United States Patent 9,976,180 (METHODS FOR DETECTING A GENETIC VARIATION IN SUBJECTS WITH PARKINSONISM) - sequence listing, part 22

SEQ ID NO: 344 - DNA, 452918 bp, Homo sapiens
attgttaggctagaaaaagattacacttcataaaaccatgtttattcaaaaaaatctattcagaaagtctggaaagcgtaataaatatctgtacagtggccacccatctcaaacatgaattacaaagcaggaacataaaaatgatgtgtaaacataactgctgagccagtgaacaaagtgctgagtcaggagcgaggcagagaagcgtgctcagtagaacgacacagatgctgcagcctccgtcctcagcccctcaagctgcgctggagtccaccttccgccctctccacaccgctcagggaccggcagcgtccttctccattctcgaatttgcatgacgcttagaaaggtaggaggcagcaaaacgtgtcagaaatgaacggagtgcaaatcaaactttgccatgtgcttgagagaatcagtaaagcgttaggtaaaaatcccaagtgcagctttaggataacaccatttaatgaacaatactggataacattaagtactattatcactttaaaattcaaacaatcttccaaacatcaatacatacacagttagtttaaaatcacagacaaatcggacttgagggtaaaagtgaaatcctcacctcttgcccatgtttgactttgggatggaattcagcaaagctctcccactgcagattgggagaatcaggtatttctcccacatggggggctgccagggaaggaggaccctatagggtggccagcaaggggccactggcggtaggtcaggaagcctgagatctagggttcaatgtgtttataagttctgtgattttcatgacccgggggtggggggttgggttatgatgaactgtgtgaggaaggagagccagttaacttttggggaggtctatgtcatttgtgcaaatcatacggagcatttcattcgttgtggaggtgcgctgagctggcaaaatgcgaattctaagaacaccttcatttacatgtcgactgctgcttgaaagcagtcacttgctatttcactaaggtttttgaaagcttagtttaacatatgataccataacttctttaggctgacttttgtggaaggatgtcaagtatcattttgttctggatatgggagggaaagtagaggtatttcacagacactcagcggagcagggccaagccagtgttctcctccgctgatgcacatcaaatacatgtaaggacagagctcgctgtgatggggagtctcgtcggtccctttggcattcttagagttcagaagctaagtctgtacaaactgggatgactgaaaaagaccatgagctggtgccccatgggcacacaaggagggaaaaccgtggccgctttctcacggatgctttccctttcacttcccccacttctcactccctgcaccagaacccactgactttaagcaaacagacaggcctgcacaccaagccaggccaaagggtccgggcagctgatgggggaatcgttgcctgtgtagcaagcagaaaaggtgatgacttttgttcatttctgggaggacagattgtgtgacctcaggattatccacttcttcctaagtttctaaaaagaagtgaaataattaagacctaaaaagcaaattcatcatggtggaagtcgttctagccttgggaaaaagcatcttctatggagaaaatgtgaggaataccctgtgggcactatggaaacaggtattcagtccgacttgctccttttatgttttgtggttctctaagaaaaaaaaaatccacatggattaaagcttgtgaaacaagtttatattttaaggtctgaaaacaatcagaccaagctaaggagttatttttcagaacgcagcacattttttctttatttttttttttttagttgggtacgagaatcgagatggagggggaacaaaacccaacaaaataacatcttcttagggaaaacctggctgtggccagcgggcacctcctgaagccctgcttgctgcagaggcgccgctcttcagtgatgcagggtgaggggctgagcggcgcctcctcccatctagtctgcttgggggccgccagggagcatcttcaacacccttacaggacaatgaaggacccgtgtgttccctctgccggctggactgggcgtcgatcctgctgcccggaacctctcactcgattttactcaatgaagtagagcacagcatggcctaaatgccccacacccgccctgtgtgcacacccaggggaatacggatcagtgtgaaaaaacagatctgtgcaacagagacacaaaacgcaacacaaagccacagcatctacaaagtgcatcgctcctgtccacgctgatctccgctgccctcccacctgtgcctctgcccctcagtctgctgggtggggcctgtgtctccctccagcctccagctggactgagaaggtttgggtgggaagccacagagctccatttctccaattcacagtttctccacagaccagaaaaatcgaagtgaacacagcaaaaccacagctttaggtgagcacacaggaagccgacacagggctgagcaggtgcgagaacccacgactccctgcaaagcctccagatagctgtgtggccacgggagctggggacagacggcagcccagtgcgcttggccccccggggaaagccgagactggaggtggacacaggctcctccgagaggcacccccttccatcctggtgacacggagctctcaaggcaaagatccagcctgccttcctctcgtctgggctcttactcctcatttgaatctgggacagaggaaaggatgggctacccagcacctcaggcaaaaactgaagggcgaggaggaaacggctctttggattattttgggcagaaccaggcatctcctcctggacgccacagtgccaaccccgtcatccagcccgtggggagccccgggatgccaggtcaccccagccctctggggccctgcaaccaccaatggctgcgccctcgcactgccactttcccaccgggtacctgggacgtgggtgtcgggagtctgaccaaaccgaccggcttcataattggaaaacagatctctcggcagaaacagaagccatgtatgagaggacccgcgggctctgaaagaagcccccggcctcgcacgggcacgcgaggtgaaggggcgcatttggtttcgcttgggagaaaagagagcgggcggggaggctggcgcagtgaggcttggagaagcccccaggtcaggaccctctccggggctgaaaaagaaaacacggacacggcgagggcgggcgccgcctccctgctggacttgtggtcactctgggtgccagacgggctccgaggccggggtctgtgagcccacgaggatgctggcaggggacgctggggccagggtcccacccgctacagccgcgtggacgtgagtctcttcatgcctctgcgctgagccaggttggatgacagcacgggctccagccgcggggcctgaggtgttctgtttagagcaaagtaggtggcggccatcgcgccctgcaaaacagaagacaagggtgagagccgcggcgcctcactccaggggttgagccggagcccggggcctccatgggcctcagctgcccccaggcaacgtgggagaaaccagagcttccccagggtccctggagcatggagtgctgttagcctgccgccaggggccagcacacgtgggccccaggagacaggggccctgtctcctgcacctgccccccccaccccatgccaccctggcactgtgcttgtgccttgggggaaaatgttttggacgcttgtggagcccccaggctgaggtcacgtgatcccctgcattctgacagtgaggccaggtctgttttggggctcgctgggtcctaggggacacagcgaatgccagggccagtcaccctggactttggccactgttgaggagtctggactcatttggaggaacaggcatatcctggagtgaatccaaattctcagaatggatctggagggggcggctcttaactggatcatgcctattcctgctggggtgggacagtctacacttttcagaaaaggagtcccacccagaggatggggtgcctgagaggctactgctgcctgaatgtaagtcacttatgaaggggactttttttgcatgtgtggcctagaatagaggctttgaacttgagtggaacagccacaccagctgccaccacgtcagcagaggctgccacctactcaggtaggagccctgtgcaatactgcacgtgtctggtgaagtgcacgaaggtaggtgggccggcggtgcagtttggggctgctatgggctctttctctgcactctgtggtttcttcggagtgattgcaaggtatcaggctcttttctgggtttcccattcccaccactctgtcctcactgtcgcctgccggtaccttcaccaggtgcacgtcctgtcggctgagctggtttggggacaggtactctctgttgaccacccacgggtgtttgagcacttgcatcgccgtcaggcgctgatgagggtccacgtggagcatcttggacacgacgtcctgccagggaaggtcatgagagtcggggggatggttggatcatttgtgctgggtcagagagcctccccagcagaactcctctccctctatggcaacacccaaccactatgctgagtgtgggtctttgcattttggggtcatgttcactttcaggtttagaagtatgtcaatggtttttagctttaaatattaccaaacttggaagttcactgaaggtttatcttttattaaatatttcatgtctaaaaagttaaatgtggaaatattagatgatgcatgtaaatcgatgaaacactgtttcttgtaacaattatatctttccaaagggaaaagctgaaataattaatattccacaggtagaaatcaattcataatgatgcacatacttacattttttatcaggactacccataaatatttactacaaataatcagaaaccgcaaaatctacaatctggagccatcagatatgtccagtgggttcatgtgcaataatggtatttttccatttcattgtaaagtcgtagcagtaaaaacctctaaaacaagattctacatgtgtgtacacatgcacatacaatacagtgcacattctattacagtgaattacatttgcagagtacttggttacagtgtgaattacatttgcggacaaacctgatgcttctgctctaatcaccataatcatccttgaggtaaatggggcaaatattacttttcctaatttgcagatgaagacattactgcctgaggaagatccaagatgagaatccatattctctccactagcctaccctccttccttagtgttcccaccacatttgaagaggtaataaaatgaattagaatgcggctgggcgcgttggctcatgcctgtaatcctagcactctgggaggctgaggcaggtggatcacttgaggttaggagtttgagaccagcctggccaacatggtgaaaccccgtctcttctaaaaatacaaaaatgagctgggtgtggtggcatgcgcctataatcccagctacctggggggctgaggcaggagaatcacttgagcccaggaggcagaggttggagtgagctgagattgcaccattgcactccagagtgggttacatggcaagagtccatctcaaacaaacaaacaaacaaaaaagaatgcatatagaatgtgaagttgaattactcattagaattttgggtcatgaaacaactaagaaatactatgcacaataacaatatcttttttatacagaaaaatctaatgccttttgatatttgataacattgaccttggtaatttcttgaaacaagtatctcctagaaaaatgagtgttgtcattttcaggtgtaaaaacaaaagcctttagggctttaataactcttttcacgatcttatagtcatgacactgagagaagcagtatttttacttcatacctgtaggatgtggagaaagacatactaatttgtagctttgctggtgtttggaggactggaggttctgttgtgtgctaagtaagagaaaggaagaggcacaggggaaagacgggggatgtggtggtggtagggactggtggtgaagggcaggaagggttggtgaggccctgtgaggcggcagagacctctgcctgcagcagcgatcttgacaatgtgcccttgtccttgactttgctccttttccaacaccttctccctgctcccatgccagcttccaagatggccttccagacacaccaccagcacccacgtcctagtctgaggctctattttgggaaccagaactaagacatctacactcatttaagacaaagtgagggtgtggacaggagcatttggactgtcagggtctgacatctgggatatgctcactaaatgccagctgccatcacctctgccaccacctccaccatcacccttaccatcattcctccatcacccccaccataatcttcaccatcacctccacaatcatcctcaccgtccttcctccatcacccccaccattaccctcaccacaatcaccttcaccatcatcttcaccatctccaccatcatcctcaccatcctcctccatcacccccaccattacgctcaccatcatcttcaccacctccaccatcatcctcaccatctccaccatcaccctcaccatccttcctccatcacctccaccatccaccctcaccatccttcatcacccccaccatcaccctcaccatcatcttcaccaccacctccaccatcaccctcgccatcctttctccatcaaccctaccatcaccctcgccatcatcttcaccaccacctccaccatcaccctcaccattttttctctgtcacctctgccgtcacccttgccatccctcctccatcacctctaccatcaccctccaccatcatctctgccattaccttccattatcttcaccatcacctccactatcatctctgccattaccctcattagcctcaccatcatccccatcacctccaccattacctccacaatcactaccatcatctctcactatcatctcccaccactcccaccgtcacctccatgatcactgccaccacctctgccacttttgccatcccttcatcacctccatcatttcctaccatcacctccaaaatgatcacctccacgatcactcccgccacctctgccaccacttctgtcatccctccaccatcagctccatccctgctcccaccattacctccaccatcagctccatccctgctcccaccattacctccaccatcatctccacaatcgtcacctccaccatccctccacaatcacctccatcatcactcctgccattatctccaccatcatttccacaatcattccctccaccatgccttcaccatcacctccatcatcgctgtcgccacctctgccaccacttctgccatccctacaccatcacctccatcatcattcccgccattacctccaccatcatctctacaatcatcacctccacgctcactgcatgaagttgcactgagatgtcaacagcagaattggaatcagagcccctgactccttctctttcagcccttttacatgaacacgggaacagctgttggtgctgcttaccagtggctggattatgatttactattggattagagaggaatttgatgatgccaagtaaaaaagcgtctgatgggcaaacgaaataaggccggtcataaactgtgtggactgcagacaaggccaaattcaaagtattttacaagaacagaagtatacctctggacaagagctctacttgtttgtttggtttatgaacatgcagggcaatcattctgcaatatcactaaaagcatggtggttaattttatatgtcatcatggctgggttatgttacccagtctagaggttgctgtgaaggtgtttttcaggatgtggttaacacttaagtcagtcgacttgagtaaagcagttaccctgcacaatgtgggtcagcctcatccaatcagtggaaggcctccttaggaaaaagactgctcccctgaggaagagggaattctgtggcagatagcctgtggtgggcaactgccccatccatttctccttggggctccagcctgccggctgccctgcagtcacagacttccccgtccccacaatcacgtgagccaatttcttacaaataaatctctctctctatacacacacacacacacacacacacacacacacgcacgcatgttctgtttgtttctttggagaaccctgcataagataccaagatagtggaaaatgtgaaaatgctaaaaatgtttttgaaaataatgtttttagatgaaaggcttaaaagatgccgaggataaggccaggtgtggtggctcatacctgtaatcccagcaatttgggaggctgaggtgggtggatcacttgaggtcaggagttcaagaccagcctggccaacatggtgaaacaaaaaagttttagtacaaaacttttttgtactaaaaatacaaaagagttagtcgggtgtggtcgcacacgcctgtagtcccagctacttgggaggctgagacaggagaattacttgaacccaggaggcagaggctgcagtgagccaagattgtgccactgcactccagcctgggtgagacagagcgagactccatttcaagaaaaaaaaaaaaatatgctgaggataaaatacctatactacttacataaaacctatcccctggcttcctcagaaatcatatggctatttcagaatctgaatatttaaaagcaacgctgggacatgtactcactttagctgcgtcagatatcgagtcccagtttcccccagaaagggcatacttcccactgccgatccgcgccagaatctcctcaggggtatcgtctggcccatttgcaaaaggggtaaatctgtataattagacaaatttgtggtaatgagcttgtattttacaacctaaaataaagtttgcaagttgatatcaccccttggctgttcaaaggaatagcactttgcttctccctcctctgctctgaagccaggattcatgggaaagcggaacttacctctaacactatgcccgttttccttccttagcaattgggtggctagaggttgatgggcaagtgggagagccctgtgagacctgtgctgtatcccctccggacccaggtaaactgggatggggtggcctagtgagttgcctggtgccgtggtttccacggtgatggtgtggcatcatgcgagagagcctgagacgtggagtctgagagacccacggtggatgtattcccaactctgtgttctttgacaagttaactttttgagcctccactgcaaatgcagagtgtatgcacaaatacacatacatgcttggtgcagctctggccatattccaagcgcgtgggaggtgttcatggtgtcccaccttaaaacacacccacacactcctaggaaaggaaggacacgtgtgctgccagcgcttcctctagtgggaaagtgtgtgatctagttttccgtataggcaaagtgagtattagaagcgtcacaaagtaacctgactgtggtattggtaagaaactgaggttccttcctttgctactgcagtcctcagggtgcggcttcagggcctgatttactctccttctgctgtggacactacctgttgacttatgatgaaataagtgaaaagcaggccaagctcattcattctcatgagggcattcaagccattttgctacagcaaacaggattcgatggtctagggttcttttctttttgcctccattcaagtatttaataaacgtaataggaaccagcggatcttgtaagatcctagaccttcctgcctagaagcaaccatggtgtgtcctcttctcactcaggggagagggaagggaggctggtacaggttaaagtgtttagcccagagtcacggctagtggcgagtggggctcagatggaagtcagctgtctggatggcaggcccaggccactttctgtaacaccacgtgtcttaccacaatgaaccggcccgtgcatgactcatgaccacgaaacccaggtacagatgctgtttgaccctgaagctgctatggggctttcggtttaagaggatgtctggaaggcacatctgttgctaccttttaaaacagtggcaggtgcagcagagagaatggggactatgctggcaaaagacttgatgttttgttcatgagctgagtttaaagaaaatgggtggctacatttcttgtccttgttgttcagttgtcctgaggggctaagaaagtctgcgagtgttcactcaaggcctgggagtgtttgcatacacgttgggtttgcccacatgcgcacactaggacagggctggccctggtcccctgacagatcagccactgaggctgctgccctgtgtctcctcctgacacctgtttgaggtgactgcttaccctgccagcatggtgtacaacaggatccccaaactccagatgtcacacgccgcatcatagccttgacgcttcaggacctaggagggaacgacaggacaccggcacgcccttcactaaggacattcagattgacagcacgtttctccagcggcatcctacgccggcaagctggggaccaggaggagggcggtgccatgtcttcggtgtgaccactgtttcttaaggcaaagccaaccctaaggtactgcagtgggactcctcccaggccagccacatggtaaactagtactctttccagacacatgacagacaggctgaaaaggagggccttaatttttaaggcagaaggatttttctgttacggtaaaatatgtatgacataaaattgaccatcaaagccctttttaagtgcacagtttagcagcattaagcccatttacattgtggtgccaacatcaccaccatccatccacagagcatttcaccttcccaaactgaaactctgtccccattaaacaacaactccctgtcccccagcccccaacacctacccttctactgtccgtctgtgtgaatctgactcctccagggacctcataggagtggaattatgcaatgtttgtctttctgtgactggcccatttcacttagtataacaccctaagcttcctccaggggtcagaagttccttccttctgcaggctggacaatgttccgctgtgtgtgcatgccacgttttgcttacccattcatccaccgagggacactctcgtggcttccaccttttggctgttgtgaatagtgctgctatgaacatgggtggacacatgtctctttgcgtccctgccttcaattcttttgggtatatacccagaagttccattctgggctacgtgataacatttaatttttttgaagaactgttaaagcagcaaaacttgtatgcatcctaggattacatacttcagtagagggcaatcctctgatatagttacagttgaataacaacaaaggaagccacaatggtgctcatggattactgcagatgactggatttagcattaaatatcgagtcgggagagctcggctcaatttccttagagatgagagcaaggagcctgtccttttctctgtatcgctgctaccatgtgtgagcctgcaccatggaggggaccagccagcgcatgctgaatgaatgtggtgctcatggtgcaagcctcacttcctaatccatcagcggggtgaccttcagaagtcacttacacacatggagcttgtgctttctgactctgtgaaacatggttaatagattttaccctgcctactttgtatggtggatgagagtgaaagtaaaaaaagttggtaaaagtgctttgtaaatggcaaaggaatatcacaacctagggcattctacaatcaataaaatcaatattgtgggagaccagaatatgccaccccaaaatatgctgcataggcgtgaggggcgctgagctgaagatacataagaagcagcagatgcaggagagctctgtgtcctccatttgtctaaaatcaggacatggattaagacaaaaggtacctacccccaaccagagaggacaaaggcttcccctagggacagctttggatgcatgtggtcccacctgggaccagcctccataggccagccctgcacctccccaagctgcagcccctggagaccctaaccctcttcctttgtcttgccaggtctctaaaaattctctgttctttgttgcagataccatgtaggctggattcaaagccacctctgtgaggatgactccttctctgggcatctcgcatgcataaatgagaagatgtgtgttaataaacttctttttctcttgttaatctgtcttttgttacaggggtctggtccagctaagaacttatgagggatgaggaaaacgtcattttcctcccccataatattatcaatattaatattgattaagtaaggcatgaacagaggcttataacctggttactttcattttttttagtttttattttttgagacggagtcctgctctttcaaccaggctggagtgcagtggcgtgatctcggctcactgcaacctccacttcccgggttcaagcgattctcctgcctcagcctcctgagtagctgggactgtgggcacacaccaccacacctggctaatttttgtatttttagtagagacggggtttcaccatgttggccaggctggtctccaactcctgacctcaggtgatccacctgcctcggcctcccaaagtgctgggattacaggcgtgagccaccgcacccagccaaacttggttatttttaaaggggccacaggttgctcaagtgtctggatgacccctgcataacctaaaacagcctctcagtccagcccctggctgcacatccgttcacgtctcagcacgcagaagcatctttgcaatggaccagtggccctgggtgacctcttaaacaactccaagacccacagtgagatgccaggcgcctcagacctggctgctcgcttgactcccctcccatcggagcagctctggtccagttccatcaagaacccacgggatccacacagactctgaagtccgccttccttcccagttccctcctcccctgtcccattggcaacatcagccacagcccttcccttcctctctttaccactggcttttctcaaaggcaagaaattgggcttagatttataaacacatccttgaattcagaacctaatggaacttgttcccgggaaatgtgaaaagagagaagttcaccaggtgcctgctagctgctccgagcggggctgggagcagacacagacactgaacaacgtaagctttcagtggcaaatcaccccggagccctgcggttctcaatctgacagctgctgacttgctgctgtcggggaaccaatctggagtgagaattggggtgcagagaaaatccgtaaacttagttgctccctgcgctatgacggatccatttcccatcccaggtgaaccgcagctctgcgtcctggttgtataaggagactactgcatcatctctctaacttggaataaatatgcagatttcatccaaattgtctacagaagacaattttacataaaaatgttactgttgaaaagttttttcaaatgggaaaatgagaatgataagaacaactacgtttaagcaagattggcccctggctcaagagactgaaggttctcgtttctgtttcccaacaccactgctgacgcagctcaagccgcctctgacatccccgctgtccggtggctctgcagtgggagggggcagagcctgtctttgcggatagagaggcctgggtctgcagtcggggaatgctcacctccggggccacgaaattggccgtgtagcagggtgtcatgagcagcccgttccccgcgcgcagctgcttggcaaagccgaagtcgcagactcggatggattctgggctccccgactcatccctgtacaggatgttactcggcttcaggtctcgatgaacaacctgcaagacagaaggcacagtgcctacttgggggctgaggactgagcaggagagggagggcaggtgcatttggaggggagggtgcatttgggaactgtcttcctagcaggtcctgcaagcaggcaacaggccaacagtgtcaacagctgctgtcttctccagagggccccccaccttctcccattctcctgtggtggtcactcacttctgagctcctggtgtcacctgcttttacagtgaatgaatatttgagtaaataagtgagcacctctccaagttgaggccgcagcttactggagctgtcacataaaaggaaatgtggtgagctctggagataggaatgaaaagcattttaaagatgatattcattcaataactactccctgtgtgcccacccccatgcactgtgaggtgttggagcagcaccagtgagcagcacagatcaggcacctgctgtcctgggtgcagcaactcgttggggagacggaccagggccacgcgatcatgcagtcactctgcaatcatgctctgaggcctcccatggaggactgcgctggctgcaatgatggtggggccagcacacctcaaagcaaagcagctatttagggcacaaagcaatgtgttctgaggggacagagggccattgtgaggacgtgtggcgtgcctttgtacagcttggatcctgaacatctcaattgtcctaatgaaatccagtgggaggatgtagaagggaattaaagggacacactccagcagtcaggcctggtttacagaggtcctgatggcaaggcaatcaaagactgtggctttacttccattacctcccctcattaaatacaagcagatctgcagaaaacatcatccaaagggcttcccctgagtttgactgtactgggaaaacctggaagtaagtgcttaatgctcaagactgggtgaccacacagaaaagaccccagtgtgtggtcctggaagaatattcccgtttggagatgactgcattctgaaaactcaggactacgcacacagctggctaagacagtatttcctgcttcaggagaaacactgggaagagatggcgcacagaggaaacatgtgatacggtgcagctgcctccctgtgaggccagggctgggaccaagagcactgcctggaaccagagagtgggagtccaaccccactggccacctactcatgtgtgaccttggccaagatactcaaactcctgtgcccctcgcctgcacagtgggtgtgatctagggttagggagtcagtgaatgaagagcttgaagtgcagcctggatcacggtgaggcccacgtgaacctcaggcatcaccgtcatccctgcctcagcgtccctgcgctccggttaatgaattctttacccgttgcaagtaacgaaaattcttaatttcttttgattaaggccaaagtatttttttggctaaagttggtaaaaatgattttagaccctcaaagggtagcagagtcagccaccccaaaatatgctgctttggcataaggattatttggagctgaaaacaactgaaaagatgcagatataagcaaagctctctgccctccccttctttacctaaaaggaggatataaatgggtaaaggtgtccctcctgtcctctctgcctggaaggatggaagggaaactcctctagatgcttacagcctggagaagcttccagaataatctctataacaaatgttcctaactagccctcatcttctgttagtttcccatagacttagcttcccacagtctgctgccttagaaacacagtcctttttctttgtcttctttaaaaattattattctttttaaaatttaaaaaattttaaaatttgagctcttttagggctcctgaaggaagcactaaacatggaaaggaacaacaggtaccagccactgcaaaataatgccaaaatgtaaagaccatcgagactaggaagaaaccgcatcaactaatgagcaaaataaccagctaacatcgtaatgacaggatcaaattcacacataacaatattacctttaaatgtaaatggactaaatgctccaattaaaagacacagactggcaaattggatagagtgtcaagacccatcagtgtgctgtattcaggaaacgcatctcacgtgcagagacacacataggctcaaaataaaaggatggaggaagatctaccaagcaaatggaaaacaaaaaaaaggcaggggttgcaatcctagtctctgataaaacagactttaaaccaacaaagatcaaaagagacaaagaaggccattacataatggtaaagggatcaattcaacaagaagagctaactatcctaaatatatatgcacccaatacaggagcacccagattcataaagcaagtcctgaatcacctacaaagagacttagactcccacacaataataatgggagactttaacaccccactgtcaacattagacagatcaacgagacagaaagttaacagggatacccaggaattgaactcagctctgcaccaagcagacctaatagacatctacagaactctccaccccaaatcaacagaatatacatttttttcagcaccacaccacacctattccaaaattgaccacatagttggaagtaaagctctcctcagcaaatgtaaaagaagagaaattataacaaactatctctcagaccacagtgcaatcaaactagaactcaggattaagaaactcactcaaaacctctcaactacatggaaactgaacaacctgctcctgaatgactactgggtacataacgaaatgaaggcagaaataaagatgttctttgaaaccaacgagaacaaagacacaacataccagaatctctgggacacattcaaagcagtgtgtagagggaaatttatagcactaaatgcccacaagagaaaggaggaaagatccaaaattgacactctaacatcacaattaaaagaactagaaaagcaagagcaaacacattcaaaagctagcagaaggcaagaaataactaaaatcagagcagaactgaaggaatagagacacaaaaagcccttcaaaaaattaatgaatccaggagctggttttttgaaaggatcaacaaaattgatagactgctagcaagactaataaagaaaaaaagagagaagaatcaaatagacacaataaaaaatgataaaggggatatcaccaccgatcccacagaaatacaaactaccatcagagaatactacaaacacctctacgcaaataaactagaaaatctagaagaaatggataaattcctcgacacatacaccctcccaagactaaaccaggaagaagttgaatctctgaatagaccaataacaggctctgaaattgtggcaataatcaacagcttaccaaccaaaagagtccaggaccagatggattcacagccgaattctaccagaggtacaaggaggaactggtaccattccttctgaaactattccaatcaatagaaaaagagggaatcctccctaactcattttatgaggccagcatcatcctgataccaaagcctggcagagacacaaccaaaaaagagaattttagaccaatatccttgatgaacattgatgcaaaaatcctcaataaaatactggcaaaccgaatccagcagcatatcaaaaagcttatccaccatgatcaagtgggcttcatccctgggatgcaaggctggttcaacatatgcaaatcaataaatgtaatccagcatataaacagaaccaaagacaaaaaccacatgattatctcaatagatgcagaaaaggcctttgacaaaattcaacaacccttcatgctaaaaactctcaataaattaggtattgatgggacgtatctcaaaataataagagctatcgatgacaaacccacagccaatatcatactgaatgagcaaaaactggaagcattccctttgaaaactggcacaagacagggatgccctctctcatcactcctattcaacatagtgttggaagttctggccagggcaattaggcaggagaaggaaataaagggtattcaattaggaaaagaggaagtcaaattgtccctgtttgcagatgacatgattgtatatctagaaaaccccactgtctcagcccaaaatctctttaagctgataagcaacttcagcaaagtctcaggatacaaaatcaatgtacaaaaatcacaagcattcttatacaccaataacagacaaccagagagccaaatcatgagtgaactcccattcacaattgcttcaaagagaataaaatacctaggaatccaacttacaagggacgtgaaggacctcttcaaggagaactacaaaccactgctcaatgaaataaaaggatacaaacaaatggaagaacattccatgctcatgggtaggaagaatcaatatcgtgaaaatggccatactgcccaagctaatttatagattcaatgccatcccgatcaagctaccaatgactttcttcacagaattggaaaaaactactttaaagttcatatggaaccaaaaaagagccgcccgcatcgccaagtcaatcctaagccaaaagaacaaagcttgaggcatcacactacctgacttcaaactatactacaaggctacagtaaccaaaacagcatggtactggtaccaaaacagagatatagatcaatggaacagaacagagccctcagaaataacgccgcttatctacaactatctgatctttgacaaacctgagaaaaacaagcaatggggaaagggttccctatttaataaatggtgctgggaaaactggctagccatatgtagaaagctgaaactggatcccttccttacaccttatacaaaaattaattcaagatggattaaagacttaaatgttagacctaaaaccataaaaaccctagaagaaaacctaggcattaccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacaaaatgggagaaaattttcgcaacctactcatctgacaaagggctaatatccagaatctacaatgaactcaaacaaatttacaagaaaaaaaaaaacaaccccatcaaaaagtgggcgaaggacatgaacagacacttctcaaaagaagacatttatgcagccaaaaaacacatgaaaaaatgctcaccatcactggccatcagagaaatgcaaatcaaaaccacaaatcaaaaccacttttcattaaaaagttaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgtggcactattcacaatagcaaagacttggaaccaacccaaatgttcaacaatgatagactggattaagaaaatgtggcacatgtacaccatggaatactatgcagccataaaaaatgatgagttcatgtcctttgtagggacatggatgaaattggagatcatcattctcagtaaaccgtcgcaaggacaaaaaaccaaacactgcatgttctcactcatacgtgggaattgaacaatgagaacacatggacacaggaagggaaacatcatactctggggactgttgtggggtggggggagggggggagggatagcattaggagatatacctaatgctaaatgacgagttaatgggtgcagcacaccagcatggcacatgtatacatatgtaactaacctgcacattgtgcacatgtacctaaaacttaaagtataataataataaaattaaaaaaaaatttttaaatttgagacagagttttgctctgtcgcccacgctgaagtgcagtggcgtgatcttggctcattgcaacctctgcctcccaggttgaagcgattctcatgcctctgtctcctgagtagctgggattacaggtgtgtgccaccaagcctggctaatttttgtattttcagtagagatggggttttgccatgttggccaggctggtctcaaattcttgacctcaggtgatccacctgcatcagcctcccaaagtgctgggattacacgtatgagccactgcatccagcaaaattattgttcttttgttaaaatgctatataagctcaagttctaacaactccttggagttattcatggctgggtgctcccgtgtgtatgtgagatgcacatgttaataaacttctgtttttctcttgttaacctgtctttggccagtcttgtttatagggcctccaccgaagaactaagatgggcagagggaaaaaagaatttttcttttctttttttttttttgagatggagtctcgtcctgtcacgcaggctggagtgcaatggtgctatctcagctcactgcaacctccgcctcctgggttgaaataattctcctgcctcagcctcccgagtagctaggattgcaggtgtgtgccatcatgcccagctaattttttttttgttgttgttatttttagtagagacagggtttcaccatgttggctaggctggtcgcgaactcctgacctcgtgatctgcccgccttggcctctcaaagtgctgggattacaggtgtgagccactgcacccggctgggaagagaatttttcttcccttgcaccgtcactgagcctccagacacaagagagacgatggtggcacggaaggaattccaggacaatccgcgttctcagctcttgaacccataaacccttgtggttttggttcctgccctgaagctccctcctccccgaaggctgccccaggcatggctcctaccccctgggaatggaggtagtccatggtcttggtgatggtgcacaggacgtcactggcttcgcgctccgagaagtatctctgccggaggatgcggtccaggagctccccaccacgcatcagctccattaccaggtacacaaacttgccatcatcatagacctgcggagtggagaaggggcgcacacgtcaccacggctggttgctgtgaaagagcaactactccagaggggacaggagagggaagtcagaggggagaggctgggaccacagggtcctatgggagtgcaaacaaggcttctgcagggtagaagcaaatggccattcctgtcataccatatgtgctctttttaggaagaaaacggctttaataatctgctgctaagcagggactgagtaaggacatacaagatgggcgtgtccttagctgagatgaatggcttcatgactctgccaggagatatttgttatttatttattattattattttttgagatggagtctcgctctgtcacccaggctgaagtgcagtggcgccatctcagctcactgcaacctccagctcctcctgggttcaagcgattctcctgccttagcctcccgagtagctgggattataggtgcacgtcaccatgcccagctaatttttgtatttttagtagagacagggtttcaccatgttggccaagctggactcaaactcctggcctcaagtgatccgcctgcctcagcctcccaaagtgctgggattacaggcgtgagccatagtgcctggcctgccaggagatatttagacgttaagaaatgcaaatgttggcaaaccaccttgcaagagcagggcctcaaggcagtgcttttcaaactgtaacgtgcatccaatccaatcttggggatcttgctaaaatgcatgttctggtcctgcagactgaggtggggcctggccctccgcatttctaaccagtttcccatgatgtctgtgctgctaccgcatggacagcactgagtggccaggcgctgggagcacagagaggctaggcagagtccagggcgaagttacatatcagagccgtgctgttgcttcagagaagcaatagaaaaagatagttttctccatactggcttttatctcataaactaaataaaaacaatatgctctgattattctttttatgtttcgattttttgagatggagtctctctcagttgcccaggctggagtgcaatggtgtaatctcggttcagtgcaacctccacctcccaggttcaagcaattctcctgcctcagcctccggagtagctgggattacaggtgtgcgccaccacacccggctaattttgtatttttagtagagatggggtttcaccatgttgaccaggctggtctcaaagtgatctgccttcaggagacctcaagtgatctgcctgcctacgcctcccaaagtgctgggattacaggtgtgagccaccgcacccggcctgttcgggctattcttatgccaagcttgcatgttaagaccgtttgcacgcagcagtcactatgcatgagggaaactgaggtaggcccaatatcctgtgactctaggttcataatgctagaatcagtttggagttggagcgtgaggaggaaaattgtctcctgtctgtgctcccggatcccaaaccctgcacccccatgggcctctatgagagactccgcctgtggactgtaattcacacaagctctctcttcctctgttttacttgctccctccatgactggggcggtggctgtcaaaaagacttgagtacacagtccagcaagtcagctccaagtgactgagatatgtgggtggtggaaaccagctgagacaggcatgagatgtgagaaagcttgctctgagtgaatgggagttttgtgtcagttgaagaaacagaaggaagtggagatgctgttgcacggggaccactcacatccttgagggtgatgatgttcgggtgctggccgtaccgcaggaggatctcaatctcttccgaggggtctctcttgctcttatcaatgatctggaacaaacacagcacatggcagtgaggggtctactttaggctttcgggtggtatctgctggtggaccattgagtttggataaagtctggccccaggtggcccaatcactacaatctcacacccgaccaagagataacctgagattgtctggagattcatggcaagtcctttctttgacaactagtgtaagatttacatctacaaagaggagtacaggctgggcaaggtggctcatgcctgtaatcccagcactttgggaggccggggtgggcaggtggcttgaggtcaggagtttaagaccagccagcttggctaacatgacaaaacctggtctctactaaaaatacaaatattagccagacatggtggtgtgtgcctgtaatcccagctactcaggaggctgaggcatgagaatcacttgaacctgggaggcagaggttgcagggagctgagataatgccactgcactccagcctgggtgacagagcgagactctgtctcaaaaaaaaaaaaaaaaaaggagtacaagacttcagacatgaattttaaggtgttataaggttgggtggagacacgtgtagggagctcatgcaagtgccaccaaataacagactgtgtcccaccctcgcagtgggcaccatccacaacaagcctccagccactgtgcaccttctgccttgttccgggaattacaaaccagccacaaaatgaggtgaggcgcatggctctcaccaagagatgctggggatggtgcgcaggccagacctgccttgctgtttagacatatgcaagctcccctcccccgcccagcatctgtatccgatgtcttaggataacagataaagttgcttcaaccccatggagacatatggtttctgaggacagggtgttgggatttaagcctaccttggaaacaggaagtcgctgttggtccctggtggctaatccctctggaggtgcctaagtcccgcccttgccgcccctgctgtggggacgggaccagtgggaggagggcaccacactcatgggaaattggcaacatgcaacatgtattttgcaaacaacactcagagcagaagaaaagcgattggaaacaccttcctaaccatgatttgtactattctcacattagttcaacctaattttaaaatagtctctatttggagaccgtgcagtcattttactactagaatatgagggtgacttgcttttaacttctatcatgtcaaagtctctaggcagagctttgcataaaactctatttcgttaattttttttggagacagggtctcactctgttgcctaggttggaatacagtggtacaagcatagttcactgcaacatcaaacccctgggctcaagtgatcctcctgcctcagcctccagaataactaggactacagaggtgtgtgccaccctactcagctaatttttaaattctttgtagagatgatggggtcttgctgtgttgcccaggctggtctctaactcctggcttcaagtgatcctcctgcctcagcctcccaaagtgctgagattacaggcatgagcaactacacctggctatttctttactttagagaaccaaacgcttgggtagcatttgactcactgctcataatctgtcccctggtcacccttcgtccactccccgtcaccgttataaaaactcaccatagtgccagttctcaccccattatagtttcaaaggatgctctgccacggccaccattcagctgtgactgcatcagtggcccatgatctgtgagtcctaatagcctgcgttgtaaacaggcagaagagttagggtccctttctggacatagaatttctctccttctgctgcatttaattctactgaagttttagctaggacactaggactaattctattgccaacataaatgcatcattctcaagtagagacttttaaaacgatcattcaaggaggggtgggggactttccctaacatgccacagcctaagcaggtcctgggaggctggtcctgcactgcttgtagggaagctggctgtcaggtacccaaactcctctgctcctgtctgcctgtgggcatcccgtctatcggggccgggatcctgtctttgcaattagagaaggttaaaatacatttataaatttataaaagaattcagtagaagattttttcgcaaatatgatttcatgataaagggatgtgttcttagcatgaatctgttttatcactctcacagtggaacaagatgcagagtaaacaagaaagtgggagctttttctccaccgccacggaccatcttcaagatacaaggagtaaaaaaggccgacgcgagcaggtgcatcctacgccatcccttgttttaaaaatggagagaagaatgcagatagacgcatccatttccttgtgggtgcataaaataaccctggaaggaaggaggaaacatttaattgccttgccttcctgtgaggaggggaacagggtgcctgggggcccatgggtgggagggaaactttgctgtatccacatgaatttttaaaaattttgaaccacaagaatatattgtctattcaaaatatgaaataaagaattccaaaatttcagcttactattttgtaagctgaaattgcaggacaacgtgactattattttaaagaatctgggactacagatggctgccctctcaaccctagtatctattttatttctatgtgttcttttgttgtgagtcttcagaaaaattctgacttacaatgataagtatttgtaaacagttttcaaagacagattaccttaaactcttgcttactttaaaaactatcttaaattgtaataaaagctagcatgtatgtgcacatgtgaggcacactggatttcaacccatcggagccagtgtcctggtcatttgctagaatctgatacacatttaagcatgcatgttgactttcattacattttcaacatattagttacgcctttcaaaatcatgtaattgcttggtggaacccccaaagcacctctgtcaacaaccaaacaccacacaccagctgttcgctgaggtggcatttggggaaatggaggaaaatgaaagaagctcccaggctgaggtcctgtggggacaggagctcatctggaggagactccaaggggcccacgagtgctgctgtttctcaccacagggtagagccagcggtctttcagcaaacatctggtttgctcctgaggggaagtcacgtttgctgtctcaggcgacaacactgctgtgggtgtgggtggcttggcctgtggccatgtcacttgctggtacttgaatgtgggtgtctgcaggctcagctcccgtggagggctggaaaggtggaggaaggcgttgctcctggggaggccacgtgctgcgtggttggcggcccagccgctgagccagtctgagccccagctgagacctggcctccctgtccactccctgtggggttgcaggagctccctgggcctctctacacctagctttcttcatctgtaaaactagaaaacaccaggcactcctctggctcactgttaagattcaacaaattaatatgaatcgatcccttcatactctccctggtacacagaaagcacttggtacaagtgagttattcctattacagagataaaatagaattaccctgacaccgccaggcaagggactaagcagctgtgacctgccacgtttacagccctgaaatgctgctttcggtcctgtctgaatcctcactgcgagtccgtgccatgaagcagtgtgatgtttaaaactaatgtcagcagtagagcgtgtttcagttaaagccccagaaaaaaaaaaaaaaaaaaacctcagatgtcacaccaactgggtcaacccagaggccttaattaaaggatcgtttgcaaaggagtagagtggctggagggtcactggccggccagcaaggcacagtgtaatgccttgggggcagtcctggctctcaatgccaaagagctgcgcagggtcagtcacaggaccagaaggggctgcatggggtggggaggtgcgccctgacaggggctgtgggcagaaaggcctcggcccgacacttctcttcccactcttgtcctgtggtgtctgtctcgcactagcagaactgcccaggagccagaggcatggaagtggtccctaacagtcagcctcctggcttccttgcctcctggcctcccagcctctgaggcacagggcagcgaggagggtgggtttgcatgggaaatggcgctccccgtcctggaagggaagtcccacagactggggtctctcctgcctcagcctcccgagtagctgggattatagggcacatcctggaagggagtcgtggcgggaataggttctcacacgaccctcctgggctcccgccttcccctgacccgggagaattaatccaaatcaagccaaggctctgagatgaagtggcaaggcagttctgacccagcgtttccgtcccggatgctgtcaggaagtgctggctgcttttccctgtaactttttctgaaaaaaaaattttttttttttgcttttgtttttatttttgcatggagggtgagctatttgagcaaggtaaggctggagagtgctaacgcaggagtgggcagtgaggtgtggctacagtcctggagtacatgacctggatctgctgcgggcagccggggtttggacacactgtttaggagcaccagggagtgggccccaagtgcctgccagcgcacttcttctctatggggtcggtttcttggggttgaccgtgttggtcttactcttattagagcaagctctggtggacggcgttcctcattctgagaataatattgttttataatctttattatgcaacaaaacagggaggccttctcagcaagcgtggtgatgaacaaggcctcccctccaggctgacgctcaaataatgctgacgcgccacggagtaggagtggtgtcgtggggcgggggacaagctcgctcagctttctttttctcatctggcaacagctggttagaaaggactcctacaacctccagagaagggcattctccaggggttggccacccaccacagccggtaaataaactttccatggtgttgccaccgagcaggctgaatatttccaccttccttagagatgctgagtctaggggtctgaatatccacgaagcaattctgggttcaacatggatggcacaccaccatgatcttcctgagcacggacacatgcagccatgtgccaaacaaacactgccattcctgctggccgaaggcgacaacaggagacttcgctgctcttgataacacctttcctcctgctggccgaaggcggcaacaggagacttcaccgctctcgatacacctttctggtctttgcgtttctctaccttccctgtctttcttgtctctctccatcagtggagacaccgtctcccgggacactcagcaacctgagcagatggctttgaggcagtaactacgcgggcagtggcatgagctcacaggcttgcagaacactcccactaggcaggccatttcccttgagttgccgaaaggatcagtatcgtatttgacacaaaggtaggagagcatgtaatcatttgtaaaatttaacagacaccttctcctgtaaaattaatttaaactaatgacagagagaaagaactcctgttttatcctggtagaaaaagttaaaatttccaagctcatcagttctccttctaaaaataagctctattcatgccgaacatctgtcttaattccgtttctttttttggttggcaaattacacacacagtgtgaagatgggcacagaaacaccacgttcttttcaacggtctcacgtgagtacagactggagcctcctcaggaaggctggcccgcgctccaggcctgcgtggtcacgccgcgtcactacagttaacagctgggtgacacatattcttgcacagttctaaggatctcactttatttcttatcagattctgttgctaaagcaaactaaggtactttcaataccataacaacaaaaatttgctaccgaaaagggagagtagctgcatcttaactcatgtgcttctttctaggaaaacccagccccactgagcttgtgcggtcttcttctcctgcacgagctttcagacaattgaagggaaatttacaagtgcaacagtcagtgaacaggcacgtatattggtaccatgtgtttgaagatacaacaggccaagagaaagagccaaaccaactgtaaagctcatttaatttcagattccggagatgcactccactttttggtatagtttctggttctgtcattgacacaattcctaaatggctaagctgtgagctccctggagcaggtttgtgttctcaccttgccctgcgtctgttgcagtaaaagcgtccaattaaaaaaaaaaaattctcaatgaatgaaaaaagtaaccagcttcctgaacaaggggattgctgcagaaagaaatggattccaaaggcacgaagtgctctgttgaagaattatattataaaccccgattttaaaaatttgaatttgaaggaaagctcctgattcatattttttcttgtctttatttttaattaattaattaattaattatttgagatggagtctctctctgtcgcccaggctggagtgcatggcacaatctcggctcactgcaacttctgcctcccaggttcagatgattctcctgcctcagcctcctgagtagttcggattacaggcacgcgccaccatgcctggctaatttttgtatttttagtagagacggggcttcgccatgttggccaggctggtctcgaactcctgacctcaggtgatccaactgccttggcctttcaatgtgctgggattacaggcatgagccaccgtgcccggccatatatttttcttttaatcaacacttagcctttcactaccaaatatttatgctaaatgaagataaggagccccttcattgtgtgctgaaattgagtgagctcctgccatgtgcccgactttgttgaggtgctggaactatagcaaaagcaaagcctttgttgccctggagtggctgccctcacagggccgtgcacacagacagtgaacaacccatgcagggggaacgtgccatagggaagatgatgtgggtgaggggggctgctggctgcaaaagatggaggcggggaactaaaatcagggcatcctgtgggctttgggtgcatatttgtgttctctggttggtcctgacttggaagcagggacagaacttaggaagctgtcagtcattcatcaagtcctggccatgtggggctgactgtcacagaatttatagttcagcttcctgggctgtcactagagatagcaatctggcttcctgcaagcctgacacagctgctggcctcccgagctatgtattgtagataaaggggctggctgcaggtgtgggtcagacttctgtcgggcacccagcctggccaccatctgctgtgtatccactctcagcccccagagcccgcggaaggaaccagccttggggacactggactttagcccagtgagacagatttcagaattctgacatccagagctggaagacaataagctcaggttgttttaagccactagatgtggggtaatgtgttgcattcctaaacaataggaaactagcctgtgttgaaagaccggggagaggtttgcagtgggagagttgagagccaagttttggctggtgggtgggagcctgtgagatgggctcggggacccggtagtgggcagaaggcacatgctacatcttattgctgatgaccgtcctccgccgcatgcctgctgggaggggctgagcatacgagaaacaaaaccataagccaatcacattaagcctttctcgtttcgaaaaagcaaaagtgcagctcgctgccagcgctcatttgattttacataaacatgttcattaaggctgaaacaaatctgattttccatgtgaaaataaaatttaaaaactgttactggagttatttctaaacagaactaatatcagaatcatctgaatcatcagaattgtctattttggaaaaattggattcatcaaatgaatctttggccaacaactgtttgagaacgaagttaacatcccatgtaggaatgctacgttttctaggatttgacattatcagcaatcgattatgactatattttgtaaatggaaatgccactactaaaaacagaatgctatcgatagaatgatgtcctttgtttccaaagttggtatactagagcggtgcaaaaataataataaaagtgagatatttcgcggcaaagttatctcggggcaaacgctgcagccgcaagtgccgccggtgagtattcttggggaaaacgggcaaagggttaaatcatccagaaaggcagcttcccagtgtgtgtttcgaggagatacaaatgcccaaccaattccactgaggagcttctttgattagagaatgcctgtgcagagacacaggctggacagagcatctattctggcaggcgatacagtcattttcccgtcttcgagtctctctcttctggtggaagagaaatttatgccaccgttttcctcagtcatgcaatctgttaccaaagctgccccgtctccttccttgtccatctaaatgttgctttctttcttttctattttctattttatttaactgctcctagtcccggcctctgtgcctgtgaacgctcctttctctgtttccactgtggctgtgaaggcatctacagcctctgcctgtctctgcaccactgctgttcttgagatggttcatgttgctccttcacatagctcaactctcaactgctgtttctctttgcttcaaattttcacatgatttctatgaaaaatgcattttgatccctaaagacaggactggcctggacctctctcttcccaggtttggccacagtggtttgactcagctgcacagccacctctgttccccaagacgggtgcagctaacaccccacgtgatactgggaagccccatggtgaaaccatccactgctttctcaatggcttagaattctttgcaggacctggcactggatcctctggagtgaacttgaacacaagctcccctgagtcctctccttctccggccccgtgcggctcactgcagcgcccagcgttaggccatgggctctttcaagatgtagcttctgcaacaagcccaggtgctgccctgaggacgagcaggctgtgatccacaggagccggggctagtgctgccagtgacctcggagcacagactgaaaacagaggtctacatgaacgcagaccatcctgaatgctgtggggaaggaagctggagcagctgccgggggccgggggccgggaccctggctaggggcctcgcagctgagtgctggaggaaccaggtgcactgtgcctttggaggtgaagttagaggaagcggtccggctgccgctcagcacttacacagctgaaccatggcccacttggtggcagcaggacctttcactggggtacacccagactcataagaccaggagactcaggtgcgattttacatagagctccacttgcacctggcacaccttccccttacagcctagggactttggctatttatcaaacaatggatttttcttgcaggtcccatgacttgagctttccagctattctgaagcccagccttactgcccagccccatctgctctgaatactgcctcattctttcatggtttgggtactctgagatgcatagagcatctggctgaaacagaacactggggctccccgccttatgacgagtgagtctgctggacaggggtcgagagtgtgcactcggggtctgactgcttggacgggaacctgctctctcactgaccggctgcgacttctcgcatatgtgttgaaccgttctgagtttctgttccctcatggggataatgaaaataattacaccgtgggatgctgtgaggattaaatgacttcacacatacagagcgcttatagcagtgcttggcacgtactgagtatgaagtatttactctcgtcatcctcgtaactctcgtcaccatattctatctaacgcctgcagctcctggtctcaggaacttcagttctcgggcagtttcctcttcatatgtgtactgacgttggtgttttgcaaaagagggtcaaggtggcaaaattggcactcgaatgatgtaatgtagttttatgcctattatgacatctataataaataaaaacttcagtcattagtagagatggccaagagctctctcaaggtatgtgtattaagcttatgagaaggggagatactagtgacacaagctaacatttctgtagtgaattagctatgatatgtgtagacagttgacccttgaacaacatgggggttagaggtaccgacccctcaagaagttgaaaatgcacatataacttttgacttcgccaaaacctaactaatgtcccactgttgacttaaagctttaccagtaacataaacggtccattaacacatattttgtatttgtataattatatactgtattaagaataattatacaattatatactgtattaagaatacagtatataattctgtaataatacgatctagaggaaagaaaatgttactaagcaaatcataaggaagagaaaatacatttagtgtatgggactgtatttatggatatagtgagtttatgccatctgttcacaagatggatcgtctgtctgaaaaggggggcactcacagctgcagacctcaacctggggtacgtatcatgcaattcaacttttgttttttttggtcatgtgatgacttttctctgcctcttgggagcactcacagcgtccctagtggcacgggacttcttagtggttctatggtgttattcaaggtttatggaactgcactaaacacggtgaaaaatatgtgagaaccacaagataccattttttactgctattcccaattccctggagagacagactcctcacatggagacgaggagtgtcacaggacgtttaaagcggatccttccaacacctgagcttactacagcagcaatggaaggctgctgtgaaattcttacggtagtgccatattcgccacagttaatttgctgcagctatgatttaatgctgaatctatgtttgtttacatttatctcaactgcaaatggcgccacgtatggtctatgcttgagcacataaattttgatacattttaagtttgtataataaatctgtgtatattttatagtagaaaatgataaaatagactagcatctatgtatattttatgcatcctgacataccattttcttaactttttaaatatttctaggctatgtggtttgtctgtgagtttcttcaaattgtaacaaatctctaaaaaattttccagtatatttactgaaaaaaatctgcatacgtggatcctcacaattcaaccccgtgttgttcaagggccaactgtatatatttacatattcccccaccaatataatgccaggaatccttccatttatacaaatcagcactatctagaatatgtacctaattatgttaagcaacaaagtcctaagaataaaataaaaacaaataattccctctctcaattcttataaagtgaatacagcatctttgatggaataggaatattattttttctttcaaatacacctctccccttccttttaatcctcctggatcacgattacctccaacacttaatagtcacttctattttaatcttattttaaatgaagggtgccctaatgtgcggacagcaatgcagccatccgtcatgctattttgaagccctatacaacttcatcgcccaccactagtctccctgggttggttataaaaacaaaggcggactttagttttccattagattacttagctgttttgtcccaataaaatggcttgtagttattagaaagtagggcacatctgttcacctacaatgtgtctgataaaaggaagaggaagcgctgagggaacataatagcttttctcattcaaccatcagagcactggctgggggcaccggcagaatgcgctgcatcaagtccagcctgaaacagtgccgtgcgcgtgagaaggaagagggtcggtgtcttcccgcccgaggccggactgccccagtgaaggatcttggacgttctagtgttgtttgccgaagtcgagagggagggacaagcctgggaatccaggttgtcattcagcccacgtgaattgagcccctgctctaagctgggcactgtgttggagactgcgatagctagaattggtcttaattttagtcctaattttaggaccgattctagctgtcacttcccacaacctttggcagagtacccagcatatagcagggactcaagttaaaaatgcagctgaaaataaatgcaaagtgaacaatcttgtcgtttgatttactcaggtaaactggtttcagtagaaccttaaatgtagtttacgttattcagggtaattatggtggcaaaattagaaacctgcaaaaatgcagaaataacttaaagcaaaatataatgatattctaagaatgtgagaagtactatgattccatactcactatgaacctccatacctgaccgtcatagaggtgaagagctggccccactctcctcttagaaggacctgcactttaagtcacggcccagtcacagtggggtgggggtggggggctgcccgcagcacgtggggaacactgagctgttggtcggtcatcatcctgttgctaaaggactcaccagaaactcaatgaagaagaaaaactccatccccatctccaaaatatcaacctcctggcctttatctacatgagacctgctctcacccacaaggatgctgaggctgggcttctcaacctttcgttggggcagcaggttgtgggggctgtcctgtgcacacaggatgctaaccagcttccctgacccgtattcaccaatgccaggagcccctgtcccagctggaaaaaccagaaagtctccagacattgccagtgtcccctgggggccacagttaccccaaatgaatatgactgccctgggcagaatccatcgattctggtcactctcctcattgcttactaaagattgctgcatttctctttctgtcattactcggtggggacatttctgggtcatccctgccattgaatgggaggatgccctgtctggctgtgacgggactgcttctgaagcagaccccgtttgtatccatgagccaggggtaggtgggatcgtatacggctcaagcggcaactgggagtggtaaagccggattctagtgacaatctcggctggacatctgctgagctgagatccaactcacacatcagataatcagctgccacatgcttagttctgggtcatgttagaagtcaccgaactttgctgtttcttagtccatcaataggtggggatgctgcttctcatgaacaagtcagcagatacagacaaaggccaaaagtatttcaactacattccacctggaaatgctgaaaacaaaaccgcacagtgctctgcactgggtcaaagcagttttggtaacaagtggacccattctaaataacaagctcgttgcacagaaatgccaattcgtccatcttggaaggaaatccaaacaaccgtgtctacctgcagataattgaacttgttgtcaccgctcccttgaccggctgaaacgtgcttctgaagtggctctggtcacaggagccttctggaccacgagccacatctctctaaaaagtcccgggccgttcatggggctgcaccttcccgtgctcggttaatttatgcatcttccagactacacattattacccactgtagtctcagaagggacaagggaaatccctgccatgtctgctggccaactttgtccagggaacttcagggtttgtgaaagagaaacaggaagaccgggctctttcttctaccatcggccagagccacagtgcctggcttctctccccgagagctgttgctgaaattccacagagtttgacctcaacaagatctttgaggactgacggactgagtttaagctgtgtaacaaagctgaattcagacagtgtccatataagagctggatatgggaatattaggagaaaacacaccatcgcctcgtcactgggggatttacttgcagaggcacaaaatgggggctgatccgcaggctgtttctggaagggcaccgcggctgctgggctgaccaaaccgtaggcttgtttctttgagctcactgggaagcagtgattgtttctgggattgctgtctgtcacctggtaaataatctaaagaaatcctgtgagcaatgactcaggcagaaaaaaattccaaggagcctatgtaggcttacgaagcacatgtgaaatacgtttcaaagtacaagtgaaattctcttgtctaaggcagaatacaggtctgctcttcaccactggaacatctggacacaggaacggcacctgggtatgcagatggtaggcgcccatctaagtgctcctttaaaaaactctcccaatgggatggaggagcaggacaaaccaatctcaacaatccaaatcctagaaacgcatgaagcctacgcgccccaggctgcagaggcaaccacttcataacaaaacttggttttctcctgcccttcacaccacgggtggacattctaccatgacagtaaccctcgctgcagtctccacccaattacagttccaggaactgtaaatcatgatctatttccttccattcacccttcctggatgtgttcaagactctgggcagactaaacacagagatggtatcagagcaaatcacaaattgattatttctccatatttaaactttctttttttgtttgagaaattcaagataaatttgtcaataatccataaattcttgacccaaacaaaatcaagggacctgagattttttttcggctggcgtcttctatgacagcaaagcgttttcccagtgcaagaaacacggtagacgttcccagtgaatatgcttgaggatcccaggccatgcttgaggatctacccttttgaaatacctgttttcacaaaatgtcagtggagctctgggcaaatgaggatggaactgggtcatctcaacattgtcattattttgaacaatctcttcagagtgtaggagaatcacagttgatgaaaattactctttttacacgacttgctggctgggcagatgttctttgaagggcaagcgtagcaccgtgtgctacagacgtgtctgggaataagccgggagggtcctggtcatgatggcaacacaggctgggacctcgctctgcgacagcctggggtttggctccactggaaaggggcagagtttcaagtgtctcttgctgtcttttggagaggatgtacaatgtatctttttttaacataaatttcattctgattttagcaggaagctttacctttaatccacattttactaaccaaaaatctctagaaactggtattctggattcccagatcaaatatttaagcagcaacaattacgaaagctaaagttactatgtagagattgccaaattgggttacaaagaattgtttctctatactgttcttgacggttgggagtaaaaccattagctctctgccaaagtttgttgtaagtaatacaagcttatttatttctttgagtattttcttcctcccttttttctttccttcctttccttgccaaattctatacctgtcccccaactctgttttctcaaaatactgggggcccaaaacttttgctcttggtgtatgtcatacaccaagctacgaaaggtgctcagtccctgcgtggtacatatgactgaaaatattcatgatttgcaaaactaccttttaatgggtgacctcatatcaaagcaaactgaactccatcatatcagagcttggaaaatggcaaatggagagaatgttcactcaggctcaggtgtccctgctggagtcactgcacagctgagcacgtgagcacatatgctgtgctcctatgctccgtgctcccatgtgctgtacatgctcccacacgctgcactcacacagggccctgctatgctcctatgctccgtgctcccacataccacacgtgctcccacgcgctgcactcacacagggccctgctcactcagcaggcctgccttaccttcacggcatactcggtgtctgtggctttatgcacacatcgcttgcacactgagtaggagcccaccccgatgtcctccttgatctcgtagccatcggtgaagtggatgttgttcccgtgtaactgctgcagagggaccaagagaagaagagttgtcggaaccctcacacgaggggacggtgcagctacacgcacacagaatgtggggcgaagagaggcaccgactgtgaactgagtgtgtggaggcctgggagctcatgggtccccctgcccaaggctgcagagctacttagtgatgttcttgacctaaatgccagcttctctgattccttgggctatgactcttaactttgagacaccaggccgttctgtgtccactggctggtatgtttctcgcaaagatctgagagcaggagaatgtgaaagtgaaaaggaagtgctggcagctgctgggtgcgtggctccaatgcctgtgtgcagagcaagactctggatggaaacatctcatcggaaatctgactccatggtgtccaagtcacagcctgctctgacctgcatgcagcagccccacccacccgctcttaactaagacagaaagccaccatggcagcctgcactgtcatgacaacgtctactttacacacctgtatttctccaaaggccagggaaggaaataggatggaaatccaatgccattcaacttacccggatttcattcttaaataagtttaatcataattagaattaagtttaaccccttagaattctctgtattctggttacatttattaggtgggaaactcattatgaaaataccaccttccaaagacctcccaaagattccatttcatcatgggaaaatgatgcccacaaattaaactgctaccctagggtcctggctgggctccacacagtgaagatgctccagtctctggccatagacaccatggtgacattcttcccagggctttaccttccctctttaagacgaatgccaagtagggtaggagcaagggctcagaacaccatggaataccaccacggagaccattacagggaccaccatgggagccaccacggggaccaccatgggaaccaccacagggaccaccacgggacaaccacgaggaccaccatgggaaccaccacgcggaccaccatgggacaaccacgaggaccaccatgggaaccaccatgacagactaccacagggaccaccacaggaaccactacagggaccaccatggagaccaccacagggaccgccatgggaaccaccatggatgtcacctaagggaccaccacaggagccaccatgggaaccaccacagggaccaccgtaggagaccatcatgggtaccaccggggaaccaccatggggaccaacatggagaccaacacagggaccaccatgggaaccaccacagggaccaccagggagaccaccatggggaccaccacaacagggatcaccatgggaggctaccctagggaccaccacaggaaccaccacgggaaccaccacagggaccaccataggagaccatcacgggtaccaccagggaaccaccacggggaccaccatagggaccaccagggggaccaccacagggaccaccatgggaggccaccctaggcaccagcatggggaccacgacagggaccaccacaggagatcaccacagggaccaccacagggaccaccatggggaccaccacaggaaccaccatgaggaccaccatggctaccaccccagggaccaccctgggagaccaccatggggaccaccagagggaccaccccagggaacaccatggggaccaccacaggggaccacccaagggaccaccatgaggaccaacacaggaggccaccatggggaatatccatgggagaccaccacagggaccaccccagggaccaccctgggagaccaccatggggaccaccacagggaccaccacagggaccaccacaagggaccaccccagggaacaccatggggaccaccacaggacaccaccatggggaccaccacagggaccaccacaggaggccaccatgggagtatccatggggaccgtcacagggaccaccactggagaccaccatgggggcccacaatgtgagaccatcacaggaaccacatgaaggagcaccacgtgagatcatcatggggaccgccatgggggataaccacgagggaccaccatggcagacactcagaacaatgggaagtgtgagggaagaattggtgattaaagtccacccatcctaagcacccaacccccgggtgactgaggccacagggaacaccagagtcacccatcatccaagtgccctcttacccccaacccactgcaggcaaacacagttacctgcacgattgggtgaactgggactttgtgcagatcttgctgtgagggctcctggatcaggcttgaggccacaaagctgaatcctctaaacaggtgatgagcgtttgcactcggggggacgccaggagagtctgtaggtgacaggggcagagttcagatgccacgaaagctgggtgaccctggggtgaagtgatagtgtgtgtgtgcatgtggtatgtgtgtgcaagtccgtgtgtgtgtgtgtgtgtgtgtgtgtgcacgtggcgtatgcctgtggtggaggaaaaggtaaaacagacatgtagaaatgctgaaccagatgaaactacattcttttggcttgtgctaatggtttgatttttaaatggcaaaaatacccagaacaaaaacttcaggattatcattgatggcatctgttagtttgccaacttctgaatttactctatattcttgaccacactcctccacccctacccactccagactcagttaagaaggcaccaatgacctcaggatggaattgtcagtgaacatgaatcctgtatccttagcttctggtctctaggttcgacaggtcccacccctgtgcccacagctgcataactgcatgtgtgctgtgcacgtgctctgctctccaaggacatttgggcaacgtttctcctgtccacagcaaggcatagtacgaaaggagtaattcccttccattaagatttttctgatctctgtaagatctgtgttcaaaagcatgactgctgtgagattgatcccatttcaagtttatcattaagaaaaacaaaaggataaatccctcgtggggaaaaaaaatctgcatcatacataacagatgagaggttaaactctctattgcccgaaagctcccagagatcaatgagaaaagagcaaaatactcaaaggaaggaattctgatagctaccataggcatgaaaagatgcccaatctctctaaggagtaagcatacacatatttaaataggacaacacttttgtctaatgaactaacaaaaatgaaagaaatcaatcacatctgggtttggctgggggtggacacttataattgtaggagggagcataactggcataatcttctggaaagtcaactggcaacatttaaagccaactttaaaatttcaaaattaaaaattttgaaagtaattctacagaattactttcaaaagtgcacagtaataacaaattgtagatgacgcaaacaaatggaaaaacatcacatgctcatgaatcagaagaattaatatcatcaaaatgaacatatcacccaaagcaatctacagattcaatgcaatctctatcaaaaaaccaacgtcatttttcacagaattagaaaaaacaatcctaaagttaacatggaaccaacaaagagcctgaatagccaaagcaattttaagcaaaaggaacaaagctagaactagaagcatcacattacctgacttcaattatatcacaaggagatagtaactaaaatagcatggtactggtataaacatagacacacagattaacggaacagaatagaaaacccagaaataaagccacatgcaaagtcaacaaaaactttgtggggaaaagacactcttttcaataaatgataccgggaaaattagttcgtcataagcaaaagaatgaaactggacccctatgtctcaccatatacaaaaatcaactaagagattaaagacttaagtgatgaaagacctgaaacaatgaaaatactagaataaatcctagagaaaactctttaggacatgggtctagcgaaagacttcgaaagtcttttaagggctgggtgcagtggctcacacctgtaatcccagcactttgggaggctgaggcaggtggatcactaggtcaggagttcgagaccagtctggccaacatagtgaaaccctgtctctactaaaaatacaaaaaaaattagccaggtgtggtggtgtacgcctgtaatcccagctgcttgggaggctgaggcaggagaattgcatgaacccgggaggcggaggttgcagtgagccaagatggcgtcactgcactccagcctgggcgacagagtgagactccatcacacacacacacacacacacacacacacacacaaaaaggctttaagaccagcataagaaatcatcaacagaatgaacagacaacctgcagaatgggagaacatatttgcaaactatgcaactgacaggggagtaatatctagaatttacaaggaactcgaacaactcaacaacaacaacaaaacaaataaccccattaaaaattgaccagaggacataagtagacatttttcaaaagaagacatacagatggccaaacagcatataaaaaatgctcaagatcgctaatcatcagataaatacaaatgaaaaccacaatgagatatcaccttacatcagtcagaatggctattactaaaaagtcaaaaaaataacagatgttggtgaggatgtggagaaaggtggtgggaatgtaaattagtacaacctccatgaaaaacagtacggaaatttctcaaagaactaaatggaactatattcgatgcagcaatcccactgctgggcattgcccaaaggaaaagaaatcgttgtctcaaaaagatacccgcacttggaagcttactgcagcactattcacaattgcaaagtcatggaatcaacctaagtgtccatcaacaggtgattgggtaaacaaaatgtggtacatatacgcaatggaatactatttagtcataaaaaagaatgaaatcatgtcttttgcagcaacatggatggaaaagaaggccattattttaagtgaaacaactcacacgtggaaagtcaaacatcgcatgttctcactcataagtgggtgctaaattgctaaataatgtctgcatgtggatgtcgagtgtggtgggatagagaatggagacgtggaagggtgggagaaggtgagggatgagaaattacttaatgggtaaaatgaacactcctcaggtgatggttacactaaaagaccagccctcaccactatgtactctacccatgaacaaaactacatctgtacctctgaaatttacagaaataaaaaataaaacaggctgggcgcggtggatcacacctgtaatctcagcactttgggaggctgaggtgggcagatcacgaggtcaggagttcacgaccagcctaaccaacatggtgaagccctgtctctattaaaaatacaaaaattagccaggcggggtggcgcacgcctgtaatcccagctactcaggaggctgaggcaggagaatcgcttgaacctgggaggtggaggttgcagtgagccaagatcgcaccactgcactctagcctgggtgacagagcgagactctgtctcaaacaaaacaaaacaaaaaaacaagcaaacgaaaaaatcccaaagtacttagacataaatgtagaaaaagtctgtttcagtgatatgtgttacagaaaagaaaaaggagacactaaatactcctcactaagacaatcatggtcatggtcaacagtggcccatctgtatcaggatgctttgtaatgattgcagtgtgagtcctgccagcgagaccagggccatcagaaggagccacagttgcatggactgacagagacgtggcttcctaatcgtttgtcaaatcaaaaaagcaaaaagctgttgaacaatatgaagaacccagacattacttaaaaaattaaatatattttaatatatttaaaaacagaataggataatagattaatatattaaaatagaatatatattacactaaaatagaatactataatacattatataatatgtaaatttataatatatgaaaatataatacgtaatttttcctgaaaacacacatatgtacaaatttaaacattcttatttatatatcttttaagactccctgtatgtatagttgtgtgcatatttgtatattcgagaattctctacccgcaggcctttgtctctcagcacttcttccccccctcgtctgtttaggtgctgtactttgaaaggaagaaagtgcacctagttctcagttttatctccacacggtgcggcaggtgtgtgggggtgggaggcagctgcagagaacacgtgttttgtttcttagcatcatattttggggacaacggttatgagggcagccgctccgaagcccaggagccgggccccacgccgcgtgggcctctggtgcaagcgggggccaggccgtgggcagatggacgacgcagcgtcccactggtgctcttcctggggtaggaagcgtcatggacccgggctcatcttcagtgtcctgaaccaagaggcagctagagccaggtgtcggccctcaaaggggccaaaaaaggggccttcacagtcaccccaggtagatgcccacgcgacccctggactaatgtgaccagagtcggctgtgtttggaaataaacttccaacgctccagactagcgaagcgtcgttaaaaaaccgaaggtaccctgagtggtttttagaaactgaaattctgcagcgcgacccggcagagaagctcggggctttctgagcggctctgcttcgcggcacacggagccgctcgaggaggaggcgctcctgctacacccggtttgctctctgcacaaagtctggctttgaggtctgcctcctcccaaagatcccctgagctaccacgggccgcagattctcccccggaaaaatgaaacacacatggctacatcatggtttaagaaatcttcaaacctggaggcactttgatgtcttcccttagggatttagactcagagcttgagcttattctggggaatccgcagagccacacgagtgtgaagtgctgagcaaggattgggagtccaatttacagcctgtggaggagtgtgtgcgggggtgggggcacaggccatgttaacttgacagacacagtttcattggtgaatggaaaatctgtaattccaataagcaatgtcttctaaccaaccaagaggcacggaagacacagccacaaccttccgtggccagagaacccatgcctctcctcacacagaccaaggagagcctgcggaaagggtaaaagtaacagcaatttaccgaaggccaagtggatcttcaccaaaagttaagaggctgacatttggtcggtgtggctagctagtaaggaaatgacaggtggcctaaatagaatttaaagcactttataatcacctgagggatgccgattttcagcacagtatttaagaagagcaaaattgtgagtcagataaaaggagatgtagaactacagtaattacaaacaacctctcatggtcctgtgggtatttcctgatttgtggagtctgcctgatcggtttaaaatcttagattggcatctcgggctaagcagcatgctctagggggcagccaaggtgtgatcagggaatagaaaccagcttgagcgctggctgaagtttcagaaaagactgaaagcctaactgtaagaaattcccactgtgagtccaggatctaacatagaggatttgtagcttatccattgcttcagagtcacatttctacagctgctcattcacccagccatgtgctcagctcacatgcttagaaaatcctactctcctgtacaaatcagaatgagtttaatgtgtctttagcacttcaattactacctacctcaaaggcaaacagtggtgtgataaattaactgaaactgattggagaactggaaacactaaggaataaaaaaggcaattctgaatagcactggagtgcattgtgtctaattatgttttccttaggctattattaaaatacaatggaattctctagaagctcaaaaaaagcttccggttccactggccaactaggttggggtttaaattcttcacagataagataaaaggcatgtccatatgaatattagagttgactgtattaacattttcttaccaagcagcacaaacatagactttctttccacattttaaacacacagccccacatgttggcacctcacgaggatgtgtgcacgttctgttagggaccttatggtccttgtggacttagggacaacgatctcgtggtcagacctaattgcctctgagctccttttacattcaggccaacaataggtggagaaatatcatgacttgcttgggtgacctgtgggcaggggcaggagggaatccccaaatcctgccccatcttttcaaactcagaaactgaaaagtaatcctgttctgtgaattgggttaagtttgtcaatgggaaggaccaaccccaacacacaaatactttctaaggaagctgagaatggggtgaggtgaaaatcccacagtcacttaccggagagagcagacccagaagtgttctccaaggcagcctcattacatcatgaatcagtgatgaaccaaagctataatgatagttttaattctacctggggactgcaggatgacccaaaagaagtaactgagcagccggtggcatgactccctggtttacagtgcccggaatcagctttcttcctgttcttggtaccaatgtggcctgggtcaggagctggcctaggcccatcaaaagtcccgctaaaagccccgcaaccctccctatctgcacacgctcacaccctcctcaatgtgttcatctgggtatatgggaaacagggatttcaccaacagctgaatctggaggaacaaagtggattctctaacttcatctacctgacattttgtggttgaccatatatttgtttcccgattatcttttaaaaaataagaaaatttcagattcaaaagcagcgagaaaaaatacagtgaatccccgtagatccaagatgcagcctggccaaccaccagctccctggacttgtcccacttatgtctacagaaggagcttgtggatggttttgtacataaccagcatactgttagtgttgtggactgaattatgtccttcccaaattcaaatgttaaggccctacccccaagtgtaactgtatttggagacagggccttgatatggttcagctttgtgtccccacccaaatctcaggctctgtgtccctacccaaatctcatcttggagccctcataattcccatgtgttgtaggagggacctggtgggagatgactgaattatgggggtgggtctttcctgtgctgttctcatgatggtcaatgagtctcatgagatctgagagttttaaaaaggggagtttccctgcacaagctctctctttgttgccatccacgtaagatggggcttgcttctacttgccttctgccacgattgtgaggcttcctcagccatgtggaactgtaaattcactaaacttctttcttttgaaaaattgcccagtctcaggtatgtctttatcagcagtgtgaaaacagactaatacaggcctttaagagaataactgaagttaagtgaggataaaagtgtggggccctaatccaagaggactagtgtccttataagaagacagagagacaccagagctccatcttgctgtctttgcacacacagaagaaaggccacgtggggacacagcaagaacacagctgtctgcaagtcaaggcgagagctctcaccaggaaccaaccctgtcagtaccttgaacttggacttccagcctccagactgtgagaaaataaatgactgttgtttaaaccacacagtctgtagtattttgttatgatagccctatcagaccaggataattaccatatataaaaaagcagactttaattcattaatatcccaaaaagataacttttaaagggagctgaccagttctgatgaaatttgctagaccccaagagtaatttcagacacaccaggagaccaaatctatgcatccaattgctgtgctatttagtagccgatactacttttcaaatgggtttctgttttttgcatgaataatatctatagctcataaatctatagacataactgacagccttccctctccgtaaatgcactttaattgaaagagggattttaattgcctccagtttcttttcttgctcttgctgtgtgtctctctgacacaggaagtaactggaccggtgtcttggaataaggataccttcatcatttccaaggtggaggttatatagggaacaacagagaactggggctatcacttaaacctttatcactgagcagagaaaacaacaacaaaaaacccaaacagaatggacagttattttccatgaaaagaattctgaggcatgggaatttcttgttcctagatatctgtctctaaggggtcaggtgggagaagccaccgatagagggaaccactgtggcacacacctgtgggcgtccgcgctgtgaactcggggtcaaagtggaaggtgtcctcaggcctgcccactgctggtttgaacggtggcttgatctccttccggtacagcgtctattaatacaaggaaagcaagacagggcactgaggatgcacagacattgccacagaacactggggacagagaaacctgctgtggggagggaaggatgttcttatcacagactgcattggccttgtggattacaagggatttctaaatactctgaaatatagatggcataaaatatattatgtgtagtatgatagatactatggcatatataataacgatgtattatagaaaggtatagaaaaggcatagtttgaggtatgagggtttggggacatgccaagtgttcttcattttagggcaatagttttctagcttcttcttggtagtagaatcttcttttccaagtaaaatcatacaggacagccaccacttgcccccactggggacagcagtgaagaggccgtgtggctctctcctccctgccctgggactttggggccagcaccacggaacttcagctctgcggggcactgcaaaaaccgccgacccagagccaccccagggtgctctcttgccagtgtctcagggcctgtgctctggggccttggcacctctgccagaaacctgccttgggtgtcagaatgagggcgcccaggctcctcgacaggaggacgcctgcatctgcagagaaccggcccttcccatgccccctctgggcccaaacttatttccccaacaggaccttggacagaaggcacagaaagtccacagccctctgtgctccggtctcagagctgcctgcctgacaatgctttccaaagctgagatgtgttgttttcaatcctctagggcaacaaggcattctgttgggaattcaatgtaaagaaagcacacacaggtacctggaacctggcgtagtcctcaggcgggtgatgctgcaggtggtgcttagatggagggagccgggggagcccagtgctgagagaagtgtggagggggaggggcactggagggaggactggggcctgaggcctgactggaaggccgagggacctccgggcagattcagtagaggatgctgggtttagtcaaatcaccctgacgacagaaggcacgggccatgccagtgtgctgaggggccagcctggtagttagcagggcagcagcagggcagggccaggctggggtcttgccccccactgagcatggggtttccttaatcctgcctagggagggtccccacggtgttcgcagaaaacatccagcctggagtcctgtcctgggcacttgtgtgtgaccatctagagctcagttctggactcagggaccctcatggccgtgcagctctggaaaatggacacagtgactccagctaaaacctgttctacatctctggaaagcaaatttcaacacctcctccgatgaggcccgacgggaagggagaggagggaggagggcgtctgacatctgggtcccacctggggcacaccctgctctgcttatccgggagcacctgggtcagagcccaggccagaaaccagggcccacagctactgcaggagggcgaggtgccaacagacgcccccgagctcccccgggggcttatcaggcagcaggatgtgccctgatgtgcaagagctcagggcgtgcacgcgggaaccatcggaggagaaacaggattgaattcagccctgaattatttgctcatttcctgccttgggggcatagatttcattagcaccgagttactcttcaagccattttcagaaatgaaaagacgctgctttctgcagtgaggcacaggacaggtgggaataatctccccagacacatgtgcttgcctgaggaagtctcctgagctgggaagcccaggccatcgggtgccacgaacaggccagtgcagcccattccccacccagagagtcctgagagccgggctattaagaatcctgctgaagtcaaaatcacatcctccctctgtgtgagagcaagcgagggagagaggtggagagagagagagagagagatggggagagatggggagagagggggtggggggagaaagagacggaggggaggaggggagaaatgggggagggggaggggaagggggtaagaaagagagagagcacgcactagctcgatccagcacagagccaggcctcctacttttattatgaggaggaatttatttacacaagagatttccattaaaaacaaaataaaatacaaaactggttgtcacgtattcattccagtgtgaagtgtttacctccggaaagcaggggcccacatggcccctctagctcctctcctccgtgccagctcttcctccatcatcctggggacccatcttgcccacccctgcccctgccccaccacagcctctgataaaaccatccccagagcctggtgcccagtgcttcttcatagaggggttttgcccccactgggacatttggcagtgcccaaagacactgctggctgccacacctgtgtgaccgctgcaggctcccaaggggtggaggccagggtgtgcagaacccagccacccataacagccccaccacacagcatcgcgcaggtgccacccagggtgaaggtgggagaccctggccctgcctgcttccttctctacctcacccttcctgccttgtttctgctccaaccctcaaaagtgcaacgtcaaccagcttcttcaagaaggaggactggatgttgaggcgactggccactgtccttggaaccccttcccctccccatggaacccccggtggggcagggctgcaggctctgcctggcttcctacaggccacatccttctccctcctcgtccaccgatggggcaggcaccacagcctcgcttcacagctgtccaggaaagcacaggctctatctgtgaccaccctgcctctggaggctcacatccagaggctgtcaccttcctgccttctaagtcagattcacagcccagcactggtactgctgtgacctcctctgggctgaggccatcccactcctttaatactaagtatctgctgctaagtcaggtcccggttccctccagcccaggacactgcgcctgggggctgggctcagacttcccctgtgctctgccccatctgtgcctagcccggtgctgcgagtcacctgggatgcccagtgaggaggtcctaagcccaggtagtcccgtagcacttttgtaccacacaaatagctccccctcacacggcagcaggaggaagcccgcctctgctttccccgtgctttccacccctcggctgtgagcccaggctttcagctcacagaccccaacaagaccagagggaggcatgcgtgtgagagtggacggagcgcttgctgagggccagggccttccttctgtgccgcgggagccttcaggcaactggccaccccgtaacatgggtccgtgtgccaaccgcagctatgaacacagcctgttcactggggcctgcagaccaccatgccccacctgctggaggctgctgcgttctcactctggtctgggccaggcagtgaggttctgtgcgggccgccggtggccaactggagccggtcactctggccctttggacggcttcctcgaggcttgctgcaatcttaaaggccggtcaatgtcttcctgatgctgcgtaaacatttggaaggtgctaatatgtgttattactgtgtatgctttttctttccatgtgcaaacctaagaacgggtttgaggctttgggggagaagtcatccggcctcttgctttgtatgtaaaccactgtaggcagggttgtgttgagagtgaaacagcagcagcatctcacctgggattctgagcttaacgagacagacactggcaattctgccctggatcccccctttctgagactctgggacaattcatgccgaaaccgacgagagaaaatgcagtctcatgatcaaattcgccaggcacatttaaaatcatctcatttgtcccaggatgtcagaatgacacagtgtggccgcagggctgaaacgaatttcacgggaaacaagcgcacgtgaggaagcccggagcaggcccatcaggattctatttatactaaagaccttcagctaagtgagaagaggaccgagacagcaacagaaaaacgggaactgggtgatgacataggaaacagatgctagtttggggtctcagaccctaacatctgccttctgtagacggttttggcttcaggcattttggaattaatacgctccaataaggcaaagggcacatttatagattattcctaaaataataatgcaaaaatatgcagaccagagagaagacaggatcgaaagcgccgcaggaagaatctaaacgattttcaaagcgtcacgatgggtgtgacaggtcagtggctcatggagcgggactgtgcctgcagtttacccggctgtaggtgggtccaacagaagaagcacctgaagggtgatgattcattgcacagagtccttgctgggttccctgaagggggagtgctcctagtgtatataatgtaggaataaaaggatagaaatctcgctgctggcaatgggagcaacagctgcatggagacgcctgtgctgtgaggccctgacccgcagcctacagctcccacacccccaaaccactctctgcgccatactgcaaatactccacttgtgggcaagaagaccaaagtggcctgaagacccggaacccaccctctgctcctgccaggacacacaacagccaagttcagggcacaccccacgcgctgccagatcaccgagcgacctcaagcttctcattgtcctgtgcctcagtctcctctacaagtttctcccatctcacagcatcacagctaatggtgtgcttggaagggtttcaaactgtacaaagaacataaacatgagctactagtattgatcatgaataacgaataacagtaataataagagtcagtgcaatactaagggtctaggccctggacagagttccagaaacaaagatgtccctccctggtgactgtgtgtctccagcatcatcattcactgcctgtaataatatttgcagttccctgggtccccctgcaagggacgccaggctgggctgggagccgtcctcagactggcttgtgctgtctgcagtgattaacttttacgaagctttttttgggttcgtgctaattctgtgttctcagcatgcttcagccacgggggaaaaaccaacacagcttctatctgctggactctgccgtatcctctgcagaggtttgtagtccgatcattaactcgtggcttctcactcagctcatcaagcagagctggccttcagaaggaatggctcccgtgcagacgttcactcgctcatctctgaagctaaattaaaaggcagcagcccacacctccaccgtccccacacttactgtcagcagatgggtcctgctccagcaggccactgaagaccccggggacagcagtgggatgacaggtgtttacttaaaaaaataaataaataaataaataaataaaaagatctgctggcagtatcggatcacagagagcagcagaaagcaaaataaatatcctaatattttcccagttggatcctgaggcaagccattgggtgaagtacccaggcagaaatctagtggttaggaaatgtcttctcattcgtcattaaggagtgtctgcattgcagagggaacggcttttggtgttaacagttcttgcaaatgaggctgaactgtggttttcagttttctgagctgccgaaaagcagaatgggcacatctggacaaatacatcacggagtaaaattaccccttaaataaatacctttaaacatcttgcattttagcccctgctttctgaagaatgggttgatggcttgcctggatgtgttattggggtttgaggttagccatgaagacacatgggctgctactggggccgcagacacaggagaacacacgggcaaacttgactcatgagagaggatcagctgagatggggggaccactggactcatcctagcaagatgttgacagcttctaagaccatcacggagcgggactgtgcctgcagtttacgcggtgtcctgaacacggtgttttcatgcctacacatctttgctggaagcatccttcttctcctccttctgcccctctgctggttaattccactcgccctctttcaggcatcatttctctctctttctgctggccactttcactgtgcacaaacctcttccatcggtggatgatggcgttatgggacagcagactcctcagtctgtgagcagctggaggacggggctctgcgttccagctgtgacgtcatggacatggacactttgctggtgcaccaccagggtgagcaccaagcgttatttatcaaatgcatgaattaatgcaaaagtggcatttctgagctcttctgccactcacgggctgtgtgggttcagggcgctgggcagaacaagagcctgccattcctctagcactgctgcctgccttcctctgggaagtacagacatgaaggaaacacgcctggttctgatcaatcacaaggacctctctcaaaacgaaaacaaggccaaaataaaatcaaattaagtgctaagagcaacaaaaggaacttctcagctctgattctagtctgattcctttgaaatcacgcagaaatgccaccttcttgggttgtgtttgctttccagccacagggagaccagagcaccctgagcagaggcgctgtgtagagaaggctcttattgccacaggaaaaaggcggcttctgctcagagctcgccggacctcagcattctggaatgcacattaatctaatgtgtcatagttttccaaatccatcgtattgttaaaattccaggcatctcacaaggttgtcttagcaagtgcgtaagcccttctgggccatgcatactttggagtggctccactcttggctgagtgctctgtgttgcactgtgtcacctgggggttcggtgtgaagagacttctctttcctaccagctgcagccctcagggtctcccatcccaggatgctgccctgcccacctgcagctccccctcccagcccagcaatcctggttctccattctcccaggcatggtctctggaggaaggactagagtgtgagagtgaggaaatggagggggcaagtctccctcgacagctgtgactcctgtcttgagagtctcactcattcattcactgattcattcactgacttactgactcattcactcacttattcactgattcactgactcattcacttattcatttgctcgttcactcactccctcattcactcactccctcactcactcattcactaactcactcactgactcccttactcattcactcactcactcattcactcactccctcattcactcattccttcactcactccctcacttgttgactcactcattaactcactcccttactcattcatgcactccctcactcattaactcactcactcctttactcattcattcactcattcattcacttcctcactcattcactcactcattgactcactgactcattcactcactccctcactcattcactctctaactcactccctcattcactcactccctcactcattaactcattcattcactcactcattaactcactcactcactcccttactcattcactcactcactcattcattcactccctcactcattcactccctccttccctcactcatccattcactcactcagtagggattcataaagtgcctcctttgagccaggccctgttttagagctgtgggatacacctctaagccacagattcctgatcttgcagcttacattctagtggcaggagacagaaaataataatatacatcagaaacacatggtattttgaggcgagtcagaaagtgataagggatatgaaaacagagcaaggccgggggctggggtgctgggagaggagctgcagtttggaagagccgcaggacaggtctcataagatgacactgaatggcagactggaaggaggagaccagtgagcccttgggagacttgggcaggaggggccctggaagccagaccagctggagccagtgcttggggggaacctgttccatggaggcatgggaaggaggctccgtgaggatgggaggggtgaggtgtggctgtcctgaccactttcgtgtgcttctccatctgtcccctgctgcatcctccttgtcagcacagtgtcctcctgtgacatgtgcagacccatctgtccaccgcctttctctgccaagtcatcacaagacccacgggtgcaggactttgttccatctacggctctatccccagccctggaaagtgcctgagactgggacgcccagcagaaagggctggataaatggagaagcagatcatacggggagaagctgtgtggtcccaccttaaccactggcaggcaggggaggggatgcaacatgctgtgaccccctgaggggcaggcatctgggttccaggcacagtgctgtgctaaccatccacaggctgacacccaggtccattcttcatgaaacaggcttgcctgagatctaaacgccgtgtaaggtgaagtctccatagaaaatacattccaacgcagagtcgaatgacagtgaccttaggtgcccatctgtgaggtgagcacagcctgagcttctgataagcctaaattttcagggaagctaagtaagagactccaaagggaggccttggttttcatttcttggaggtcctggttgggaggcacagatgtcctgaaactttacactcttttctctaatcttactttcgaaaagaagtctaatcttacgaaagttctttagtcagaactgtaaaactaggttttaaaaagttatcactcttccccagtttgagtgctttgctggggctcaggctgaaggaagaggagagctggctggttttatccagcactggtgttacacattcccagaggagaggtctggggctgcaggtggggcccacctcttaatgaaatgcgtggaggccccggactccatgaggacataaagaagacagaggccgggcgcggtggctcacgcctgtaatcccagcactttgggaggccaaggtgggtggatcatgaggtcaggagatcgagatcatcctggctaacacggtgaaaccctgtctctactaaaaatataaaaaaaattagccgggcgtggtgggggcgcctgtaatcccagctattcgggaggctgaggcaggagaatggcgtgaatctggcaggtggagcttgcagtgagccgagatcgcgccactgcactccagcctgggcgacagagcgagactaaaaaaaaaaaaaaaaagaagacagagaggaaagcgaaagcagataataaactctatactgtagagggcatttaaatcttaaaaagtgttccattaaaatcttttgaggttaatttgttaggtcaggaaaagaaaatcccaacatagctgtttttgtgttaacctaaaggaaagagctgaaagcaactgataggaaaggaggtatcgccttcctcagatggaaggaacagcctccgagttttagccgcgagaactccctgtgtgggggacgcgtcagacgctgactgcttcaccattcggagttggcgtcttggcagaaataggcaattgacacttgtagcttggtgaaaagtgagatacgagaacttctcagacaatgtccagcctggcccagagaactggaaatggaggctttaccaataactccactaacagaagctccagtttattccaacaactcggcactgttgttttttttttttttttttaaatgtgacttccacgtgggcatcagcttgactaacgatggaaaatgcagtatcgaatctgggcctgcccatagccctagcactaaagggtcctggttgagcagcttgtcatgacttttgtctgttcagcccttgaggttagaagacagtcactcctggagcaatcgggaatatgcagggctcggagaggccggggagtgggtgcagggaggacagaagcctcgactctgatgggcagaggagagtagaaggaggaaagctgaggggacttcaggcctcaagctggagggaggggcactcacgtgtctgtgcctcccaagttgccagcccgctcagcagggtcctgggggctccctgcctgcaggtggcttgtctacattcacctccgacctacttgtgacccggacactgaggaccctctgcaccaagccgtatgttccctccacccacttctgtgtcacgcgtgtgcaggtggggactgtggcatgcaacttacgttccagtctatggtcacaaagaagggatggcgcttaatttcctccactccgtcaatgccagcacctgtcaacaacacagaaatgatcatcagaacaaatccaagatggggttctctgacagtttccaatgcagcagtgtggagggtggggatgtgcagaggtggggccgtgggaaggagcccagaggctgctcactcctgcccaaggcacctgcgcacctgccgatgcccccagctcagaaagccacgactcagccccgagggcttgtgaggcagaggtggcctggggttggagtgagcaaaagaggtggtcaagagaagcatgggacaggccagccaggtgctgcctgctgcatgtgacggctgcctagcaccccactgtcacccccaggagcttgaggtgcctgtgagtgtgagcaccaggtggacctcccaggaggccggaggggaaggtgcagagcagagttcctggcaaagctgctgcagttaacccgggagggaaggattccaggaaatgaagaggagttgacaggactgagtcccggaggaagccagagcccagcctcctgcccacacctggccacccctgagcctgctcagacaggtgactgtgtttacctggaggctgcttacaaatatctctgctttgttctgttatttctacctaacctcctcccttactttgttgcgtacaatcctaaggccctggggcagaaaggaaggagggaggagtaggcggagcgctgggggccctttcaggcagcatgattccctaacggtggatacatgtccactcatctgccagaaatcgccactgtccccccagaacgagcccagtgtggacaaggcctttagtcagtagctcagctcaccgactgcagaagcgtgcccattcacggaggcactactgttcgggaaagcggtggggcagggagtgaggggccgtggaatcttgctgcagtttctgttcagtttttctgtaaacttaaaactgttctgaacacaaagtctattaattaaaaacaaaaggccctaaagctctaggactctgtgttttctccaggatgggacggccacagaggagcccatcctcccgggtcacgaatccgagaagaggcgggcttggctggaaggggcagtggcggcggtggctggggaattcctgccagctccgggcccagggctggggagggtctgatccctggggcccggctcccctgttctgcaagctgtgttcctttccgctgccaactcctaacggctgtgctccaaatcagagcctcctgtgccatgtatgccccttcgtggagcccccctcatgtccagctctcactcctggaagagcggggctgcccggggatgctgtggtcagcacaggtgtggcccggcctgtccggctggaagctggcctggagtggcgcaggtcaccgggagtcacagcagatggtgccatcgttggctggaactgcccgtgtcctgacccctcccacccctccattccgcactctgggcagtgatgtggaggaggctcgggggctgtggtggcctcagaaagcgcctctaggtggtcaacggctcagagacagtccccttaccctggaagcttggccagggccatggtgctaggaacgaacccacatactaaatgcccctgaaggcactctcacagcactctcagctttgtgttattcacactttgacgtgaaagtccatctagaaggaattagaggaagggcacacattcaggagtttctccttccatgaggacgcagaatcataggacagacatagcacacggacatctcagtcatccgatgcacaattgctgttcccattttacagacgaggacactgaggctgacacaggttgggtagcttgttcaaaatcagaccagaggttatgagttacaggtactgggtttggaggcacatgtctgaaaagcagctgaggtgccccaccttctgaagtgtctttcccgaggactccctgctgaggcccctccgggtccccagtctagctcccttgttctcctctaaaccctgagcccagggatctgatcccaggcctttgcaatcgcagcagctggcatgagccttcgcaggcgcaccagtggctgctgtaatgaaatttccagagcgacagtctgacttccaaacagccctccccaagcgcccatcctgtgtgcaggcctcctttgatgatgaccagaactctgggttgaagagtccttctggtcacgatgattaacagaaagaccctcctctgaagtgtgcctctcctctactcttttgtttggtgactgttggacgcatggccagaggcactctcaaaaggctggagattggaacaaacagttcagaggccctggtacacgcacaggtgtggcaacttgttggctgtacttctttggaggatctatttcacattttgtacccactgtatttccttcttgttcatcatttgcaaatatggtctgcaggaattttagaaagtgagaggcagaggaaatacaggtattggtataactactatgtaactggtatatgctgggtttacctggatcactgcaatcaacacatttctatctttacctcctttcccctaaggtagtaagattttgcaccatgtttgtattttaagccctcagcaaaaagagtcaacaggggaataacactttggttatcactaaaaaattacaggggttccaattacagggggaaacatgaaacaggaggaggacttttgcactcagcaccttgaaacctgtgtcaaccctcccagggcagtcaggtttattattcttgttaaaataggtgactttgcactcggctccccctttttatctccactgaacccactggacaaatgacggtgagtggagttctgggcggggagaatcggaaggtatcaggctgatgctggaatcacggctggctcgctacgggatgcggatgacacgcactgaaggccttccttggttctagaggactgctgccactcatctagatcatgaagcactgacaagaacagggacagaaactgtgagcacagaaggccggaattccctcctgtcaggcttagcaatttgtcgttaagttccttaatgcagggcaaataggagttcaaggttcaggggaacagaagattcaagaatcacacttcttctcggtagtaataacacctgatcctgtttgtttaaatggcttgtggtctatctccaaattggggcgtcacctaatgtgtttatctgggtctgtgtctccaattgctgttctctggttaagggtataattttgcaaccagttggaactctcatatcaatgactaaagtgcagtgcagtgcctgtgaatggatttttttttttattttggggggattcattctgtcgcccaggctggtatgcagtggcatgatcgtgactcactgcagcctcgatttcctgggctcaggtgatcctcccagctcagtctcctgagtagctgggactacaggcatgtgccactacacctggctaatattttgtattttttgtagagatggggtctcaccatgttgcccaggctggtgtcaaactcttgggctcaagtgatctgcctgcctgggtctcccaaagtgctgggattataggcaggagccactgcacggatgatttattctttcattgcaccgattctgtccagctcttctactccatatttttcacgaggtaagccattcatttcattgtggggattctaaattctcagcaggtgattcccaaagggttttggtatctgccaaaaatgtgtgcattgtgtctgtatatccacagatagctttaggagatggttaattcatggtttgggactcctttgcaatattttcatttttgttgtttgagagtcacacaaacccatctccgacacttctgggaacattcagtagaatcttactggctgcctccttaggtttcttacatactgcaagcttctcctaaccagcccaccatgtccagcctataaccatccagggcaacttccatcattgacttaaatactaggtctgctttttcaatttcttcatcacttaaaggttatctacacattatttgtttaaaggtttttttttttttttttttggccaatttgaaatttcatctatttcatgtttacaccctttgtcagggagtcgctcgtgtcccacaggactcagccggttaggagtcagggatgggctaggggctcaggcttgagcggtgtgggagtcagatctgcagacaggccctgggcatgggtctctagcggctccctagggctggttgtgagggtggggctgcctggtcttcagcaaccatcaaagcctggcttatgacaggcagtcccagcaatgccagtagaaactgggatgaggatcagaatggaccacgtttgaagtcattaaaaacacatcatctggagatcagttctggacaggaaaacagtaacaagagcaacggaaaacctctgcccgtgcgtcagccacaggcagcaggtgtgctgtgaagacagcacgcctggcttaggtgatgggcgttgatttgctgtgctatttttgtgctcatcagcacatcgaattcctttctaacctttccctcactttaaacttccccctgggagtctcagaatatctcatgagtttctaggagaagctacagatgctcattaggaatgagctagaaagctgtcagctttggaaaaaaggaagatttggaggtaggcttaggaagttttatactcactgcaaactcctgtcctgggggggaagtcgggagataacaaataacaaacactggtgctgaaaaccccagcagttcctgatctcagtgcaggatacatttacagctgtttctagacatcactatggtataaacttccatcagaaatggaactcacttaagtaatgagaagcagccaacaccacacccagggtctagccctacaaagcctgttcagcagaagcatcacccacaaccgcgagcctctcccatctcagccgggagcagcgccaagcacagagggaccaaatgtcctgctgagcctgttcctgcagagcttcatcccggagcctacccgtgatgctgccttggtccgtgcttacagggtgcagtgccgagggcgctggccaggagcccctttctcacctttcttttattctattctttgaagtccctggatttgcaaatcactcagagtcaccgagtcctccacctgggaggcgttttcctcgcacagacaagaaagcagacagcctgagcaggggtgtgaccctccaaggcctctatcgtgggatgtgccccagcctgtggtgcttctgcttagactgggtcaccccatgctgctacagccaccccagggtctttctctaattcacaaccacacaaccaccagaacaacagtgcgaagaaacaagactggtgtcccctcggctgcacccttgagagcccccacgctcaccacacccactgcgtactcccgagcgtggcccggcccctggctgctctgtctcctctccactcacccgtcacccaggcatggggacattgcagagtcacacgtgcccccaggtgtgccattcttccttccttcctcccactactctgcacgtgacgtttcttgggcccagaaggcccctccccccacaccccgtccagcatctgggacatcttctgagacccaacccaggcgtcctcacagagcagctctgtcgcccccactcaaatagatcagtggccccaaaccagtggcctctggaggtcagtggcagtgccatccaccttcctaagccagcacctgctacgggcattcagtacacattcactgaacagatcacacacgaaggcagggggattcagtctagaactcttttgaacgaagacattttatcttcaggggatgtggaggtgggagaaatgccagtcttagactcagaagcctaggagcctggagcaactcacacgggggcagagggccgttttctcacctgcagagtgtaagagaggaatgagatgcgtctgtatttctggtagtctggacatgtataaacacattatgccatctcttccagctgtcaatatctgtgcagaaactctgggaggggtcaactcccccaaatttgtatgctgaagccctaatccccaatatccccaatgtctcacaatgtgaccacatgtgcaaaaggggtcactgcaggtataatgagtccggcatcagcagggcaggcactcatctcctatgactgctgtccctagaacaaggggaaatttggacacagacccacacggaggagaaggccacatggagatggaggcggaggtcagggtgtggcattcacagccaggggtgtcaaggctggccagcaaagccccggggtctaggagcggccagggacacattcctttcagtgggagcacagccctgcagccttgagcttggacctctggcctccagagctgcgggaggacacatttctgctgttcaagctgcccagtttgcagttctttgtcaaggctgccccaagaaactcacacagaggggcggccaacgaacagctcagtgttcactgtggtccgctgggcattagagacgtgtgtttttatccgtgtttctcgctacactgtgcgcacacagagggcacatttttcctttgatttcctaatttctagcttattgttttgtccactgatccctctgtcaactggactgaacggaactgtctggaaatccagaggcttcccgctggtgggggctcattaaggaagaggcaggggtgaggaggtcgagaggcagagagggtcccctctctccctgggggaggccatagagagggagagtctacagctcgaggggactcacactaggggagacaccaagagaggacaggtgggaggcaatgaagacgcatttgctcctcctcccagcccctcaattgggccctgaggtcctgtgtggcgagtccagggcgggagagctctggcattgagagctcttatcagacaggctcaacacaggggcagctggaggtgtgcgattgccttgcatatccatgcgagggcccagggttagaacgaggcctctaacagccaccaattccccagatggtcaaagggagaactcaattccaggctcttttggaggaacgagaataaggctcacggcagtcagaagcagaggtaagttccagccacaaaaccggccgcctgtgcaggtgaaggtgactctgcccagcggggttttcagactacctggctccagctccgcaggcaactaaatccagcgccctccctggataaaggctgggcaattaattctgactgtagcttcttcatgttgagcctgggcatcttaggttgtaaaatacacctgtgggagggtccacagctcctcgaaagcttgatgataactcacttagacacggtttgaagggcgatcttggcccgaggtgagccattctccatgcttgtgtgagcttccagggggctggtatcttttaaccaatactcatctctacacctagggaggaggtagctccatctttctctcatccataatttaaaccaaatactaaaacaatattttaaagaactatgattttagtaatgttaaatttgaagggttttaatttaaaaaataggttatttagaaaattatttgcttctcccagaacaaggggagaaaaagtacaaacaccccaatactttgtcacattcacccaatttactgtagcaaatcctctcccagcaatataataatgtttgaaagaaaatagtgactctggccaggcacagtggctcacgcctgtaatctcatgttgggaggccaatgcaggaggactgctttagtccaggagttcgagaccagcctgggcaacatagcggggccccttctctacaaaacagtaataaactagtcaggtgtggttgtgcatgcctgtagtcccagctactcaggaggctgacgtgggaggactgcctgagtccaggcaactgagactgaagtgagtcatgattgcaccactgtgatcagcctgggcaacagagcaagaccctgtttaaaaaaggaaaggagaggaaacagtgactccaagacaaagcgcttcgattgctgcaagaatagatctgaattgttggctctcatgtacgtttggatgaataaatacgtccagcatctccacttctcctttctgactccaattcgcatttccagggggaggccaagcaggggaggggtgcacagcaaaccctcacgcatgtggccccacaggtggtgactgcggcagctcggctgggcgggggcggttaccatgcgtcacctcagagggagtggcagaggtggggtcgcggtgcctgccacctgaggcggcacgtcccttgcacatatgctcacgtgcttatgttataataagtgtccagatgtcatttgggtgcttgggaatgacaaggcagagactacacagatttccatcataaaagcttggtcttgaaagaggagtttcagccaccggcaaggttcctggcagcaactgtgtgaagatgttaccctctgagggatcagaccccgggcaaggcgggcatgactctgtgctcttgccagggtggatttcccgggtgagcttcgggactctggcattggcctcaatgttcttctggctggtactgcaggctttccatttacccttccattctgcaaccagctcagtggagggtttaacaacatctattaaaatgcatctcacaaaacgatggttttctccagaaaacgctcagaattgtggctcctcggctattgtgcaccagataacgttcctctgttctgtcccacagccaagtggcagagaaagaaaagtgtcagatgagcaggaagcaatgaggccggggggttggacacccttcccggccacaggcctctgcacaccggtgctctctgcttgtttatgtgtttactcgtcagacccattacagtgcttcccacccatcaggcactgctctgcctcctcaaatcctcctacttcacgatgtcggtgctggtattaccctcagttcgtagaataaataagcaagcacagagaggtgaagccatccgctcaggcccacacggccaggaaggggtgcgtggcgtgggtctgagcacctggctctcgcttcactttgcttctgtgccctgccctggactccagcctctcccacacgctcccctctcctctttcgctgctgctctttcttccccttccatcaggccctctcccctcttctgagatccattttgtgcctcatctgcttctctgccctggctgcaggcatttgtgcgcgtctgggctgcagctggccttgctgtttgctgtcagagagcccacgagcatgagggccacactttggcttcacgggtccccagagcctagcccacgagtgagggaaggcacgggccagactgcccattatccactcacacttgctctggacgaaagcacccagtgtctgcccaagagccatgagaaaggggcagcaggcgatgctggggacaggcggtggccccagccacggcgaggtggcagtgtggtcctgcaatctgccaggggggcggccccggccacagtgagatggcagcgtgactcgccagctgcccgaagagcatggtgagtggcagcatggtcctgctaactgccaggtgaggtgaggtggcagccatggtgaggtggcagcatggtcctgctaaccgccagggggtggcccaaggtggggcgtgtgctagcacgtcacagagaagtctctggcatcaaatgtttctccctaaaacaactttttaaaaactgggttttcaatcataaaaataatacatattggcagaaaaagtccatattggcatgaatgaggtgaaaggaaaagctccccttctgcccgtccctccggggagaagcacccgctgtaggagctgcttgcctgtgtttgcagaatttttctttgcttacctcccttgcttccaaaaacacaaacaggataattctgaacgttctgtgctgcaatgagctatttttacttaacacttctttttttaacttacacatccttccatgttagtgcatgcagaatggcctcactcttcagtactcacatagtatcccctgtgtagacgacggtaattcagttaaccgtccctgggtgatgtgggtttcagcttccatatctctctgtgcacttgtgtgaatatatttgaaggatatattatttgaggtggaattacttgggtgaggtgcatgtgctttacttttgcagagatttttcaggttgacttatgaaaagtgggaaaaacacaccccttcacccggaagttgggaaactgctctcccatcgccaacagtgaggattgccaaatgtgtgcctctgtgctaacttgagaggtaaaaatgggctagacctccatgaagacagtaaggacatgaaatatcacgaagaaatgtacaggtactggctgattcgaaagcacaaaaacattcacggaaagcaacaagtgccgaactttcaatagccccttcgtaagacagggagggctttaggaaaaatcttcaaccctcgctagatgttttggacctgacaagcaagaatcttatattccttaagattgtgattttatatatatatatatatatatatatatatatatataatatattttttttttttgagagagagttttgctctgttgcccaggctggagtgcagttgtgcgatctcagcttaccacaatctccacctcctgggttcaagcaactctcctgcctcagcctcctgagcagctgggattacaggcacccatcatcacacccagttgatttttatatttttagtagagatgaggttttgccattttggccaggctggtcttaaactcctgacctcaggtgatccgcctgcctgggcctcccaaagtgctgggattacaggcgtacaccaccactcctggccaatttttgtatttttggtagagatggggtttcgccatgttggccaggctggtcttgaactcctgaccttagctgatccacacgcctcggctgggattacaggtatgagccacaatgcctggccaattttatatacatatctttcttctagtgtttttctaaaccttgatgcttttcgcccaatttttctatagaataaaaattctatataaaattcaatgaaaacaaataagttgggatttttacaaaattctgaaattaagctacagtgaaattctgggaaattctctgcaggaaaagagaataattatacattcattccatattaaagtataaaagaattgagttgtgaattaaaagatagttcatttttcaagtttaaaaggccaagtcaagtactcttatcagaaatacaagcatagctatagggaattttcctgaaaagccttttcaatttttaattaagactgagcaaagctcaaagtggtctttgttgttgcaaagattagaaataaataagccatgaaggctcagctctaatttgtggctttaaaaaggatactgatgtctgacattgctctggaatcaagccaaggtcccctttgaaattgaattaatagatcttaaagtatttgctgcagagtggaggcctctgatgagatagtagagtgtacgtatacctctctgatcaatcttaaagtatgtgctgcagtgtggagagctctgctgaattctctgatgagatagtagactgtatgtatatctctctgatcgatcttaaagtatgtgctgcagagtggaggcctttgctgagttctctgatgagatggtagactgtacatatacctctctgatagatcttaaagtatgtgctgcagcgcggagagctctgctgagttctctgataagatggtagactgtacgtatacctctctgatcaatcttaaagtatgtgctacagagtggaggcctctgctgagttctctgataagatggcagactgcaggtatacctctctgatcgatcttaaagtatgtgctgcagtgtggagagctctgctgagctctctgataagatggtagactgtatgtatacctctctgatcaatcttaaagtatgtgctgcagagtggaggcctctgctgagttctctggtaagatggcagactgcacgtatacctctctgatcgatcttaaagtatgtgctgcagcttggagagctctgctgagctctctgataagatggtagactgtacatatacctctctgatcaatcttaaagtatgtgctgcagagtggaggcctctgctgagttctctgatgagatggtagactgcacatatacctctctgatcgatcttaaagtatgtgctgcagcgtggagggctctgttaagttctctgatgagacgggagaatgcacgtgcatctctttgttttggtgcaggcacacacaagtacactggaagtcttggttctttctcattttacttgggttgtcaccagtttctggcaggaaattctgcctcagctatcggggcccaagagccaaatgtgctccaaatctgggccctcggtgactgcagagatgccaccctttcctttcaaatgcaactgcccttgctgggggaggaatgtcccaggaaattctctgagtaacactgtgtctgggacaggtatctgtgctccgaggaaagaaatagttttctaaatagtttgtttttgtctcagaaaccagagccaggagcaatgacagggagccactcagttaacgcctagaggccttgcttattctggctgcgatcacagaaggcttcgggcgatgatgaggaaacgagtgtgaccctctcaggctggcttcacagggttagccgttggaggagagaaaacccacccaaattagtgaagtggaaaggtttcatgaacttctccagtttcaacaagtgaaatctgtgtgtttgggtgggactggagacaagggaagatgagggagaggaaggaggagagagggagagagacatcacatcctattgcatcttccctaaaacccagagtgcttcgcagccatgctacaggacgccctcaccataaagcaaatgtgggggatcattttaaattagttgcctcccaaaagggactgttctaaacaaaggtggccgtgcagccttgaccttcaacagggagtcccaacacttttccaattgcctcaaaagcagagattctggaaaaccagatgcaacaagatgccccaagactcacagcctgaagactgcggggagcctttgggccgatggggccgcttttataggacatgtttgtgccacaccaggtaagagaccacctgggacgtctatgtgtgtggggagaggacacgcgcagctgcatgctgtcggagctggaaggaactgcagggaccatcaaccccaccttcatttcccagagaaaaggagggacagggcccatggctgtgcagctggccacagcccagtagggtctagaactcagaatccggacaacccccatgccactgtgggccgcagaccagaagctcacagagctggggccgtggcctcctggatcctgctctcacacatcctgctgccacaccaacaccagagaatccaccgcttctagcaggaggacggcccgcaaacgctcaggggaaaggaaaaatcaggcctgatttcttacggagttggaaaaaattaagaaaagcccattttgcattttgaagaccaaaaatgtcgtgctaacgaagaatgagaagagcagggcctttttttcctctttttaagattaagggtaaatcgcatcctcactaaataagagaagctcatacatggtcttctcagaaacccacagagaaggaatgggtttgtgcttccacattcgggaagggaggacccaggcctctgcgacagctgcactgctctctggctggtcgggtgccaactagagccgactcctgcacacatagggtcccgggacaagcccttgtaccttggaacagagcctcactcaaacagaaaatgatgaacacaattttacagtcttgtcatgaagatcggaggagatgacaggtgcgcatgcttggcaggtgtgaagtgctaagagaatgcaggactgtgcaagtcactagcagaaaaacactttgtgaacaagaattctgggtaagcgcacagaaacagcatgacgtccatgtccacaggcagagcccgtgcatctgagcaggcactgcgggggccaaggcgtgacatgcccgcaaacctgtgctgtcttttctgctttaccacttgacagggaaaatggatagagatgaagcaggagcaccaagggtcaggctcgactcaactccacacacttcagggcaaggagcttttcagagcaccttaaagaacaactacaattccttcaattcactttagttcatgcatattcaccaggggctctgcgtggtccgagagctggacacaaagatgagccagacacaacctctgccttcgtggatctcatcacttagtgaatacctgtggccggcccagctgcctggccagtaaagccgccactccagccctcatttccttcctccaaccacagatgcttgttctcctgccttccttacggtgccatatgtcacgagtgccatgagacagggttccagtcaacaagaagtacagagaactcccaggggcttccagaaaagctttgtttttgtgaaaaaggggacagaggcagctggcctcatccagttcctttttctcctgcagtgaggatgtgattccaggaggtgttgtagccgcattgccatcacaaggcaccgaggataaggatgaaaaggcagtgcactgaggatgggaaacagaagccacaggaagatctgggctcctgacagcagtagttcagctgccagtgtctacaactcatccaccaccacgtggtgtgttaataagagaatgaaaccgtgatttggaaaactaaattaattgaacaaaaaaattaaaattatttaaaggttctattccttgcagctaaaagcaattcctatggatacatctgttttcataagtgaatttcgtaagtttcttgtttgacctgctttgaagtactgtcacgagaattcaagtcagataatgactaccttagtgcagtgccaaggcatcttctcatcctcatcaacagcaccgtgccgggggaaacctgaggctcgaagaacgacctgttctcctggttcattagaaatccgcccaggcaggggaacgtcggagctgtccacccaccctctgccaccacccatggggcctgccttccagggctgtgtgggggaggctgtgcttacacccagcagcatagagaatgaggggaggagagccacagacacaataaaggtgcaacctagggtcacggaaaagaacagctctggaccagacactgaaaaggctgatgaaatgagaccaggggctccagacatgggcaaacttcagagttgagagatgagtggaaatggcatgcaaagatgcttctgtgcattttgtggcagtttacagcattgcaaactcgattctaaggcaggcgtgtcctgaagtgggttgagatctgctgagctggggagcaagcccctgccagcgagcccctgatcccctccagctgggagggttacttcctcccagaaggattacatccacattgctcttagggctgacggacactgcaatggaagggactcaatttaattcacaatctggaagactcagatcagaaacatgacctttgacatagcatttggacaaaccagggcaccgcgatgcattggcttagctgagacacgcttctcaacttgcatctgtctccaaacacgccctcagagttaagaaacaccgcctcccccacctccccagacgcacggtgatgaacgggggggtctgtaaacaaaaggccagaccacacccagatttgggaaaactgcagtgaaacggcaacttcgggacacagggtgggacacaagcccttcctgccttgcccagcccaggctgtccctctgtccaaggctgcatctcccaccactgggaccccaccctcagggggtgaggtcttgcccatgacaggccctgtgtggatagggactctgggcactaagggtgagcgctgagcccttgctgcgtttcctgagccgagtcactgtgtaaccgtgggtgtgcaccaggaccagcgagtgaagggccaaggtgcagacagctttaggagctgcacatctcttggaaatgtggctgtgaccctggctaacgacgaccgtcaccactgatgaaaaggaggagtcctgatgactcttggttggaatctcaggtcccatctgggactttgctgagggggtcccagtaacaacaacgtggcaaaaattgtttggtcagtaggttcctctaagccatgaaccccacacacagctgtgagcacacacacacacatgtgcacgcacacgcatgaacacacacacacagtgcccctgtgtgtgctgcagcatgggccctctgtcctgatcaggcgtcctcccctctggtcctgagtgctctccatcctgggcctcccatctcattgtcgcccccagctggcatctcagtgacttggggctgctctgctggggccttcagctttgtccacagcactgttggtgaatacccctctaaggaagctgcctctgtctgggtgacagttccccagcctctcagacccttgactggggacagcgctataaaatgtgtgcagtgacctgctagttagttttcatccaatgcactggacacagtcctttccacagacaccagcatggggccctgccaggtggcattgggggctgggtccatcggtgtctccatgtgccctggcatggatgcactgtggtgtgggtggcacgggctccgctgcggggtgagtctacactctccagccatgtgggctgcaattcagtctagaccctggcccttccatgtcagtaacagcaacgtggagattctcaacagggggactttgccaatgtcaggagacgtttgatcatcacggggtgggggtggggatgcgctaaacagcctcaatgcatggcgcagctcccaaaacaagaattaaccggcccaaaatgcagacggtgcagagccgtggccgagacaccgtcctccagccccaggctgtggtgtggacgtttcataattgattcaatgatttccttattgattgatgcttacttcatcttcaggtctttgttaaacaggaagaccttcggcaaacaccgtttatttgtaccccttttacgcaggtatggctatttctgttggagagatttctggaagtaacacttctgggcaaaagggtgcatacatttaacattctgatggttttaccaaggtgctgaaatgttgcagggatttactctcctgacacacacccacgtgccctgggctttctggattggcctgcagtgactggcagacagtgacggcagaacaccctgtgacatcacccatgccacggggagctcaccgtgtcacctgctctgacgtcaccagtgccacgggagctcactgtgtcacctgctctcctggtagccacgctcggcatgcagaggtgctcggtgacaaggaggaattgctttactgtgttgtgtggaagaatgaaaacaggctgagtggacaaaggcgctgacagtgggttatcaccgagaggtctgtagagtggaataaaatatctgcttacacagaggagaactgcctcggaaatacaactatgggacatctttatatgaagtaaagaattactatgaagatgaatctgcaggaaggaagagtggtttacgtgataaaaatctggattagaagttggatgtaaatgtgtttaattaggtgaatacaactatgacaattcattacaagatgaatctcatggggattagtactcagtactttaaatacatcaatgttgatttttaaaaatcaccttaactccttttttctaagatcacagttatacttcaattatctcacattgtgaaatatgactgtggagtaggaaggtacttttgattagcttcactttcaatcactgaaggattgcaaatgaatgcaaaagttccctgcaatggaagctgatgtggggaagaagttaaatgggtccttctttctttggggttaaggcatgcagagaggaaaatctagtattttttccgaaatgaagtatttcctgatttaacttttgccttcccctctggtatgtcttctatctatgaggttagagtttaaaaaaaaacagaatttaatgtgttcctttcgttttcttgttaaaataacctgaaacaccctgctccagttgctgtctaaaccgtaaacaccctgctctagttgctgtctaaaccggaaacaccctgctcttgctgctgtctgaaccgaaaacaccctgctccagttgctgtctaaaccggaaacaccctgctcctgctgctgtctgaaccggaaacaccctgctcctgctgctgtctgactctgagacaacacggccgcgccaactcgctaagaccggcccagcccacggagtaatcctcaatacgctgtcacatacacgaaaagaaaatcaatcagtagttaaagtagatcctgattttaatagatgtggaggtttctcaatttagggagaattaaattagaagcagcttttcaacggttctgtccttagcttagagactttcaaaactcagggaagtcagattggttgaaggatactaccattttgggtaaaaccagtggcttttagaaaacagcttatggtattttggcagcaactatgtgttttagaagctgtgaaggggccttttttcctggagctcagatggcactggtactatttcaacctctaggtgaggtctgttttcagtgaccttggttggcattgggccggagcaggagggtggccctccacatctccactgtagcttgcggggcagcgccctgcacgttcccgtggtggggtgtcccggggaatcttacccagccggttgcaggggttccgtttgaagagagctcgcagcaaactctgtgcctccccactgaggaactgcggcatccccagcttggctctgaaaaacaagatcctattttaggatctattttaggagaacaaggacaagctataaagagggccccagtcagcattcagagacctcaatcgcagtcacccagagcagcccgtgctctaccacgtgggtcttaggacccttttatgctttaaaagttactgaggacaccaaagagcttatgtttatgtgggttacagctgtgatatttaccacagtagaaagtaaagtgagaaatttgtataatttccatttcctaattcactttaataaatttttattaataaacattatttaataataaaatcattaaaaaacaataacactcccattaacacaaataacattgttaatggaaattatctatgttttctcaaacatacatataaaaaagtctttagtggcattgttctgcacttgggtgcgtctcttcctggctcataggagacagctggaccctgtgctcggtctgttgcgatgctatgaagaaaacctgcgagaggaggacctgcaaaccccgggagggtctcaggaccaccggagtcctcagagcacactgagaaccccacgcgcagagcctagtgctccctccagaaattctccatccctcccaagtggaatgccctgaggccacacccgtgacttgctgtcagggattattccagctttagcaaaagtaaagaacatgtcctcccttaaaattcaaacaatgagaatcactgcaaaggtcctgacttgcagctctcagtgtctgctgcaattcaaggtcccttgatggaggaaaaggctgattaaataaaaagacactccttagcttgacaaaagggtcctcacaatggggcttccttcactcccctctctccttccatctacataaggaccgagcttacaaaagctgagctggtggtgttttaggtgattctcaattttataaaagttatgtgtccatttgcaagcagagttggcaagagcagctcatgaggacaaacagctttatgactcctccaccgagtggcctcacttaggaaggaactgattaggggctcccagcctctctgtttcctgccctcctgctgtctgctctgggacagtgatagtcagtggtgtctgctcacatttaggatgctatggcaaggtggtatggggatcaggcttcttcctacagtccaagagcaaaaccttggcttagtaaatgatttttcatgagaattaagcagaaaatggtttgtatccagtcacatggtaaaacgataccgagtcctgccaaggtcaaccaggagtgctatatgaatggggtcagcaggtggggagggaaaggagacccctgctcctgtgatctctccggacaaggccctggaggccttgtgtctttttccgtctatcctttacttctgggaggtcaccaaccatcacgcttgaaaaccagccactacacattctaagtgacttactgatggaaaactatctatggtagaagagttcatcagaaccactcagcaggatgagacaaaccagcaactgctcccttgacccactgtcattagaatgcccagcaccctattaccactgctactggcggacgagcgctaccattttgtgtaaaaccagtgacttttagaaaacagcttacaatactttggcactgtaagcctagcaatgtaattaaaacttcacagttccaggttcagaggcagcagctcttgatatcagaaggtgctcgcaggtctctggggtggctcccacactactcacttgaggatgagagccatggtctccttcctgtccttcccctggaacggcagggaccccgtgagcatctcaaactgcagagcaacacagagcacagtgagttcattcatccagatggacccggcttcacggcagagtaccccagcagggcagcctgctaccgtgtccatttcctcatgcaaaatctccatcagtcaattgtagccactggcctacgtgcttggggtacaacagtgactaaaactgcctcgcagagcttgccatttggtgggtgagacgggtaaatgacagatgtggtagataatcacactctgtggcaggccagcaggccccgagtacgacagagaaaagaggcagagcagggtcctgtggtcaggcagtttggacgaacacatcttacacgcggtttaggaacctgtcctgccctggcaggtgttgtggaagggatgagctaggaggaggaggaggagaacagctagctcatgttgaacacccatgcatgcctggatggtgggggctagagtgcttccagcatgagatagacctgaccacagccattagcctctgacgaggacaatatggcacagcaacctctcagatacagctgccgcaccctacatccttattttgttattactggacacctgccaggacggaacttgagataaggaggggatggagcacagccttgtctgagcatgggtttctttcttgcaccaactcccccgggcacatgcagtggtgattacacacactctggaagcagtggcctggaatggtctcatcagagcaaggtgcacagctgaccgcttctcacaaaagaaactagggctgcagcaggaaccaatcttttcataaaataagaccctgaatctaagtggaatgtgcccaaggatcaatcctactcggtgtctttcacgtcagtttaaattacggggaagcaggtgtttccatggtcttattgaattctctctcatctttattttttgctgcgtgtgtctctgcccttttagaattcatcctccagcattcgtcctttgcagttcgaaaatctcaggagatacacaaagtagaaagaccaaaaaaatcacgcagaattccattacccaaagatatccaaacttaacatttgttagttcctcctagtacttttttcaagctgttttttattttgttttaaaaacacagataaggttttgtatactaacttttcacagaataatataaaactttcaatggttatgatgaaatctttgtaatatcacttaacaaacatggatatgacaaaatgtatagtgagtgtatttgttgctgtacacttaggacatttccaattttctgctattgtaagtactactgaaatgtgcacagatgatttcctaagatttattcttatgataggctgctaggagtgaaattataatcttaaagaaatgaatgcatttaaggttttattaatattaccagtctgctttctgaaaacaacattataaaagaaatggaaactcttccaccagttctgacgtttgaagcctgttctgtcacattaaaatgtgctgtccatccggtgcacagagtaagtgagggaactcagagcagacaggctgcaggcaatcaatcaatacaaaagtaataaaaagcaagcggaagggggtccagatgagaactgaaaaagagacaagtgtaattaaacaggaaaggccagaatgctctgactggcagatgagctgtttgtctggtaaaacaggatgaaagtttataagctgatcatacacactgaaatatctctcagaatagaatggtattagcaaagggaactcctttcctattctgctctttcttctttctttcttgagtctattaatagcactatgaaatcccatttccaaggacaagccttctggctacatgaaatgagaaagctgtcatcccatacacaccgtttaatccttgttacacaaatggtgcctgtccagatgcccggatatcatttattttttgctgatggactggtatcttgcatacatttgtttggtgatttctttttcttttctttttttttttttttgagatggagtctcgctgttgcccaggctggagtgcaatggcacaatctcggctcactgcaacctccgcctcctgggttcaagcgattctcctgtctccacctcccgagtagctgggactacaggcgtgagccaccatgcctggctaatttttgtatttttttttttttttttttttagtagagacagggtttcaccatgttggccaggctgaactggaactcctgacctcaagtgatccgcccgccttggcctcccacaatgcttggattataggcgtgagccactgcgcctggtctggtgatttctttttagcttttgaagatgattcccttgtgatcagggtccactgctttgtggttctctctcttcctccccttcttcctccatccatatggtaggaggtccccaaccatctactcagccagagaacacccagcacagcacccatgaatattcaacaactgcttcttggtgatgaaggtgctgctgacggtggggatgatgctggggcggaggtgtggactttgcagcctccaccagccatggggttctgctgcctttcccatccccttatccacccttttctgtggagaagggagatcatttcagtatgattgtctgaatggagctgcccgggaactttccagtgccgaagcattactgactgaggttttgctgatgagtttcttgggacgttatttacagtaagacttttgctgtgttgctgagcagcactgagacttgccaaggcttccggggtgaactgagaaaagccgaggttcatcttggggttcccacagtcaagtacacgcaccgggggagggagggcactccaaaggattctttcccaatcggcaccgagaccaggctgcagacaggcacagaggggctcaaggagatgtagccaaagctccaccgggtgcaggcccgatgcttctgggaaggtaattggacagacataacgcagtgcttctcaactggggtcaccgttgcctgccaggggacatttccggctgtcatgcccgggagccctggtgctacaggcgtccactgagggaggcacagatgctgctaaacatcctatgacacacagggcgccccacaacaaggaagtgtccagtcccgacctcaacagtgctggctgagaagccctgtctaaagggacagctaaggaacctggaaagagtggcggccccggcacaggcaggatgcgcctcatggaggccagtggtactgggggcaggggaaggaggagactctggggagacccttggtgacaggagcctcgatttcaagtttacttggccgatcaccattcttaaaagggcaccaaaagcaagctaacattttaatctgaaaacaggcgaggacaagccctgacctgagatggatgacttgaagtggtagagggcctggctttgcagggtatggaggggctgggtctcggagagctgtgttgatccatgcccatgtgtggaggtccctgtgtgcacagacacatgccctctaatccgagctgctctcgctccgtgtgctgcaccccactccgagtgccaagaatctcagtctcaaaacagccttggaaggtgccgttcctcacaaccgtctacagatgaatggtccagtggcaagcagcagagcctgagctcagaaccatccgtgtttgctatggtggcataaggacacatcacatggcacctgaggcgggatgtccagaacattccgtgcccgtggttaagaaacgggagaaggataaagtggtctcacgaaaccagagtgctcaagagatgctttagatgtttacaaaacagcccaaatatccttctagaaactggctccagcctggcgtagaggagtgctggaaattctacaaatgtcaccacgcagccggccaccaggtttgcacgttcttctccaggtaccagctcctaatttcagacacggaattttattcagggacactgacttcctgcccctggcacaggcatccttccttccaggtctggggagggcacttgtggatgctgctcctcgggaagagatcccagcacacatccacctccaggggacggacggccacccacacatgaggaccactccctcagcacgcggcctccagggtctcagccttcttttaaaacaaggcccctcacacgcacaacggctctgcaccgatccgcttacaaggcttgggtaagatacgacttcaaaggtcacccgaggcccatctcttagctgcaaatgagaattcagaagtcacttctgatgccacccacggacgtgtgggaagcgtggggcctccacagtcaagacctttgcctgtgtgcagccagtcaccacgtgggcgggcggcactaaatgagaatgtgtttctgggactattatgtgatcttgagcccgacacttaggctctttcagctttagttttcatttctgtgcacagaaagaataccgtctttcctgcccggcttggagattgttgggttgagatcaaatgtgaagatggccaggcagccttagcttgtggtcaccacggcaacagccagccctgcctcgggctcgagagtgacacagcagttctggagccggaccccttccccagctgtcacgagacattgaatgcgggacgatcccagcaaacaagtgaacaattcagtaagaaatgtcctgtgcccagggaggcacgtgggaggagagtgcctgctgtgttgacgtgccgggcagcgctgggccaggcctccttcagaagctctcaatatcatcttcttcacactccagggacagggagggtggggactccaggatgggtgaaggctgccgggcactgggtctgggtgtgagtgcctctctgcttccaccctgttgtcttcactccctcatgggtcccttggaggcctggccaggtgcaggcacttttgtctgtgctggggcatcttgggtaaggtgactggtgtttaagaaactccacgtgccaggagacactcacagagacagacaacgacaataaaagatggcagacgttagagcagtggcaagccaggagtgctgagaagacaccgaagccagagccaccagccagagccaccaacccggccagggtcagcaaaggccactgggagtggtgcttctgtcttagggctgatggtggaaggggaccggggggagtttgctggagcaaggcgagcccgacgtggtctcatttcctcttcttctggcccctcgtcgtgtctccatctttggatcattcctcttctgtctcttctgttctcctatttctttttctttcagcttctccatttgtcttttcggtttgcagtgattaagaccagaagaactgggcgtggtggctcacgcctgcaaccctagcacttctggaggccgaggctggcagactgcctgagcttgggggttcaagaccaacctgggcaacacgatgaaaccctgtctctactaaaatgcaaaaaaaattagctgggtgtggcgggtgcctgtagtcgcagctacttgggaggctgaggcaggagaatggcttgaacccaggaggcggaggttgcagtgagctgagattgcaacactgcactccagcctggtgacagaatgagactccatctcaaaaaacaataaaaaattaaaaaataaaaagaaaaaaaagaaaaaaaattaaatatatattttatattatgagataggttttatgatctgttgccttaatagaagaaacagaagactatcaaatctcccctccccctgtccccccagaaacctcacaaaactaagtccagttggttttgacttatatgtggtgttttggctgtgcttttctctgctaagttactcctctccactccagcctggcctcttgttctttttaaacattggttcacctgagagccaggtggcaacattttatgaccttgttcattacacaaaggctggcccgcagtactgctggatgggccacttgtgagcccagagttataggacaggacccagagacagaaggatgccaggagccctttcagggagcctggatgtgcagcgtggccagccctgctctctgggggaatttggggttctcaggagggggtttaagaactggaatctctcctgaagccacagactataagcttggacccatagcccagcgtcagcaaaggcaacatcagacttccctgcaccggcaaaacctgcaccagcgtgggaggtctccacagggctatccccgctgccctcacccaccactcaccagccagggtcacacaggaaacccacacatgtggaagggagtggacctatcgaggcagaaatcacctccaagacggcaaagcaaacctgcctcactgacctatctaaagaaaacctctttcagtggaaggaaagcagaggtggtctcagaggggtgaccgtgggggacttagctctgtggtctccgcatggagaggacctgctccttagccagtgccactgaaggtctgaataatagtaaaaaataaatcagcagcatcatcctcttggctgagctcgcgggccccttgctttgctgcaggcattctctcaagtgtcgtgcctgtgctcacgtgttgaactgcacgactgtctgtgttgtgactcactttacaggcaggaatgaccagggacggaaggggcttccacaggaaggagtagccacaaacgtgatgtgggcatctccgactgcgaactggctttctgggttaggctgtgggcccatctccggagctggtctaatgtgtgtctgcccctcgcggagaggtgagcagcccgtgcgggcacgtggaacacagccagggcctgtgagctcccggggctgaggccggagcctggagagtgctgcagtgacccaagtggcaaaggaccagcgaggccctgggcaccagccgggggttctccaggcgacaccgcaggactcagccctggggttccctagcaaggggacgaggagtagggtgtggtgggaggagaggcggtcaaaactctgaagggaactgggtttggcaggcacacagttctgccacacgccagcggagcaaccttcatcccgtctcctaaagtgctcatggcctcagtttcctcctgtgtgtgatgcacaggccggagggcgggatacccctgaaatgccacgacccgattgtcatccaggtcagattccagagcactcactgcacgcctgctccaccctgaggtcaccagccccctgcccagctgggagagtgggattgggggagggagggagggtcctgtgaagattgggaaaggagcccacacagttcctagggcggagaagacccagtccaaactgggttctgttaagcactctgcctgcgaaaacgcgacagagacaattcacatttccagacgctgatgcaaaaatgcctaactccgtgtacatctcagtttgtaactaagcgcaaggattctgtgtctaaataagaaaaatactttaactcgaaaatcatggcatctcttgtaatcatcacgctaagcccgaagagcacaaagcataaagagggttcgactcctcccacgtctgcgtttctgcgttctcgtttgcatcccagccccactttctgatggtggggatgtgggatggggaggaggctgccaggaaatgcttggcctggacacttgcccagtgtcccaagccctcaggcactgccttcttccgcatttcgggacctctgaaccaacctggggacaggggtccacgtggggaacagccgccatggcacagaagagggtcggggcaggctcaccatgagcacgccgaaggaccaccagtcggcactctgcgtgtgtcctcgccggttcaccacctcgggcgccatgtactcgatcgtcccgcagaaggagtacgctctcttgtcgtggtcaatggcctccttactcaggccgaaatctacatgcaaacacagcacacacactgcctcagtctctgggtgtgttcgggggtccacactcaggcgggcatcagcgtccttctgtgggctctgccccctctccaggtgggcgcagcagagccctgctcagcaaaagcgggaccatgtgagtgcttcccgaagcccgtcagtgcccgaagcccgccggtgcctgaagccgaaatcctcaaagcgtgaggagttccttatgagtgtacacactcaggagcgccttggaacaccacccagacagcaggttgtcagtcagtgacgggaactcccccagacccttttccacaggcacgtggaggtggggtgttgcagggcagagggacctggggtggaaggcaggtgtgtggctgacagctactgggaaaggggctctggctgccggggagccaaggggaaggcagagtgtggcgaacctgccctgccccgacaacacgagggtgtggagagcacagacaggcggaggaggcctggggagcagaggccgagctatgatggaagaacagggatctccaggtgccacagagcaaggaggggcttctgaaggaagtggccccggggctggaaagaacaagagtgcattggctcagggcccccaagtcttggggatgacagagcgtggctaaatagagccaaggcaggcccagccagtgggtagagcagcagtgcccagagaggccatgtccttgcccctgagcctgggaatgggccaccttatgtggcagaagggactgatatggtttagctgagtccccatccaaatctcaccttgaattgtaagaatccccacgtgtcgtgggagggacagagtgggaggtaactgaatcatgggggtgggtttttccagtgctattctcgtgacagtgaataagactcacgagatctgatggttttatacagggcagttctcctgcacatgctctctctttgcctgctgccatgtaagacgtgctttttctcctccttctccttctgccatgattgtgaggcctccccagccaggtggaacagggtgagtccattaaacctctttcctttatgaattacccagccttgggtatgtctttattagcagtgtgagaataggctaacatggggactttgagaacagactaatacagggactttcagaacagactaatacagggactttgagaacagactaatacagggactttgagaacagactaatacagggactttcagaacagactaatacagggactttcagaacagactaacacagggactttgcagatgccattgaggatctggagataggggatgaccctggatttctgggtgtgcccaacaccattgcaagggtcttcaggttaggaagggaggcaagatgcagtcagagagcttggaagatgctgcctgctggcttccaccatgggggacgcagcccagccaaggactgcgggcagcttctactagctggaagaagctaagcaagggagtctcctctagaggcccccaaaaggcaggcagccctgctgacaccttgatttcattcctgggagacttatttcacacttggggcctcctgacctgtcaggtgataagtttgtgtggtttaaagccccgatgttcctggcattttgttgcagatgctatagggaactaatacaaatggggtgtcctgagactagaggagctgttgccagtttgactgaatttgctggtggctgccagggctcagatggaaacagggagggaagtcacgtggccaccaccacggtccagggagtgagaaggaggcagggacagcatcagtgagggcagcagtgcaggccgcactccagcgagactccagatgtctgccctcaggttggcactgggcatctgcaaggcccacattgcaggctacactccagcaagactccagatgtctgcactaaggtcagcactgggcactgggactcctgaactaaacacccagcgacgctgaaggagcccagcaaacagaacgtggcaggggagagggaaaagaaggggccaccgggaagctgcatgggtctggacgttatgaagacatacaatgccataagcagtctgtagctatagaaaattctgccaaatcagagacaagcatctggcaaagggaagggcggtgtaaataagagggcttgggctttgaggtggtccccaaaggtaccagggctgagatgaagccatggagggggcctgccgtcttttacaaacctgtgatcttaatgtgcccctcttcatccaggaggatgctaaaagaaagggagagaaaacagatgctttagaaagagacccagcctgccgacgggcacgcagagctcagaggagagctgcggggcagctgggggcggacgttttcagggagccctgatggagctggcccaggagatccccacggcttgtgcggtgggccttcccatcctgcctcgcttctccacagctcccagctcgagaaagcatttggtgccacacctcctggataaagggatgtgtgttcgtgcagctggaggactgctggctttagatattcgtgggtccccagggaaggtctaagagccctccagactgctgtgcgcaaagcataggtggagagcgtcctgggactgctgtggcctgtggagacccagagcctcgcagatggaatgtttctgcactcgggatgcccttgatgtccaaagacccccttcttctcccatgtatcctcccctgagccctgccctggctctccagacccacccaggtgaggcctgcacaagcgggggccaaggcatcgaggagcttcgggcttcagcaggtacatcttgtgatgagacctgctcccggcttggcacccctgcgggccactgggtccctgtcttgttccctgccaagcccttgtcacgccatgtgccggacgtgacagttgcctttgctcctcccaggtatcctgccgtggggtgaaccctgcatagagaatggaggcagggtccgtaaagggctgggtgcaggcataaatcccttcttccctgaacatcaggcgggagtctgggctgtgataccttgacacacctgtggccctaaactttccccatttatttatttggctgtaattaaatcctgttcttccagatgctgggaggtaccagcctagccctaaagagaccaggaagtgggctggaaagaaacaaaggcaaggcttggaggattaatctgtgatacctttatagaaacctgtgaaaggaaggaaagcctgacttgctacagcacagaggagcccggaggacattatgctcgattaaataagcccgtccccaaacgacaggtattatatgattttacaaatataaaatgtatggtccctagaggggccagagtcacagagatggaaagtggatggcgggtgccgggggctggggagctactgtgcagggggacagagctttagttctgcaagatgaaacagttctggagatggacggtggggatgggggcccagcaatgggaacgtgcttaatgccactgaactgggcacttaaacgtggtgaaaactgtaaaagtcatgtgtatttttctacaattaaaaaaaatctgccacagagttaaaaaaataaccactattttctggaaatgggaaggaaaagttacagcatgtaattaagatgacaatttataatgaacaaggcaaatcttttcatctttgccttttgggcatattcaatctttgcccagaattaagcacctttcaagattaattctctaataattctagttgaacaacacaaccttttccttcaagcttgcaattaaataaggctatttttagctgtaaggatcacgctgaccttcaggagcaatgagaaccggcactcccggcctgagtggatgcacggggagtgtgtctaacacacaggcgtcaacagccagggccgcacgaggaggaggagtggcaacgtccacacagactcacaacacggcactccgacttggagggtaattaataccaggttaacttctgggatgaccttggcaacgacccaaggtgacaggccaggctctgcaatcacctcccaattaaggagaggcgaaaggggactcccagggctcagagcaccacggggttctaggtcagacccactttgaaatggaaatctggccttgtgctgctgctcttgtggggagacagcagctgcggaggctgctctcttcatgggattactctggataaagtcttttttgattctacgttgagcatcccttatctgaaatgcctgaaaccggaagtgtttaggatttggggattttgcaatatttacttatatataatgagatatcttggagatgggccacaagtctgaaatgaaacaaaattcatttatgtttcatatataccttctacacatcacctggagctaatttatagaatattttaaataattttgtgtatgaaaccacgtttgtgttaagtgcttatgtgtggaattttccactggggggtgtcccattggggctcaaaaagttttggattttggagcatttcagattcggatgagggatgctccagctgtatttacacacgtattcaactcacatgtgtgcctgtggcgttccacggactggtggtgaagtcagatcatcaagcacatgggcaaatgcattttgcatcctgcagtggatatgggatgtgacctggtttctgggtaaacccagctgtttcccatagatgacagctgcatctaacaacaccagcttcggagcagggcttgtcttttctcagttccatgcaggtgacagggcaggaatgtggagtagcaactgggacgcgtttgcagaccccagggcccccccttggtcttagctcacaggcacggggctctctggtggtacccaaggccggtcggtcccaccaggccacaggtgatgcctcatctaggggcggctatgggccctggtctgggtgggtggcattaatcggcccctcagggcagggaagagtgagtgatcacctcagggatactgctgaggtcaactcaacctaaaataccatcctccaaatctcttcttttctaagtggatcactcctagttatgtgtcaggtctacaaagaatatgtaaaaacaacaacaacaaaatgaaaatgggaacactattattttggagggactttactgttcaaaaatctagaatagattagcaaaatatcgtagaaataatagcctcacaggtcaccactgccaaggatatacaaatctcagtggactctgggtctgagaattctggggccgttgtcttttaggtaagttcttgggagagctgttctgactggggacctagaggtggggctgacaagtaactgagtagaggttcattgaccacattcctgggacttgctgaagtagatgaaagggcttcctgaatctggaggacagtagggaagagatgagagaggaggagaaactgccctggaggcagccatgtttgagatggtccccagtggccagatgagcctcacccaggagagagggcgggaatgtgggtcagggtcgtgggcgtgcccctccccagctccggcttcccgtgcatcacagacatgcacctgagcctggcctccctcaggcgttatgagtgtcaggtgagaatgggcctgggcatttcctatgcaaatcagcaaggccacacctgcatctgggcacctgatgcctgagccggtcctgccggcacaagagtctccccagcctgctctctgatatgtcctcatttaggaaataaatatctagcagtggctaccaacatgggccaggaaaatacatggagctgatgggcgtggggaagtcagccctagttttttctcacttacttctcaggcttcagatctctgtagatgatccccaggctgtggagatggtctaaagccaaggccagctcagccaggtagaacttgacatcctcctccgtgaacatgacctagtaagaaaaaaacaaaaacaaaaacaaaaaacgtttaacttgttttatggctggtgtgttttaaagaactctgccagagagactgagagtccacactggggtcagtttgctctgtggaacgctatggccccccagagtggtcttctgactcttctcatggaaaagtgagttccctctgcagttccaagatcagtggatggagacgagggcttcctgcacaggtgactcatgccgccttgagagtggggtgctgagattcagcctctcctctctgtgtccttctcacccctgcaaatcatttggctctggagtaggtttctgggtttacattctagcatgagtgctgctcatgtgaattcataacaaatgtaatacaagtaagacgctgagggcttgatgaggtgactgaaaatggggctcaaatatcattctttccccatggattatctatctccactccttgggttgatgcaaactagtagcctacgtaacctgctgtcaacccaaagtgggattagttctaccaaagatcacccacaggtggtacagagttggctatgggtgccccaagctgagggggcgggatggggaggggtttccaggtgttggggttggcagccacattccgggatcccacgtagctgggacagctcagggctgggaggtgaccaggcagggatggcctaagtgtccatgtcccgggggctcactcaggccagccgaaacatgcatgaggcctcggagcccaacagactccaaagccatcgccccataatgactcatccccacccccgacttgttagaatcagcacatagattttgtagacccccttaagaggaagcaaaatcatgaccacaagccattttctatattcgtcaggagaaatcaatgttatggagactacaagtccacatgattactgaattctctccggtaagcagacgtgaaaaatcagcacgcagccagaaggctgcccggcaaacacaaaattagaagggcagccaggggacctgaacggtgagtggcgtcaggccgacagccgggcacccgcttcacacagggggttcttccacagggctggacacgcaggctctgcatcctgacagtgactggtgggtgccagccacccaccggccccccgagtccccgtcctccattccacgcttggccagcgcctttcccggatgtatgtttcttttctagatcggttaaggtgctcagtggactgactgacagcacgttctgctagtggcctggttctttcctctgacttgacatatccacacgtggcccaccatgggttttgtgtacaatttagggctcagaggcaaacctgtctttccactcccctagctcttagtgtaacccccaaggacaatagcaggaagtttctccatagaaagggaacacctcacggtgtgagttctgcaggttcaccggcacagcgatggtccccgtaagatgctggaccccgtacttgctaaatgacgacccaaggtgagttctgcaggttcgccggcacagcgacggtccccataagatgctggaccccatacttgctgaatgaggacccaaggaaaagactttccgcaggttcccagcaactccacgaatctgtggtgcccgccctggacaacttccctcctactccgaaatgaaggccctcgggggaggcacacattcccacgtggggagctgcaggactttttgctgattactgttgtctttttggtcagggggcccaaccacaggcgtgtcatagcagctgctggacaaaactggaccccaaatggactgactccctgtggatgagaggggagtggacaaaccaacagatgataccacatgaggaatgggcagacaccaggctccagcatctttggaaatggccacacagcaggaggcaaaggaaggggccagacgccagttcccaaaggcctttgtgtagagcttggatcaggttctcccggcccactgtttttcctccatgcaaggagccccacagaaacgtgcaccactgtccaagggactgctggacgcagagggacagggcagccatggtctctgggaccctttgcgcccgattcaggagcagctctgccttggtttactgttcatttggggctttgtgcaagacagcggggtctcctgctgaaaagggggaaggtggggaaaagggagtggggggtgtgaaggccactgttgctgtgaaagcacctcggccactcctttgtataagagatgaacaagcaggatcgtcagaacggaaagcccggcactggcactgccatgggcagaatctgccttttgccatcccatgaagcggggtgcttttcacgtcaatcagggccacggggctctcagggtgcagtgaagttgcatcctggagggttcctacctaaggcactggaggtcaaggagaagccctggggtgtgcagtagcggctgtgagacaaaggtggcgtgcgaagaccacacccgatgctcccgaacagccccaatgttcagccggcttagcagtacctccctcttccctccctcttcccaggatggaaagtgagaccctgtgagagtctttcccagccgctcctacccaccgacctgcgccttccatctgcgctagctgggaggtcaacagcgtgacttatggtcccagagctgcaggggcgctgccagggccacctgggacgattgctagggccacttgtgcagcttccttagaaccaggcagcaatgcacacagcacacccaacacacacacacacacacacacccaccccacatcacacatagcacacaccacacataccacatacagcacacacacacaactcatacatacacacaccctacataggcacacaggatgtcaaacacacagacaccccacaccacacaaagcacataccacacataccacatatagcacacacacacccacacacaaacacaccccacacatacacacaccctgcatatgcacacatgcacaaagcacaccacacaccccacacatagcacacaccacgcacaccaaccccacacatgcacacagcatgccaaacacacccccacatatacacatagcacacacaccatcacacacagcacacatcacatacaccacaaatcacacgcctgacatatacacacagcacacatcacacacataccacacacttatcacatgacacatgcacaccccacatgcacacacactcacattcccacacaccatgcacacacaaccccaaacaccacgcacacccccccacacacgcactcaaacacatacacaccccacacatcacgcacatgcactcacacagcccccatgcaaaccccacacatgcacatgcagtctcgcaaccccccaccacacatcatgcacacttgcacacactcacacatgtacacctctcccacacacgcactcttgcacacactcacacatgcacacacccccacacacacacacgcactctcgcacgtgctcacgtcctctcaatgctctccacccctcctcccctcgagtcccagacagaagctcctgcccgccctcctgtgtgatgtggcggctgctcacctctttggagagccgggtgaagaggtcccctccccgcaggaagtccaggatcaggtagagctttccttccgtctgaaaggctgtgggggacagagacccgcattttgacagcttgtcgaatgtcctgtggcaacatcgctctctggcttctccctgctcacggtgctgcttactccgggaggctgagtcacttgagaaacggcaggaccccggctggtgaccagctcagaggggcagcacccggcagagggggtctgacactgtgagcgctgcccctctctcactgtcgttagggggccttgagatttctttcatctttctttcctctcccctccctcccttttttaatcacaaaggaattgaaagatacacggggagaaagatgtgaatatttaagctggtatcgttgctggcttttgtcgtaatgcattagtgagcagcctgaagatggctctggtgggtttggaggacatgtcctttccgtcctatggaagtgccttcttcttacagaactccactctggtaccagggagccccccgcttgccttcctctcttgaggcagttctggtgataggtcagcccagttatttgaacatcaacaatggggctcacgtcctaggtctggtcactgtgagctataactgcagactttctgtttcaggccacaggcaggctacacagctcctgcccacactcagcaagggcctgcctctgttgagcgggcgcatgagcacgggagggtctagagaagcccgtcaccatcgctgctgtgacgatggttgctgcagtggcactggtgaggcaccgcgtggcatcttttttatctacaaaggaagtgtggctggaagggatcccaatatccctgcatactagaaaacgttttattttctaaaagtaaatgctagaagcatcataaatgtgggggttttagaaacatagcccccagctagaaagccctctgccaggactgtgtaaactgagtgtgcattaaatgctccatcctgggcttggcaggcaggtggaggtgctgggtcaccactgaggtgatgtggaggtctgtttaaagctctttgtaggacacccagttctcaatttcttcagaaaagcaccctagcaagtaatgtaaatgacacgtgggatgggacttgacaccagccacttggcagcagcggagggggcagagttttggaaagccagcctctgcagcctcctctgccgggaggtagaggtttgcaactgcgctgcccacggccgagaaggaacagcagggtgtgcccagcttctgcaggcctccttcatcctgtcctcagattcacgcaaatctcactaacacctccccgacacaccaccttgccctttgcaaccaagaacaaactattagttttgttgctgttcccttctgtactttgctcatctggattattaggtgggaaagtttaatgtaataagccatgaatctgcagccaccatctcatcacatcttttttaaatttgaagatttcacttactgcttctctgttgggataaaaaggcagacagcaaatgaagagaagttgtgtggcaaagcagctatgtggcctttggttaattatttgagcctcagaacatgaaaataataagctaccttgaatagaagttttgagggttcaacgaactactatctttaaacatgatattcatttgaaatgaggtgttaccatttctggtttaaagaaattattgggtcatagagtattttattctaaaacaacacaaaaataagtcatagattcaccccaatctaggttaagatcttctaaattatcaatggtatggtaataatttaataatggataccccatctaaaattagatctttgagatgaaaacagggcttcttgctctttcaaagaaaataaatacagaagagattaagtgatcaggatagaaggcaccttcctccccaggcagggcaggactctatggtataggaaagattttcttctttctgatctgttatttctttttcaattttctttgatctggagaaggttgccctgggtcctctttaaagtgtcattttgactctacttaccataatgaagcttcacaatgaaggggtgattcacttctgccaagatgtctctctccatcttcgatctcactcggtcccgaactgcaaagtaaaaagataaaggctttcatgaggcaggaaataagagttctgaggaacactgaacatgaaatactagatataattcccgccaacttttcattaaaaaatttcaaacatatacaaaacttgaaaaagttgtacaataatcctagatttaacaactgcttacgttttaatacatttgctttctctctctcatatatatatatatatatatatatatatatatatatatatatatatatatatatatgcatctctagctctccaaaaaattgtaggcagcacgacatgttactctgaggtgcatgtgcaggtgtctcctaagaataaagacagtctcttagcataactttaacacctactgtgccacataggaaagccaacaatcactccatgaaacatctaacatccaatctatattcagtcctcccctccacgtcgttttcccgacctaggatccagttcaattatattggttgttaaatgtctttgttttgctcctagaagacaatggtcccatacctatttccctcgccctgtattttttcgtggactttttgggaagtccaggtcagttttcgtctgtagaatgttccacattctgggttcgtctgatggttgctcatttgctttctaaaactcttgtatttcttgtaaactggaggcgtgataagattggggctaaatgattttggtcaccaggtgatgcctgtactttagcctgcctcagatcagggggtgcctgctgggctcaccctctctgtgtgatgctaaacgtgatgtgtggttgaggtggcaggtcaccatctctccatggaaaaggtcttcatgtccctttgtaacaagaacctgtgggctgatatctggcatagagtgacctgcgggttccctaacaatccttcatccaatggtgtgagcatacatacgtgatccctgcctgaatcattcagggctaaagaacagccatggtcacatttctgatggaactggaaatcaagaggaagattccttctctccctctccatgaagataaccatggaccatgtactttctgttgaatttagtgtgttacaacagctacatattcttcttagtgctcacactatctcaagtgtggccatctgggaatacagatgtaattagttttgatgcagaaacaaatgaacaaacaaagagcaccacttgagtaaaaacagctttagcattcccctgggcaagctgctacacccagggcagtatccgggacctcacacagccccatgagcgatgggagaaaatttcttcaaacattgctattgggacaaatatgatcagtattgtatcatgggccaggtatttaaatttatccatatttaggacttgtgatacatactgctaaagttttatttaagaaattcttcaccaagaatgctgcaataataaaaagaaaatagaaaattacaaactgggaggatgtggagaacttggaaccatcatgcattgctgatgacagtgtaaaatggtgcagtcactgaggaaaatagcttggtagttccttacaaagaagtagaattaccatgcagcccagcaactctgctcacaggatacacatccaaaaaaactgaaagtatggatttgaacgggttcatccacccatgttcatggcagcattatttacaacagaaaaggaggaagcaacccaagtgtccatcaacagatggatgaacaaaatgtgatgctgtagtaaatacacacacacatacacaaacacacacacacacacaatgggatattattcagctctaaaaaagagtaaaattctaacacacagtatgaatgaaacctcaggacattatgctaagtgaaataagccagacacaagaggacaactattgtaggatcccacttataagagttgcccagagtagccagaatcagagagacagaaagcaggatcgtggtgaacaggagctggaagggggagaatgggaagtcattgtttccacctgggatgatacaaagattttgggtataacattggtgaggacaacattgtgaatgtattgatgtcactgaactgttcacttacaaatggttaaaatgatcaatattatgttatatatgtcttaccacagttaaaaagagaaagtccttcctcattcctgggtccctgagtttcactgtctcaactcctggttttaatactcacacctaggattcaggctgtctgaagtccacctttgtctttggtgttgggacagttttgctttcccgtttggtctgtaatactgtctccgggggcccaggtggtgaccgtggtgtatggccctgcaacccagctcactgtcagtgtcactgtgccctactcttggctttggtttcctcatatacaaaccggatgagatggctccccctcctggggctgcctaagaaacctgtgcagtgatgtgtgtgccacaacaacacggggcccgcccacactgtgccgcttcaggtgtcattgcagtgacacctttattatatgctcagatcccctttttttctttttctttttttctgatctctccttgctgttccactgctctgcccatccctcttctaaccccagacccttgtcatcaccgtggtcctgtgacattccttacagcaggggtgtccaatcttttgacttcctgggccacaccggaaaaactgtcttgagccacacataaaatacactaacactagctatagctgatgagcttcaaaacatcacaaaaaatctcataatcgtttaagaaagtttacgaatttgggttgggctgcattaaaagctatcctgggccccatgtagcccacaagctgtgggttggacaagcttgccttagagtctagacaggcatcgagtaggcacccagcaggcagtgctgtgggcagagctgggggatactagtgtctcccctaaacctcagcacctccttccccagtggtcctcgcagttcctaatcccttgagaccaaaacaccaaggtggagggtgcgggagcgactgcttatcacttctgcccaaggggacacaggaggtccttcttctgcctcaactaacggaatcaggattttattgcttaaaagaccttggggagcatgcaattcaaccccatgttcttacagaagaggaaacatgctcactgcagtaaaaagtattgcttaaagttaggtagctcctggtagcctggaggaaggagacccctgcctgccccgctccactgggtgaaggcctggcgtacgtcccagccagcatgtgagcactgtcctcactggacacaggggcagcatggactgtggcacagaagacaaacgctggggaggaaaagggggaagcaagcaacctgggctgaaggagatttaatgagaggggccatgaatggaaaccactgtcccagtcgttaaagtggagcactgtgttcagaagccaggatagcgcagaacactttcaaagaatacaattttgtacccctggctatgattttctctctagagtaatgaccccggagtttagagattcttttcttcctttctgattgtagtcattgtgtgcaaacattttcagaaggctctcctgcagaatttagtcttgcacccgctcctgtttatcatttgtgagttcatgtcttagtgatctggattctgcgtgctggtcagagtagtttttcttctctatgtaggtgaactggaaaataggccataggatcgcggattgtggggagatgtgggagcaaaggtaggctcggtcttcctagcccttttgcaaatcagacagctgaatggtgaggtcacaattcttgccgcttggcctcaaattccttcctcccccacctcttctcctggcccactcctttcccatcactacttctcagtcttctttgtgccaggtgtttggaatgtgaagaggcaggctctgccctccaggaagtgagagcccagtggggagatgccctgtggtgatggcagcaaggggccaccagagggtgaccagtcccacctcttgtgtgctgggggacctgtgcatgctgggggaactggaaacagcctgggaggttttcacagaggaggggctaagccttacaggggacccgggagcctccaggtgcttgggcaggaggatacaggccaagggatggccctgtagggtggcagctggggtaccctcagggatgccagtgggctggcgcacagagctgcagtgccacactgatgaggcctgcgggcagggacatgggggcctggggagccaagagaccatggacaggactttcacacagcacatgtttagggcctctagatttaagaggtcatgtggaggatgcaatagcaacatggctggaatggacaacgtggctagaatggggcaaaaggatactgctatccagccctgcagagggacagatctggcctggaggagggagaactgagacctcaggacctctcagctgctgagaataaaaagaagggagctgcatcatcctagccctctgcctgggcgactggtggagaaattagccaggagagaagtcaggtggtgggcagggagagaagaggccacctgcattctcggcctgttgagtgctggggacatgcagggctcaggaaaagacttggtttggagctttgctggaaatacagatgcgaacgcccaccccacagcagcagccaagggtgcccaaggaccactggaggatatgtaggatgagagtagaaccatggtgaggacctcggtagggttactgttgttctggggaaggagggagagaggatgcaccatgatgtggtccacagtgggaagacctggaggagacagacagagaaatcaggaaatgtgaaagaagtgtttggtggcagcagatgctcaagacagtccaccaggtggggactgcaggaggccgctggtggagttgcatgactcatggccgattcatcagggacgatgtgatgaggacatcgctcatcccccgggaggggcccgcagctgggtctgtgatgtggtgggtgagtgaagtcagcatctctgtaaccccttggtgtgacttttagaagctctgatatactttcttattaaaacattttatccattcattcttgaaaaaatagttcctgatgtagataaaaagaagagagcttgttttattaaccatgactgcagttatgcaccagagaggacactctgaagggcaaaatctcatatcagcatcggcgtgacgtcattaggatgctctcaacacaagctggagattgccgaatggagctcttgtatctactaccctggctctgcagcagaggagaatgaatgtagggaggaaaagcaaaatgattcacagggaaaatgttacaaagaatgtctctgtgaaaggaaaataaatcctggggcccccacatcactaagctaaagggaaaagtcaagctgggagctgctgagggcaaatctgcctcccattctattcaaagtcacccctctgctcactgagataaatgcagatctgattgcctcctttggagaggctagtcagaaactcagaagaatgcgaccatttgtctctcatctacctatgacccggaagccccttccccgctgaagactggaaagtcttcccacctttgcttcgagttgtccaacctttccggactgaaccaatgttcatcatacatatgttgattgatgtcttatgtctccctagaatgtacaaaaccaaacggtcccctgaccaccttgggcacatgctgtcaggacctcctgaggctgtcacaggtgcatgccctcaaccttggcataaactttttaaattaactgagacctgtctgagattttgggggttcacatctccattgcccacctctcccccgttacagcctccaatagctacagccagtgtgagcaccaaagagtttcagggagttgatgaaagcaaacctggaatctattcactcagcacaaagaccccaaaggaagaaaggacacagtggagtcagaaagatttctctcaaagtaaaagcaaaggcctaggcagaagacacagggctcacgaatgcaggcaggctctgcaggaagccaggggtgggggaggcaggagtgactgcacacagtgggaggggtggggacactgccccttctaggatgattaaacaacaagcctctctctctctgagctgcctgctggcatcaaacaaagttaaactcaacaaggaaaacttctctgtcacacatcacacagccaacggggctgccattgaggacccgtgggctctgccacgccctagactcagaatgcttccacaaggagaaatcctcatgagatgcatgtggccaggcttcctacactgtgccctttatctcagcagagcaggcccaggctcggcagggcccacgggagagcaggccatccgtcattccaatgtgcctcctcttctgggtgaagtccctgttccatctgccaggccctgcatgatctgaagctgagacctggtgaagcagcatggcagagaaaaggggggttcctactccatcttgccatctccttgcaaagcttgatctttgactctgggtaagagcatctaaaaatcctctaaataggactgatgttattgaattcacatccatttggaatgaagaacattgtttagccacatgtctgactttatagcattggtaaggaaaacttggtaagtctggtgaaaaattagagaaagatagatgtcttatattcaaattttgaagggactacctagttacagtaaaaaaaaaaataggtctcctccctatatcttacactaaaataaatcccagatctattaaagaattacttaaaaaacaaaacaaaacaaaacaaaaaaacacaaagctggccaggcacagtggctcatacctgtaatcccaacattttgggaggctgaggtgggtggatcacttgagccgaagagttggagacaagcctaagtgttgggaacaggcccccaaatctggccataaactggccccaaaactggccataaacaaaatctctgcagcactgtgacatgcttgtgatggccttgacagcatggcccacccagggcggaaaaccacttaaggcgttcttttgttttgtttttttttttttttttttttttttttttttgagacggagtctcgctctgtcgcccaggccggactgcggactgcagtggcgcaatctcggctcactgcaagctcctcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggcccacttaaggcattcttaaaccacaaacaacagcatgagcgatctgtgccttaaggacctgttcctgctgcagataactagccagtgccatccttttatttgggcccatccctttatttcccgtaaggaatacttttagtaaatcttatgactgacttgctgtcagtaaatatgtgggtaaatctctgttcgaggctcttagctctgaggctgtgagacccctgatttcccactccacacgctatatttctgtgtgtgtgtctttaattcctctagcgctgctgggttagggtctccaccactgagctggtcttggcacctgagcaacatggtaaaaccctgtctctactaaaaatacaaaaaattagccaggaatggtggtgtgcacctgcagccctagctacttgggaggctgagatgggagaatctcttgagcctgggaagttgaggctgggtgacaggagtaaaacactgcctcaaaaaaaaaaaaaaaaaaaaagcaataacaaattataataaagttgaacacttatctggtgtctggaaggggaatcttttttgttttttaaatataaactatggaagaaataacacagtaaacatagttacaaaatatttacaaattggccattcaaaaagattataaaattaaaaggcaaacaaaaaaatatgattatcttaaacaagcagaaaaaaggtcaaaagccaaaataaatacaatacccaaatactatcattatgcttataataataaacagagaatccagccatgacagtgaatgcaacatattccagattaaacccatcagtgcagggaagacgtttttataagaatgttctgtatggttgactccccaggcacaatgtggcctaacacaagtatatgttgagtttagggtggcagaaaacaggaaaaggatgtgttcattccagggcagggctatattactgctgacaacactgtgtaactgaccatgcctagtttccatatatgaatgcaaggacaaactaaacaagatgtcaagggacaaggacagtcattacaccaagcaatgccctcagcatatgaaatactaggactggaaatggctcttcaagagggactagggaagatgttcaggtctgtgcaaattctagctttgctgggcagagctgcaatccactgacctcaccattgcccaccctaggtggtgtcagtcattcatggcccatatccagggatggaatgagagagctgcaaccatggatctgccaactgacagccatggagtgattcttccactaagaaacagacagtgaaagcaaatgtttcattttctgatgctgagtacgttcaagccgcctctttgacagccagggagtccaaggagttttcatttctaagatctagatgtataaaaaagaaaaccaagtgaagaggtttcttcagaaatgtcagcaacaatttcctgttgggtagttctagactactggagactctggagccaggccatttggcccaggctatagcgtctctgtgatgtttattctctggtacttaacaggttagtctggagttgactggggattgctactatagatgtgaaaagaataaatgttctcggctatcttgagattcgctaataaatggtaggcactggggataagttaaaatttcattgtccttcaaattagccctctatttgtggccaacctgccgcgtttcgggtttggatgatgtagtttccgtggtttactttgctctgttcagcaacctgtgcctactggtaccagctctaactgccatgtgctcttcacctgtcatggccccaagacaatccctggggctgagatggttgtggaggcaccaacaggttcaccccactgtgaagggcacactggtttccttcccaggaaaacacgggaggaagcactttgtgagattatcctggcaggcataggatatatgatatgcaactagagctactttctggaacccctcttcaaggtgcctcttttcaggcagcaatgcaggcattgctttgtgtttctgatttttaaatgatctccaccaatagacattatatgtatattacattatgtagtatattgtggtggttagttttacatgtcaacttgactgggctaagagatgcccagagagctggtgaaccatgatttctgggtgtgtgtgtgagggcgtttctggaagatatcaacatttgaattggtggactgagtaaagatcaccctcccctatatgggcaggcaccatccagcccactgagggccagaatagaacaaaaaagcagtgggagaggaatctgctccctgttgaactgggacatgcatgttttccagccctcggacatcagtgcctggttcttggactgagacttaaaccattgcactcctctccccacaccaagttctcaggacttcgaattcagactgaaacttataccaccagctctcctggttctcaggactttgaatttggactggaacttataccaccagctctcctggttctcgggacttcgaattcagactggaacttataccaccagctctcctggttcttgggactttgaattcggactggaacttatgccaccagctctcctggttctcaggcctttggatttgaactgaatgacaccccagccttcctggttctccagcttgcagacagaagctcctggagcttctcagccttcatacccatgtgagctgattcctgtaacaaatctccctctaagaaatgtatatccatcccgttggttgtgttactctggaaaatcctgaataatacagaatttggtacccaaaagtgggatgcccctataataaaacctaagaatgtagaagtagctttggaaatgggtaatgggtagaggttggaagagttctgagatacagctagaaaaggcctatcttgccatgaacagacctttcaatgtgattctggtgaggactcagaaagaaaaggagagctgtagagaaggcctacatcttcttagggaataactaaggaatcctgaatgctgataggaagtcagtatggaccagccatctccacagaagccggcagcgattctccaaggcaacagaaacatgaccctgcagccaactcagagagcatcagggctgcccacccatgtcaggccaggcacaagagccccagggtagaatgatttaaaagtaggggccactggtgcctgggactgcaagggcactgcctcacatcatgggctgcccaccctccagcactgctgtccctggctgtcccgggtgcagctctgccttgggcagaccctggtgccctgtgagccccagcagttgccttctggagggagcaggtggcaaaggctggcagtgactgtgtggttctcttttccccaccatggggagtgcaggagccttgggggtgtggctgcccttacctaaatttcaaaggctggggtccaggcacagaaccactgtagggccatccaactacactggattgggtcacccaaagctgtgggaggccacccaaagctgtggggccagggacttggagagccaacccctgccctgcaaagctccggggcagaaccgccaactcgttatgtccaaaaggcaggacccctgctccagtgggtctggagggcacagcatctagtcaaagaggattattctggagtcttgaggttccatgttattttctctgttgggttttagacttacttgggacctgttactccttttctttcctatttctcctttcggaaagaaaatgtctgtcctatgctggtcccaccacgggatttctgaggcacagagctcgtgtgttttcataggctcacagctggagggtgactgtggtcaggatgaatcataccttggatctcactaatacagagagatcgcagagatactgacattggggatcagaggaaaccatatgatttggatgagatgttgggctttagacttgagttgatgtgggaatgaagcggaggctatggagatgggatgaatgtgggaaagatatgaattttagggactggggtggaacgccatagactgtgtatgttccccccactaaattcatatgttgaaacctaacccccagtgtgatggttttaggtggggcctccgggaggtgattaggtcagaagggtggagccctcatgcatgagattagtgcccttagaaatgagaccccagagagctcattcatgccttccatcaagtgaggacacagccagaagatggctatgaaccagacagcagccctccccaggcacaaaatctgacacagcctggatcttggacttgtggcagaactgtgagaaaaaaatttctgttgtttagaagccacacaatctatgatgttctgtgatatctgcctgaatgaactaagacacgtatcgtatcatattatagcatactgttctgttctgttctatctaggtgataatacaaaagaaaattaaggttaagataaaattaaattaaatgcaattctgtcagctgctgtgaagatgagcaatggctgtgtaaatgcacctaaggaaaccactgtgttggggacgtagtggatgccgcactgaccgtgcagtgccaatagctctgctgccacaaacccacgggaccttggcttctgcacacacctctgtggggggctgagcatacgcagacggccttggtgacctgaaggcctggcagtcagaggctcgatgatgctttgtggttgatgcagcgcaactggagggattttgaagactgagccgacagacacactttcgcctgagacttaccagcactggagagtgcgggctgtgctagctcggtctcccccactgcgcggccattgcctgagacttcctttctttacccccataaaggctattgagcctgaaattatatcccgagcagtctcccagatgcagaataaaagtccttcttcccacagtatcttttagctttcaaaggtttaattcatagtaaaaaacggacttccacgagccatcgtgtggctaaacttttgggggcaaactttttacagtgaattactccacacataaaggaagagaagaaaaccataaataataagaagcaaagttaaccacactgattaccagaatgggcatgactccccaacaggtgtctttttattcttctatactcaagtattttttaaaagactgatatggttacttaactgacttccttaatagagaatctttgtcagaaaaatcttaagcccattactcttaactacttacactgcagaggtattaaagatgacaagtaatgaaaaaaatctatttcctcctttttgaatatctgtaattcaagaaatgcaactctggtaataaacacatagaggactccaccatacagaggcgggtgtatctgtaataaatcagatgcctgttaggtaagggtgatgtttatctgaaatgcaagagacagagtgagatcgtaccttacaaagggcttgagaaagacagaagtcaaagatggcttaaggaggagacattttcattttgtttgtcatcttatgcaattaaatgggaaatgaatcccttgaagagtaaacaccttaagtaccatgagcagggatgtagcttcttgctgaagaaatgcagggagtctgtcatctggtgaggatgcagctggcccagggaggcctggggaccccaggagttatcttgggataagcataggattctgaccttcaccacctccaaacaatacgcttttgagtaactttgctgccttgtgccttagtttcatcattcgtaaataaagatgatgatttataaaaatataataataataataacagtcctcccctcttaagagagggcaaaattgtgcttagaattttccttacttttttctcccctgggaatctgaaatcatccaaatgggaatcaaatgacataaatgaattagcatattatggaaatacaatctgttcaagctaccagattgatcggagctgagtttctgagtgactcagtgccttctaacgaagcatctcagcataagagaggaaaacaaataaagaggtgctgaaaataacattctggggtttgcagccaggcgggctaactccgaggaggttctatttcaagatgctgtcattgatacctgtctatgcgggtcactacacacagctctgcattcccagtgcctctgcagtgatcccatcttacaggacgtgctccactgcttacaggaaggacagagggggctttgacatgttggcaagctcggactgtgctgcctaggcccattccagcatctcctgactgccgtgggtgccatgagagtgacccaccacacagctgccaaaaacacacaccagcataaccatcagtgacttgacttgcttcaacagagagattctgctggaatgattttattttctcctttacaaacaactgaacacagcttatttccttccaggaagggaatgcatatctcctctaggctgagaaagttgacttgcagggaaaatgcttgaaaactagttaggcatgaaaacccaggtgcagtcctatcagaaaaatcatcattaccaagaaatatttcacgtaagcagctcattcgacactgcggagagcgcctaccgagacgaaggaattccacactgcaagccctcctgcagaagggcgcacctgtgttctccgtgcaggcaccggccatctttagtcatgaacatgatcacaggcctttcatattgtaactggaggtattacagctgaaccaagacatcattctttctaaccaggtggcatctaacttcctccccacatccctattcagcagaactaaataaaacctcaaccaggaaagtcctaacacagctccaaagccaagcagtctttgtggagaaaagggctgaaggtgaacacagcttacactttccaagcctttgcttgagccggcagcactctgcacactctaacaagggagagcctcacgtcggcaatgatgtggggtagttatctgttaatacaacctatcccactttcagcagggggacactgaggccaggagaggcaccccaagatgacacagctcgtggggttagagctggactcagctccagggtctggacttggtgttcctggcccctgtatcagggattctccatgttggcagtgccctagagacaccggcggaggtagctttcatcaattctcgcgctcagaccaaccaacttagagtctcccagaggggtccgaggcatcagcatcttgtgaaagtcccccaggccattccagcttgcagctgaggatgagaactactgctccatacaatacagcccatctcttaaggtgcatgaccaaccctgtttgatgaagatgaggcttggttcattcttggtctcacggttgggaacacgtttctttgcaacacattcttttaaatcaagttcccttacaatacaaagtggggatattaccctttggaattcattttatgtggaatgcattatatagaacggttacctgtaataactccatgttgagtcatgaatatggaagctttgtcaagttaaaggagtcgagcacatttaaggcatccttaagtactggggcgacaggcagcaccgccgggtcagagggagaggagcaaggttgcaagcgcaccccagcagtgtggccccctcagcagctgagcagatgacctccctcggaagtgacccaccccctctctaaaggaaggagacgggtgcccaacgctccaaacttgtttggagatcaaatggagccgtcggaagccattatcctccgaggtgagctggaaggaatcccactgacaaccctcacttccaggcacaggacaatcagccacggtttggagaaacaagctggagtttcaaaatgacttctgcaggtctcccgcctcctttcatttttctttttcaaaacatttgactattcacatgcctggcatcttccctggacggccgcctgggctttcggggttttgctgtcagcaggtggagagcatccctgcggctgttaccatgcgttccttctttctccttgacattcttcaggatgattaatgatctcacaaatcagggatattatgagggtggagaacgggttaggagatacttgaacaacttgggctaatggaacgcagaggtgttagagctgagacaaacttggaggtccctttgagtcaactctcttctttcacagatgaggaagaaacaagaaactaaggttttgggccagcaggtgtccttgcccaggctaagtgctagttagtaccagttagtgctagttagtgccaggcctcctctccacataactccgctgcatcatggttagatccagggacctaacctacttcgaagtatgcaaagtattatttgcaaagcttttctatttttctcttcagaaaatagattccaatgaaatttttgggaaaaaaaaatctactttttagtgatggatcattacggaaagccgaaacagtataagatgtaaaacaatgattagttttaaagctgacttttaaggaacacaaggaaacaaaaatgtttctattcttctatgtttatatggctttttttttttttttttttttttggacagggtcttgctctgtcacccaggctggagtgcagtggcacaatcacagctcactgaagccttgagatcttgggcttaagcaatcctcccacctcagcctcccaagtagctgggaatacaggtgtgcgccaccatacccagttaatttttgactttttaaatttttcgtagagatggggtcttaacatgttgcctaagtctcgaactcctgggctcaagcaatcttcccacctctgccccctaaagtgctgggattacaggtgtgactaccacatccagccacatggctcattttcatagcataaaaataattttagctactcaagcacattgttccaaaatattttaaaaataactttacattacaaaaaaattagagatatttcatttctgttgaaaacttgcagtaacagagtatagggaagaagacaacagctagccccaatcctgtaagtcagcccttcactttggcatgtttgcttctggcacaatgtccatctcatgtgtgtacacacaaatacacacacctcactactgctcaagtcactcttaaatttaacaataccatgattattctgtacacagagttttatgtccagcctattccacataaccatggatcaggagccgtttctcaaggacactgtggactggattataaacagccgtggatacttgcattagggagagtgaagtcatcgagatggagcgttctgcactttagctaagaggccaaggtcagccctgagggagtccaggcttagcgacaacttaaacagggtgcagcttcccgctcctccattccactgtattcctacagagcagagcaggcaggcacagattccagctgcattcccactttgcctccctttccttcagtggcgggggagggtgaggccaactttgaagggaaagaaggaaccgttacgcttgaaggagaaaaggagctcttccgggtcactcctggtgccctggagaggtgaacatggaaccgcctgatggacagtaggacagtgtgtggccaaggacaggctggagagcttcccgcatccacttgcctttgtcttaaaccacaggaagatgcctcatctgtgtttgagagcaaatctcaatgcctcgaggatgaaagagtgggttttaggaaaggaacgtattatctagcagctgttcattttaagaataacagctttttggagatataattcacattccatatgatttgcccatttaaagtgtacaattcaatggtttttaggatattcacagagttgtgtaccatcggtgggttttaaagattttaatcacccaaaagcagctccagacctgtctgcactcagttcccacctctctcaccccccagcctaggaaaccactcatctacttcctgtctctagggtctgcctctcctggacggtcatatgagtagaatcttaacccgtgcggcttggtgcctggctgttcccgctaagtacactcttcccaggcttcacccatgttggagtgggcaccagtactttattcctttctattgcccaatatcattccgttgaatagatagacactttatttttccatttcccagatagtggacatttgagctctttcccttttttggctactgtgaattggctggtgctgccatgaacattcctgtgctagtttctgtgtagacagctgtgttcatttctcttggtgaaccgcctaggagtggaccagtgaggtcgcatggtaatctctggtcaacctttcgagaaactgcaagaacagttcactgtgttggcattcagatgatcctgcactaacaaatgtctaatttaacttcctattttgaagagatagctgtaactgaagagacatagaccaatggaacagaacagagccctcagaaataataccacacatctacaaccatctgatctttgacaaacctgacaaaaacaagaaatggggaaaggattccctatttaataaatggtgctgggaaaactggctagccatatatagaaagctgaaactggatcccttccttacaccttatacaaaaattaattcaagatggattaaagacttaaatgttagacctaaaaccataaaaaccctagaagaaaacctaggcaataccattcaggacataggcatgggcaagaacttcatgtctaaaacaccaaaagcaatggcaacaaaagccaaaattaacaaatgggatctaattaaactaaagagcttccacacagcaaaagaaactaccatcagagtcaacaggcaacctacagaatgggagaaaagttttgcaatctccccatctgacaaagggctaatatccagaatctacaaagaacttaaacaaatttacaagaaaaaaatcaaacaaccccatcaaaaagtgggcaaaggatatgaacagacacctctcaaaagaatacatttatgcagccaaaagacacatgaaaaaatgctcatcatcactggccatcagagaaatgcaaatcaaaaccacaatgagataccatctcacagcagttagaatggtgatcattaaaaagtcaggaaacaacaggtgctggagaggatgtggagaaataggaacacttttacactgttggtgggactgtaaactagtttaaccattgtggaagacagtgtggcgattcctcaaggatctagaactagaaataccatttgacccagccatcccattactgggtatatacccaaaggattataaatcatgctgctataaagacacatgcacatgcatgtttattgtggcactattcaccatagcaaagacttggaaccaacccaaatgtccatcaatgatagactggattaagaaaatgtggcacatatacaccatggaatactatgcagccataaaaaaggatgagttcatatggtttgtagggacatggatgaagctggaagccatcattctgagcaaactattgcaaggacagaaaaccaaacaccacatgttttcactcataggtgggaattgaacaacgagaacccttggacacaggatggggaacatcacacactggggcctgtggtggggtggagggatgggggagggatagcattaggagatgtacctaatgtaaatgatgagttactgggtgcagcacaccagcatggcacatgtatacatatgtaacaaacctgcacgttgtgcacgtgtaccctagcacttaaagcattaaaaaaaaaagttcactctaaaaagcatgggttaaattacgttacaattgataacactgaactaaaaacttgagtgcctacaataaactagaatgtctcacctaagacttttgtgtacgtaagaattactgggacatcttgtttgaaaagtcatatatctaggccttgtttctacaagatgatgattcagtagatcaggagtggggccaggatctgtgtttgtaacagtcctctccccgcccccaaacacacagacaattctaatcaggtctaaccaaagtggtcaacttctgcattttcttaccattggttgtactgataaatgtcaaccagatttctctcccctatagaattttcaccagaagtcccacggaccttctaactcacttggaagagctcttttcctcctttgtatacttaagtggtttaaagtctgtacatatttggtctatgcattttttgtccttcttgttggtgacaggtccttcccaacatatatctcatttcctcagctagaaggcaagtgacctgaaggcagagaatgatatatttgtactgctcccctgcctgtagttgctggggacactgttgcaagacctaaaaattcaagtgccgccttcacatctcagagcctcatggggccccaaggcctctgcatgagctccctgctctgccaagtgtgcccccctcccagagagaaagtctccctaccctgcaggtttccccataagctggaccagctgcccccatccagcacccaccctaaaaggcttcagttccctgccagcccacagaatcattccaacaagccagccacaccttctgcaggaaccaggggccacgtgaccctcccgttcctaggaagcctgcctctcaccgtctcggcacctaagtgctgcccccgtgacgccctgtgtggcacggggtgccctcctccccagggggtcagtttatgtaactaataagctgctgtcagttcatctgtccagtgcccggcgctgtgtgttcaatcgcctaatgctgtttagggcagggggaagttccctctctcaccaacacagtgaataggaggtgatcagaacagatacggtaggtgcccagctagtgacgggcttaaagactgtgagcctggaacggagattttggatcacattctgactctaacgctgcactaggggctcatccctcacttgcaggatgggcgtgcagaggagctgggcagaaatcggtatttctaatgcccagtcactgggtcaacaaaggaaaacaacccaacccaaccatgagtcacgttgtatttaaaaccgagtgaggccgtcggcctgccggtatcgaggctggtttgtcaggccccatccagcccaacagcctgctcgcagcctgctgctctgctttcccaatgccgctccacggcagaacatatgtgggagaatggtatttacgcaatacagctcttctctgacaattgtggaaactctgcagggatattttaaatattcatggaaatgtttatactgtttattatcaatcagagagtaatgtgctcatttagagacattttcagaaatcgtgaacattaaatggaatgaatatttcctcaaataacggagtagaaattgcagttacctgtctctgaagcagccggcccttccgaagctcttaccttttagggtggctttcttaaggaccttcatggcgtagagctgcccagcgtcggaccccttcaccttcctcaccaggaacaccttagcaagagaaaacggaacatcagaaacccgtaagacttcaaactcgctttccatattggatttgacaaggggatacacaaggaagtttagagcattttcaataaaacaagtacactggtgagaatttaaaattttctccaacgtcaaggctgccggaaaatgctctaagttcctatagctctgcggcgaacatcactatgtgcctgtatgaagaagcgtcatttgtttttggtatcattaactttgcattttatgccagaaataataccgccccttgttttgaagaccagctgtttagaaaaacaaacaggagttttaagggagatcctttggtttgagtatccctctgtaaatccttactgagagaccacgctgaaaggtattaccaatcacacaaaacaggctctatccgattttcaagaaaagctactttctcttacttcaactgtcttcacccaaattttagctgtgagtagcttaagagttcctttctaactggatcttaaatacacttacggatatttggcaatgctttctgaaatacattttgatgtgtatcactgagaaaaacaacaaaaaaaggtaattgagagcttgagtttaaatttgtattagtgattttttaacaaacttagtaaacaaaactggagttcctttgtataaaaaaaaaaacttccatgcaaattaagaaaatagtacttgattttcctaaaagtgttttccaatagatgcaaatatctgcttgcatgatggagatgacacaggcacacggtgcactggtgtggctgcccatgcagtatggctggagggccgaggtagggtggctccttcccaaaacgtctcctttactaagcctcaaaaagccagaaagaccagccactatagatgttctagttccatggaaactccaggtggcccaagtgagcatccgtgtggagcagcagcctcacctgccatgggcagagggacatggctgggacctttgcactcttggctcccccccaagactggaggggcaacgtctagacacttaccgagtgcaggggctctaggagcaggggctgctagggcagcccaactggagggagaccaaccagcgtctattctagaggcacaaataaagagggaccgggaagacgcaaggtcccagcacaggcatgtggattcacggagttgctgtatcagtgtcacgctctcaccatgtgcccctgaagtgattccggaccccactgctgccctgccatctgtcccgatcactgtcattattgaatcacagcccctccccaggtggggactcttctagatgacgcccatgggaaagcaccccagcacccctacccggggtgcaggacggtacagcatcatcctgtgtgatgaaatgctgcctctcggacccgattaggtcccaagaagtcacaggcaattagaaagaggcttccctcttcccctgggttatagactataccatcaccgacagttaatattcatctctgggagatgtgtggagtgtgagagagagagagagagagtgtgtgtgtgtgtgtgtgtgtccccaaagctggataaacaagcttgtggtgaagccctggggcgatagctggggcatcacccttacgcacactgtggtgggagacacaggcacaagcccttctccgggctcaggatcccatggctcttgctggcagacccactgtagccctggaagttactgcacatggaaggactctgcctcagggtgttccctctgtgcagtgggcgagcttcctgacaggcaggtagagatgtgaaggcagtggtctgaggacaggatttttacagagagaaaaacattagtgcttaactcttgagatcttctgctttgaatcacgggaaagtcacatgccatgcacagttttagcttccatctgatgcaactcctttcatttctccagcccgtccgtgtgcctaatgtccctaggttgacttgatgagtggtgctgtggagatcaggaccagccaggacagtgcagggaggaggcaggcgcagcccaggagtccaggagctgggcaaggctgcgtgagcgtcccggtgccggagaggccgcactggcagagaggaacctgggtcccaaaaaagtcggagggggtgtggaacaagggacagttgtgtttgtggcagggacgccacatttccccggcatcctgcaggtaagttgggcagtgacaccagcaagggcaggggtgtgccttcctggcctaggcaatgaagagcaggtgcaaaacgttccagctgccactccctgctgtggcaactgaggacacctggtgcaggacaaaccgggcagcctggtcactgagtcactgtgtggaggatggaagccttgggtggttgctccagcccatggtggactttggtagggtgacagatgaatctatccattccattgcggcgaagctgacatgttagctcccaaaataaggcattcttataatcagaaaacaaagggccaggttcagtggctcacacctgtaatccagcacattgggaggctgagacagaaggatctcttgaggccaagaatttgcaaccagcctgggcagcatagcaaaaccccaggtctagtaaaaataaaaataaaaattagggctgggtgcggtggctcacgcctgtaatcccagcactttgggaggccgaggcgggcggatcacgaggtcaggagattgagaccattctggttaacatggtgaaactccgtctctactaaaaatacaaaaaattagccaggcgctgtggcaggcgcctgtagtctcagctactcgagaggctgaggcaggagaatggtgtgaacccgggaggcggagcttgcagtgagccgagattcagccactgcagtccggcctgggcgaaacagcgagactctgtctcaaaaaaaaaaaaaaaaaaaaaaaaagaaagaaaaaacaaaaattagttgagtgtggtggttggtggtgcgtgcctgtaggcccagctatccgggaggctgaggcaggaggatcgcttgagcccaggagtttgcaaacaacaagctccctctttcaaaatgggaggaccctgaagaaaaaggaagcaaggtacatgacggatttgtgtttggacggtgcagccttcacaatatcctgagtgggtccgtactttcaatacctctgcactcaacccctaacccataagaagtacgaccgtataaactcaaagagcagaggaagccccattccactcaagtctgaactggagaccaagtccacatggggcagctgccagttaagatttggtttaaatgatgtcaagttttgcataggtcttgacacatgaaacttttctctctcgtatgttaggccttaaagatgagatgactgatggtcgtggctaatgttcatacttatctgttttgaagagagaaccatacttttgctttttaaaagaatggaaaaaactccatcctaccaatgtctgccaagcttctctgtggggccaggtactgcgaattcctgcagcaggtgctgcctgactcgcaagcacaggacccagtggaggggaacggcaccttgagacgagcagcaaaatacagcaaaaatgcaaaaatgattttggtaacgagtgtggcaacttgctggtctgcgacagggatcttgacccttgggtgccgtgcagttccctctccctctctgctgtcattcttgtcactgaagatcaattttaatgtagtggaataagctccaaaacaacactgtaacctcgagctaacgcaggcactgtgtctttaatactcaacccagtgggcgctgtgtgtgccccctcatttcatttttagaactgcctctccagcagcttggcgtgctgcattgcaaagatgctgtgagaaccgcgacctggcaacaggtgcgatgtcactctgaactgcctcatgatgtcatggatcaccgtgatctgctgattctctcagcagaattctcagctctctctcagaactggagggtttctattgggctgcaaaatccttcaagcaggagctaaatgcccatgtgcacttccagggacttttgagtaacagccacccccaaaaggaagacatttaaagacatgttcttatcatgctaccagcaaagtcagagaaagcaaggatttttaaaaaactttggtttggttcctttttcgaatgcaggaatcataacctacagttcattctccagaatattttaaaggaaaagaggtttcctatcctactcctggcacttatgcgaataggggagctccaggagcaggtgaggaggtgggaccagggcaaagccactttcccagccccggggtggttcccacacctccctcctctaagctcgcagggaacactgggtctgcacccctcctttcaacactgaacaagcttcaccatctttcattgctttcctgattcaagctttaaattgcttttcattttgaggataaggctgttttctgtgcttttctctggtcccaagcaccacccatggccctgctctctagatagcgatgaaatcatgatggcttcgccttgcaggactgagctcagagctcatagacgcttcccgctggtggtgagtgcagcttctcccacaggaacaagcttattccggctgaccaggtgaagagcagcggcttcggagagcctaagcggctcacacaggcaggcaatgggacaagtcactcggatggctcctggtgcagtctgaggtcaggagctggcaccagtgcaaaaagtctaaagggaagaaactgcatgtcatccatttctgcatctccaatgtcatcattaaataagagagaaagaatggagtggctcagtgacaggcaactatgagccctgttgaaggactcggctcccaggcaaggcctgtcccgggacactgcgtccagattcacaccaggtctttgctctttggagcggaggcaggaggtggaaacctgaagaacaggtgctttctgcagaatgagaacattcagtgttgtccttctgtccctggtaggtgcaaaagggaagatgactcttgcataaggttgtgttatttgcatgtagagaggaggaatacagtaacgtggggcattagaacacacggcttctccccctcgtcatcagttttgcttaaattaaaaaaactcaccacaaacaaacctatgtggacaaatacaatttgtatctgtgactctctagtgacgatattagctccaaccttccctggaaatgtctgagcaacgcttttgagaatagtatctcttctttccagagtccagctcgcattaatccacgaagcggacctaagcctcccttcccacgccagccccagcctggacctcctgccccgcccctcacaccagctctggacaggcattactggagctggcccattccgtaatccctggaggtcagacacccatgggcgctgccactgcctcatccttctctttcccctacctactactgttcttgaaactttacgttttaattcctcatataataaagacacaagtaaagataaaattagaagtggtgaaaggctgggaaggaaagggacagagtgttatgagcattatcattccaacgggattctgccaaacaccatgatttcacttgttttccaaaacatgtttttttaaagcaaaattaaaattcaaaatttgaaatctgaacgagggagctggaaaagcctttctcctttcatctttaataccccagttctgtgaggaggacattggtaagattcactctgtaacagaattggtcaaccaaagccctccagacacttcctgggcctccgccatgggatgtattccagcgctccttccctccagataaagacgattcggctgattctgtgcttccacaggtggaatctgttctcaagaaacaatgcatgggcaacacccttgaaaggtggaaaaaggaaagaatgcttgcttgtctctgttttcaaatcatggagaaaattattctcctctctcttttttctctacatttctaattaatagtgaggcattccactgtcacattacgcaggctctgccttctgtgattttgtgctttttggtaatggctattaacatcgtgagaaactgaaatcttcatccccctatttcataaacaccatatcaactagccatattaaatagacatttttgtaggcccaaaatattgctggtaatttcctatggtttaatctaacgtataaaaattttacaaacaatccagttcatgcggactgtaggattatccagaacaccgatgtactattcattccatccagttcatgcggactgtaggattatccagaacactaatgtactattcattctacacttaaattaacagcagccacatgcattttggcacaaagtcatgtgaagaatgcaaagatttggtaaatgtctacataccacacaaaaatagttactttaaagagccaggctgttctgcttacatgtaaggaacggttggcttcatggtttatttcaggcccttatgttctagaaatcaagttgtcagagcctatatatttctaacagctaacccaaggaggcagagaaatcagcattgtgctggagtaagtcacgtgtcatcataattgaaaagcgttattgacatcttgttgtatgtggacgtggcattaaatgaagagccaactatttctcatttcctgaaagaaattagcttttattgctgcaatttgaaggtgacaaaaaagggaaatgaacaattccactgcacaaatacatcttaggcacctgctgggtgggattcgtgccctatttactccatggaacaactgtataaagtaggttttatcctttccatttagtgggtggggaagctgaggcttcatgaggcaatcgtgcagggtgaggaggggagccggctgcagaccctagccttcctggctcctgtgcccaatccagaggaatggattcttttcttttctttattctttttttccttgttctcttatttttttctttctttggggaaaacagctgctagaatgcactttcaaagatacattggctcaggtcaataaccttcctcaccttggtgatgatttaccaagagccaagggaggctctagagagaaggcaaaagtgcatgtgacggctccaacggcattttgttctcacctggcacagcccagccctgtgccactggaattctggctgtgcaaagtgagaccccggttctgaactgtccaggttcccgtgatcgcagccctgcaggtgaggaccgcctgcaattttcatccaggggggctctgtccaggtgtcctttgtgttcaggaatgagactcaagagacagccagggctgaacttacctttccataggatccttgtcctaaaaccttcagcagctcaaactgggaaggatctgccttctcaaagccctccttcacatgatggctgatgtctatctccttcacgacgccttcttcctgcaagagagcggcacgggtgagaaacacaccgcgaggagtccctcagagccgctcacagcttcctcctcccctgagtttaccacgagctgggtctgttacagattttagcgctggagtttgaaagtggagacaccatttagttgtgtttttttcttttttttttcttaagacggagtctcactctgtctcccaggctggagtgcagtggctggatctcggctcactgcaacctccacctcccaggttcaagtgattctcttgcctcagcctcctgccaccatgcccacctaatttttgtatttttgtatttttaatagagacgagatttcaccatgttggccaggatggtctcgatctcctgacctcgcgatccacctgcctcggcctcccaaagtgctggggttacaggcgtgagccaccccgcccggcccatttagttttatggaatcaacttggtgatgtgtgtggttattgtgtgcaccctgtgggccttcatggtttcttttctccatggacttttgtcatttggtcttaccaaggcctccgaaaaatctaagggtactctcaatgaaatccattctgctctttaacagtctgggcagaagttctggtacgatgaatatagcaactatggaacaaaatgacagcaaaagcatattgacgggttcctagatggagaagtggtctggaaaatgcagacggcttgtcctccttctccttctgattcacgctatccctggtatgtttgtcaaagctaatgtaaagaacacgtcattgccatcctatagattatatttcagaagaagcagtcaggtaagatttgccaccagcccagaaagcaagatttccctgtaggagaaagagtctataagtgaaaacactgacagaaaacactacaaattttcatcccagagcttcctgtccccagagtcacatgacttcccttgtaaaggggtaggccatctgcccaagtgccaggccctggaaatggaacactggaaaggaggtgtttctcccaacatgagacattcgagcccaactgttccttgaatttatctctgcatttctctgagatttctgttccactatctatacattcgtacacccctttctacagttttagctcggggtgaggggctgaaaaacttcagaaactgctggctaaaatgcgcatccaaaaacagcaaccaggaattgtatgcatagtgtgctctgggaaccaggggcctctcattcctcattgcttcttttcatgaagaaactgtgaagtggagattttctcctgagactcagattacacattaatagctggaagtgatagaggtgggcttctcatcaaggactgacttcgaagccaagtacttccaccctctgttttactctaagagtgaagacttccaaatgaaatcacaatagcaataacgtacatgacgatgtttgaaaaattcagtttctcaaaacggttacttataaatcttgctattttacctccatgtcacaaatagaggcacatgtaaaagcagataaggtgtctgagccgtggaaactcacagcggattagaggcctatgcagttatccatggcttttccattctcagttaaaggaaacactttcgtctccatatcttcaaggatgatttgctatttttgtaaaaacagtggtttttttttgtttgtttgggaaaacaatgagtatagccaaaattgactctgtttaatccatcctgaagttcatatgagtgcagttggaagatacagaattacaattttgttgcttcataattacttcttgaatgagtaagtaaaaatgctagaggcacagcccagccaatgggcattatatttagatgctaatttgtgaggggacatcacattttaagcccttcctcccttcacagcacaggcttactagaattgcaggaccatgctagccacccgagactgtgcagcttttgtggtgaaatctcctggtttatggaaagggacagaaaaaaatgaggccctcagggatccacgtgtgtcactgcctgtgagaaccactaccttccacgcggctgctggaggtggcttcctgcacaaaaaacaaaggcaggagcccaagttcaaaaaaattcatcatggaaacatgtatgctatcttttcccgtcattgacctacgaaaggaagaaagaaattgcagacgatttgtcatttaaagaacaacaaaatactcctcttctgttactaaaacactgtcctcgcaatgggtccattaacatcctctacctacaggactagcacgcgcatgagtcatccaaaccccagcctccctcccaaaatagctcccatcatgcagctgtgttaatgcgacgcccacactatgaaaaaaggaatcaccaccaaagcacacccttctgtgacttcattttggtaacgagagcatggcaacggccacactgcagaacagaaagtaaaattcaacaccgcccagaggtgtggggcaggcgaggcacgagctggccagggaggcttcacactgcagccaccaccctttcctggggcacgtttcccagcccttgtgtatgtttcctaaagatttccagttccttcctttttcttcagcagctctttgtggagggtctgagacccacagctgtggtgaatgagctcatgcagtcccatgggtcctggtccccttcactgcctttgtgggacatgcctttgtgggactaggctctgaagcgagagtgacagcatccgggctacttggatgccacctggccatggacgctggcacctcagaattcccatgggtgttcccctgctcccagtcagcccgttttttaggctggcttcacgccttcctcagcacttccaaattgccatcccctgttgcctcccgcctccccggtccatgccacacccccacctccgttgcagaagttcaccttctttagtcatttctgtaacgtttcgaatcaaagccttcgacgcagatatctcataacatttcaaattttgtgcagattctttctgtcaaagtattgagagcaaatgtacctgaagtacacacataatttcatctcctaaaatgacatgaaaaacgccagctttcttccctaataatattgcgatagagttcacttctcatttcaaatcagtaaggtttttaaccgcaaagcatctgaggcgtcaatggaaaaaaatccccaagagcatcacctttcagacttcagagttctgccttcacagtgacattttagcttgaacttgctggaggatgcttaactttctttttcactttccccaaaacgaaaacaaaacaaaacaaacaaagatctggtgttccatggactcggcgcgcactctggggtctgtgtgaataggaaacagccagatgaagccccagcaccatactcccgggcactgctgataacgaccctctctggacagccctggtttctggatcccttcatgacaaccaccctaaggggcaactagcatgaaaatgttactcacatttcattttgaaatatgtgccttttctgttttatgaagcaggtaattttatctagagcttgatgaggatttgcatgcaatgccttaggaagatcaagtctgttcctgaatcggctgcatccatggcaggagcatgtggtttccagcacagctactgtaaacagtatttttaaagctaacttgagagctttgggaggaggagctgggacggtgatcaggtgctagctccataagcaacaattccaaacattttgtaacgtaagaaagaaaaactagaggtataaactgtttaaatgatgtttgaatgtgacaaattgtgacaaggaatttttaaaattcctgcagaactgcactcaaaattccaatgactgcaggaagtcccgggcaggtatttcagcagctgctgggagcggctgggaagtgggagtgacagggagaaagatgagggcggttggccactggctctgcatgcctctctctgggccaaagtcgccttcttaggtcatttcctctgctctgaatcacctgctcttcatgtcattaaagggataatatttataaaaagtgcaaattaaaagttgtggaatattaatgataaggacataggaaacaaaataggcaagggttcacctcatttccaaaaaaggagagaggtcattctataaatcgcagattcacatgtaggatattaatttccagaataataacagaatatattattacacaggtggtttatgaaaatgtggaaaagaacgtatctccaactcacaggtcccatcaagccagcactgttctgctgctgacggcatgaactcatgagcaggtggacaagagcctggctttgagggcagctttggtggagtccctcctgaatcccaggtgacaaagaggctggcatcatataaacgcttaatgacagagtaccacatcgcaagtcattctctcaaggcacagaacccggacacacctgcccaggaacagtatcgtgtcctggaggttctgaacgtatgaatgttctatgttgcccacctgcttcagaatcaccccaaggaacttgttaaaatgcagattccaggccctgggcaaggccttcttggtctggaatctctaaacttggcttcgtctagaatctgactttcattatctcaccaaaggtgcccttctcaagccatccaaatcttacccattgctaaatcgagtggctaaatttccatcctccatagcactgggcatggctattcactccctctcacttgaaacactctcttcacctggattccagtacatcctactcccctgggttcgctcccacctccccctctttctgtgtctgccaaggtcacctttcccctgggcacagtccctggccttttgtctccatgtagttacccccttggaacctcgtcctgtctccgggctttataaaccatgtgaataaacactgacaactctcaaatctcaatctccagcaggggctgctcccagaggtccagttctagaggcccatccatcacaggcaactgtcctgagtgtgtgcacgtgtgtgtgcgcatgtgtacatgtggaatgcacatacgtgagtgtgtgtgagacaggtcttgttctggctttttctcacattgggatggagctccttaaagtcccagctttatgcaggaagtggggcaagaggtctgcctggggccagccctgggatttgtcaccagttcccctgccctgtgaggctgtaaacagccaagctcaaattcaccaggttgtcacctggcctccaggagaaagctggctttaactgtctccttccttgggttccctgctctaacacagggtttggcctctgcgtattccttactccccagctcactcacacttttaaacattcttaaagggatacttgatccaggactttcggttgtatttcacatgagggctagccacatgtagtctaccacgccgctagaatggaagctcaggaatgcttttaaagggagagaagattcactaaatggctttttagcctcttccggaaaagaaagacagccgcagacttgctgagaagagtagaggggagtctgtgcaggaacagcccccggagagcgagctccatctgcggcacgactcctgatagctcgtgggtcctcggcctttggttaccaggaaagctggctgcaccagtgaacacatgccacccatgacaaaaatcctccagtaggccgtttttgtaattactaaaacgaaataaaaataactagacatttgaaccaaagactcttaagaaccagaaggaacctcccatgtagcaggttgggcatcttactattcaagggacgagaattcagatcatctgaggcccaggacccatgctcctggcaaagctgcttccattccaaccagggcctaggacgtttagagtggtaacggctcgcgaactctggggccttctctgccctttaaactgccctttctgcatctccgcaaatgtgtctgcttttgctggtgtgagcaaatgtgaaatgaaatgatgggaccagctgcatttgtccaatcaattccttaggaaaccatttctacaacaagtttcccttccatttctaaaaagctaaatataagtgagccatttagtacagcagaacgagtaccctcaagaatggaaatcaggctggtgacatgggcgcttgctggaatctaggtgaaacaaagatggcttaatttaagatgaataaatctgctacaaaatcataggaggaagggaagcaggagaaggaaagagaaaggaaaataccgggtgccatgtcaagatcgcagatagaagctctgaaatttcaggagtgtgagcctatctacttgatagagggctgctcagcgagacaaggtctccatttcaaccctggtcattttcagagtttgaactgcatctattcgatacaatgctcaaatggatgccgcagaatccgcggagggaaagcaatgtgcaggaacagggctgggctctgttttctcatccatcctagaatatcactttttctttttctgaccaatgaaagtgatttagcttccaagagtggtcactgcagtcaccgcatgcacagtgacaatctaggagtgggctggctgctcgggctcctttcctctttggggagaagtctccgttaagctactcactgaagctcctcggaactgaggctgggctaatgtaaggttcctagaacacagcagcactgagtggacagagactatgggaagaaaggaggagaagcagcaaaaccagccttggcatttctctccttttttttctctttctatccaaacttgcctttctgcctccccaccccgtccctgttcattttagtgactgaggagagaggaacctcccaaggatgtttcctctctggttttaattaagccctgccacttcgccactgtttctgccttcgccttcattgcctgttgttcccgtggattattttctcttcccttcttctcagccctcagtctgctggtatttttataaatcacagtcaaggcaaattggactctgaaagttgtgcttataaacggtgactgacagatggagcgccgccacttttgcaggggcctccttcccacagaaaagacgtgcaaagagtggagagccagggcttcctgcacacacatgggctcccagtcctgacatcggccattctgtcggtgtgctcattctgataaatcctccaatccttaacctccctgggaaacgtcagtgtgaagtcctcacggaagcctggggtgttggtgtctgacacggtgttttaggtatggctccgtgaccccttccacttcatcttgaaaattatcttcaatgatttgctttataaagactcattactagcatcggggaatgagacggtagctactgactgacatgagtgtattaagatgcacaggaacgatctccgagaagcctcacactcggggcaggtggaacacgaatgcagattaggtcaagccacagtgtttcctcgtggaacagctttagatgggaccatttccggtctgggcagtgggatgagtgcccaaaggggctgaatacatctgtattatttagcacaactttaaaataacgccaggtaaaaacccggtgacagtgataccaggacgcatgcctggtgtgcacccaatgggacattatttatgctagtgtgtcaccctgactgggaaaactttttttttttttttgtctctgagatatatagtatgaaactgcactaagagatgagagaaaactgataacacgggatttaaaatcacaagtggaaaaacctacatcatcataaactacatcatcagtataaccaagaaaactacagtcatatcccagtgagacctattgggataaatttcctatttctttagcagaaaagggaaaatagaaattctacaactatcatcttctcccagactcaattatcgatgtgtccaatgtgatctcctcattctttttcaaaagcaacatattggtgaatgtttggtcaatacctctaccagaataagttgatggctgcgatgtttccattaagaagaataaaaaatgctgagtcaactaggatgtaaagaaaacgcacatcccaagagtgcccagctgttgggaacgctgagctggtgggctcttctcacacaaagttagtttcttttcttttttttctttgagacagggtcttactttgtcacccagactggagtgcagtggcatgatcttggctcactgcagcctcgacctcctgggctcaagcgatccttccacctcagccctgcaagtagacaaaattagtttctatttcaagtgtactgagcaaaatcgcaaggctatattgatcagaccgttcagatacccagcagagggacgcttgctggggtaagagaggccggtgacgtgcgtcctcctctccagcagctgaaatgggagtgtgcacggggccaactcactctacaatgctgcaacaccaccgacttagaggaaggaaggcagtttgggctctgcaaggaaaggctgcttaagtaatggatttttaaaaaatggtccaccaaatccatggcaatcagtatcacagctgatggggtgatggggaaagtctcatccccaaaatggttctgaaaggtcggcagctgagttggcagctgagtgcccgctctccggcagtggtgctggtgcccaactggtcatgcacggtgtttgtgatctggatgagagctggcagagcaaaactgttaggctgcagatcaggatgaattattcaaattgataacatcttagcaaatggagaggatgtgctagaagatcagaagaggccattccggcaggcagagtgatggcggcagccgcttaacccatggcacgtgtgcagcacgaggtcatgttttcaaaaaaacagtaattgtgccttatatggaactttatattaattgtgatagagagtagtcagctgcaatgcaggaaaggatggaaagagtaactgagtccgtgttttagaaaaagaaataccactgtgagtggaaacgcacctgccctatggggcagactggcgggccctgaacagaaagcctgcttctattctgtacaaattccatggtcgaccaataggcataacgtgcacaccttctgacccagggacctcactcctcagaattcatcaaaaacatttacacatagaaagctgtaacattatttataacagtgaagaaataagaaacaattgaaacgtccagcaagtggggaagaataaggaaaatgatgatctatccaccaaatgaaagtttacgtaggctttcagagtgattgcgctttttcccattactccaaaaagatgaaatacttacatataaagtaacaaaacaagtatagtatctgtgtgtcaaaaattacggaacatattattggaagaaatcaaagatctaaataaatggagagacatgtcatgttgacagctcagaagagccaacatggtaaagatgttaagtgttcacaaatgcacctgtaggtataatctcccatcaaaatctgagcaagcatttttttaagtatagagaagtttattctaaaatttcatggaaaagcaaaagacctgtaatacccaattttgaaaaaacactaaagtgggaggaatcactctacagatggtaaggtttgctacatagctacagtaatcaagatggtgtgctattggtgaaggggtagacacacagatcaatggaatggaatagaggacccaggaatagaagcattcaaatacacccagctgcttttggaaaagcaattcaatagaggaaaggcagcctttttgacgaatgatgctggagcactggactttcataggcaaagaaaaaaagacatttaacctaaattccatctcttatacaataattaactgaaaatggatcacagacataaatataaaacataaactacaaaacttctagaagaaaacataggggaaaattgtccaaacttagggctagggaaaaattcttagacatgacacccaaaccatgattcatcaaagaaaaaagtgataaatcaaacttcatcaaaatttaaagcttttgctttgcaaagactctgtgaaggagatgaaaagacaagctatagagtgggagaaaatgtttaaaccacacatccaacaaaggttctgcatccataatgtataaggaattctccaaagtcaatagtaaaacaaaacaatccattagaaaatgggggagacaagcagatatttcaccactgaagatacacagatgacaaataagcacatgagaatatactcaatatcattagtcatcagagaagtggagagccgcaataaagtatcagtacatacccatcagaattgctaaaataaaaaaatagtgataaacatcaaacatcggtgaggatgcagagaaactggaccttgtacgttgctggtgtaaatataaaatgttccagccattgtagaaaacagtctggccagtgtcttacaaaacaaaacatcccagcaaacgtattccagggcatttatctcagagaaatgaaaactaagctcacacaaaaacctgtactcaaatgttcatagcagctttatttgtgatgcaaaaactcgaacagcccaaatggtcttcaatgaatgaatggttcaacaagctgcagtacatcacatcatggaatactatacacaaatgcaaaggaacaaactactgttagtcacaagttgtatggatctccagaaaattacgctcagtgaaaaaaagcaaatctcaaaggattatacaatgtatgattccatttacatattttttgaaatgcaaaattatagaggtgaacagtttagtggttgccagaggtgagggatggttggtgttgggggggtgtgtgtgtccataaaagggtaccatgggggatatctgtggcgatgggacagttctgtatcttcatcaggatggtattgccacagattacacatgtgatatatttgcagagaactcatatacacacacacgagtacacgtaaaactggtaaaatacgaataaggtctgttgattgtaccaaatgtgaaattcctcgttttcatactgccctgtggttgtacaaggtggagcccggctgaagcacaaaggacctctgccacgtgttttgcagcttcctgtgactctataatcatttaaaaattttaaaaatggtaaaaagtgatttttaagtctatttgccaatattgaaagagctttgttataagatttaaagaaagcagaaaaataaacgtcatgtatatgatgattaccgtgacatttttacaaggtaggaaaaatatttatggaaaatacgtcaagatattagaagtgatagtattagaaaatataaatgattaattttctcccctttgttttctgaatttcctatacagaaatagaaaactggccaagtttctatacaaggacatttaaaatgataaactatgcgacattccctctgtttactcactgctatcctattcagctgcactgaactataatggaaagttcaggcaaaattaactgtgagttttcaaaagcaaataagatcaaacaacttgctgcaagggaaaaaaaaatggaagccaatggaaaacaatttggatatcatttctggatcaaagaataaacctattaattggtaaaaaaaaagaaggactcaatatttttaaagctattaacattttttatactcaacacacagattcctcccgtgcatgaacatggaatgtccaatcagggtacagatggcgaacatggacgcctgcaatatggacggcaacatgcacttcccagcactgcgggcagtcagggaggcagttcacagattttttcctgggaggtgggtgtctctaggggtgggtggcaacaatttactggaaactgacaaacaaaagaacttgttttaaagtgaaattagggttgggcgcgatggctcacgcctgtaatcccagcactttgggaggccaaggcggtcagatcacaaggtcaggagatcgacaccatcctggctaacacggtgaaaccccgtctctactaaaatacaaaaaattagccaggcgtggtggcgggcgcctgtagtcccagctactcgggaggctgaggcagcggaatcgcttgaacctgggaggcggaggttgcagtgagccgagatcacgacactccagcctggcaacagagccggactctatctcaaaaaaaaaaaaaaaaagaacgtgaaattaggtactactctctgtaacactaattagataactgagttaagtgtgatacatttatttcttttacattaagtagttttctagacataaatatgaagggttcaatttttttttctttcaaagtccttaggattaactcaagcaaaaccagcgaccatctcttttgtaatgtatgtgtgtgttggactgatgctcccctaatctttgaaggaaggttcaatgtgaatggtattctccaatgcataaatgagataattggggcaatggaagagaactacttctgcaatactctctggtcctaactactttttcagtttcctgctaaaagtagatcattccggatctccttgagagaggatttccaatgtggccagtggagtttcagaagacatgtggcatgtggcagcccctgctctgtgtgctatttcctatcctgacgattcttacgaatggaagccctacgaaaaacaatcaacactccagaattaggtttcaatgatgtcagaggtaacgtgcagatcatcatttagcagtttccaaaactgttgaaaagatgaaacttttggacaaaaacctcattcaaaggagttcattaaatagccatccttctttcttttctttttaaactaacctagttattgcattctaaaagattatgaagcattttgttaaaaaaaaaattagatatggtgcaaagtttagaaacggcctcaccagcccaccaggcacctgatcaccctccatccctgagcctgcagaatggtgagagcaagaaggacttggcacagaacaataacttgaatggaattaagctgactgctgaaatgcaaacatgcggtaggctttgccaatatgagctacaaattacggatttccgaacagtcttgggcacagatagggtatttcaagtgaggcgacaaactgaagtcgttgacacagcacaatgcccttgcagaccgccttccgacacagcttaattctatcagcgtttccattgtcattcgcaagcagcacagactgacaggctgaagacccacacctagtggatttcacccgcctagagatccttgttacccagtgctgctccaaagcagctccctgaccccatgaacacttacaggggaactcaggggctgtgcatggattaaatacagtctcaattctcaatttcacaggtctttgaccccccacaggacaggccacattttgtactaatgcctgcttatcccctcctacctcgcaaagcgtctggcaccatccttcctcagtctttgttcaaggaatcgatgaaaacttgtgaaatggtttagagcggtgcttggcggtccccaggaggccctgctcaaatgccaggctgcagaatcacccagtggcatggcctcacccacatgatgacagccaatccctctgtgtggcgaaagatgtgggcttgagaactttctacactccagaagccattactggcacaatatataagtgttcaagatcaaaagaaattgtattataaaagttttttttttaaatctaccctagcttgaggtttggtaaaatgccttggccacatcccccaactgcaggtgtcctgttctgcatctggaccacacgccttgcctgggagagacttcagtgatggaggagacaatcccaaaaggtttctgaagctctcacagtcacatgccaaaaagtccactatttattttagaaaaaaggatttggaaacttggttaggaaacccatgcatcgaggatgctatttccgaattgctaagtaaaaagtttatcatttcctatgcacaaaaacgaccagctctttttcagtggcatagcagggatgggccgataaccacgctggtccctggaggctaatgtgggctgtatcctggcaatggccacaggtgtgcaatggctctctacggattctgcagtctagctttgacattgatctactaggttttagtaacagcttgacatctgaatggtttattatcattagcatatgaacacacacttatataatattgctgaatgtaaaattctcaaggtaggctcaactcaaaccctggaggcagcatgtgtcttagccacttactcatttttggtttttgtttttatttttgaaacagggtctcactctgttgcctgggctggagtgcagtggtgcaaacacccctcgctgcatctttgacctccctgggctcaagagatcccccaccacagcctcccgagtagctggggcaacaggtaagtgacaccatgcccggctaattttctttgtatttttttgtagagatggtggtctcactatgttgcccaggcaggtctcaaactcctgagctcaagcagtctgcccaccacggactcccaaaatgctggggttataggtgtgagccaccatgcccagcctccacttactcatgtttagtcccacttttttttttttttccttaaactccttaatgcaagaaaatgcttgggaaagaaacaggagtcatttaaaaaaaaaaaaaaaggcacccactcgtggtgttcccaagtagcaaactgactgggcagagtgggaaggactcagagacaactcactgacccgccccgccagccctctttctctgctggctctgacgtgggccagtcagccctgactcaatgctcacatattatcacacgtgcggctcatcccattgttagaggataccattgctgagccaaacacagggcactgctttaaacagacttggctaatttctgcacccattacaagctgatacgttaaaaaaagaaagccagcctactatcatctgttttcaaatgtttccaaattgctcttctttctcagaatgacagctttggaacattagcgcaaatccccaccgagatttgcatccgtattcttggatcttattcagaacttagccctgctgaaaaatacacagttaggtcaaagtctgttcatgggaaactagtatgcgtatttcagaaggagctctcacctacaggctaccccgaggcagtggctggaaactgcaccaaaccctgtgtgtgtatctgtctatctgtctgtccaggcaagaacatttggaattttctagtgcagttcttggtgctgccatcactgaagcaactgatgcagttcgtaagttcagctttctgctacttcttcccacagagtgacatatttttcttattagacttagagcttttcaaataatgatgacctgagaagcgactgctacccctttcccagaagtaagagatctgcaaaattttgctcgttcgtgagcattttagcttctgtttcaagtcttaagactaacatattcccagactgtcaggccagttttatgaagctgaatgtgatataaagcttaacctgcctccttttgttgtaaacattggatgcaaagaagaattaaccatggaactagaagctgctggctgaataaaaatcccacgggaatttctgttccctttctattcctcttcccagctccggatgtgcatcctgtgtggggacagagagaaacattcagggacaaaacctaagtcacgaggtctgatgcgatgtgagaactcgcggctggcacgcgggtggccatgggggggtgggggtcccactccagcacaggactccatcctcctccactgcagcctgaaagcagggggcaaaaccaacctgctgtctgaaagggttttgtttttttgtttttttctaagcaaacaagtctgaccttccatccctaggaaaggcctacttatgatgagaattctgatgtcaatgtgaggagacactgcccagaccagcaactccacagcaagtcagaaatacagagattgcccaccgcatgaaaaatgtctccagttttacaaaggtcaattggtaatttacaaaacctgattttgagatgactttaggaaattgttgcttctatactttttctctacagagctagaatactgttcaagcgacagcagaaaacatcagttccctaaacccaatgtaaaaattgatgatttctctagcaatttgggctcaaagacactgcaatagcttgaaccaggaacatacatcctaagcaggtaaatctgttttcttcccaggtacgtggtaggttttacaatgggaaagggactcctccaagtcacggttatttgtgcatctcttcataagtgacaggggtgagaagaattgcacgctggcttctggacaggaatacagttctaagcagcattcatcaggccgcactctggcccacttccttgttgtgaaaagtcacatagctctagacactgaccacctgcacccctattgttctgggctctccgaccttggagccataaagcttttgtttaaggatcacttaagatgtttttcagaccctgaattccagcaaccagtttgaagacccccacagaggaatggcattggtgtagaatatagcttcttcctctccctgtcccacgaagtcaccctgtactcttccacaaatcaacaatctccacgctgcagccactccaaaagccacaatcctgagcccaaattcctcggggaggtggatttgaggttttctcccatcgcctcgttcagggatgctacgattgagcctctttctctgctgcaacccagtatctcggtgtactgactcctgtgtgcatcgggcaaagaacctattacgcttacatttcccagtcacctttcatgtttgaggtttcatcattctgaaaggtgacacagaatcatcatggaacaagagcatccttctccctacccagataggtccttcatctgggcgtcatcagagaggtgggctgctgtcacctcacttataggtaaaaatatactttaggcagactgtggggaaaaggaaggagactagaggatgctgctctaggaaggatggcccagggtggaggtgatggggaatcctagagtgacagttgctaagtggggtatctgggggaaaacagttggggcagtgagctcaggactggagtgaaagggccacggctagaagccctggggtaagaagatgcaatttctgattatttctcctgtaatccaggggttatccatatgcacttatctggagctggtctttggggagcagtgaatagcctgttcctggaccctctttctctcttctgcaaagtcctggatgggcaggaaatcaggtggctctctcctgtgcaagagtccttgttccaggccctacctgttggggttctctgctcgggttcagacagagcctcacccactgggtgcaaattcactcacaccaactcctcagctccacaggcgactgactgtagatgttactacattttcatttttcttggcttgtaagtccctaatgacttttccccctactacctgacatgttagaaatggtcattcccatagccactgaaagatacccatgttaatctccacctctgagtcaactggccttgtaagcacactaacccttcatcacagaagaaagtgaattatgtgagtgggttgtggttgggaaccacttactcctgagaagacagcagaatcccaccactaacctataggaatgaagatgaccaagtcatgctggaatagactcaagagtacagaggtgggcaactggcacacccaaaggaacacaggacataatacaaaccttcctttcccaccacaataataaaaccccaaagagaatgtaatgttactgtttctctgtggagcagaatccctctgagtccagctgtctgaatcgggcgtcgttattctaggtaggccacccacagccttccagtaagctccaccagaaacccaaacaaaacacaacaaaaaaaacttgtcagggcagtctttgtaaaagtacaatcccctaatgaacattttctattgtttcacccaggcagatttagaagcccgctagaggctggtatgctgggcgtggactcagtgtgtagctggtgtccagtgttctggccaagtccacgagttctcaggcaagtgccaagaaacctgcatgccagcaaccagaccacggggcattagccggggctgactcatcacatcccgcctcgccaaacacgttttctcttcctgttacccagtgccaagtggctgtgctgaacaagagggcacaaagtagaacatgccctccccctctctgctaagttcctccctgatctacggcaggcagttcccacccagccaacaggcagaggcagctgcagcctgagtgcgcagagggtagctcctgccggggtgaggaccgtgggcgcggagcatgcttcccaagaacagcccgcagggaagacgcccaaaacctaaatcgacataaacacggtcctggccaccacgtcccccacagactcaatggtcaggtggccggggtcactctgaaaatgaactgttctcccactgagctgtgcctcaacccaaattaacctgaagttctgtttacagggattgagagaaatgaatggattgaattatgctaatatcttcccttcccataatcctaattgagtgatatggtctggccttagagtttctctggcacctttgtcaaatgacagaaaaatcagcttttgtgtttttgtgtctgttattaaaaaatgttttaatgaagtattataccacataatagatatatagaaaagtccaggcaacttacagaaataatacagataaattacaagaaagttgttattcccaggcaaatatccagagttcaaaatgaaactcgaaatccttctagtctctatatacagactttcctcactctgtgaaccctcactatcctaatattttccataacaacttgcaaaacattttagccccagttcaccatccaaatagaaagcctgttacaccagtgtatgtcagggttcttcagaaaaacaaaaccagtaggtgatatgtgtgtatgtgtgtgggtgtgggtgtgtatagagatgtatatgtatatacagaggggtgtgtgtgtgtgtgtatatatgtatgtgtatatataggtgtgtatgtatgtgtatatataggtgtgtatgtatgtgtctatagatttgtatgtgtatatatataggggtgtgtacatatatatgtatgtatatataaagatgtgtatgtgtgtattacatctatgtatgtggggagagagagagagagagagagaatgaatcagcccccacacatatagaagctgacgagtcccaaggtctccagttagcaggctagagacccaggaagaactgatgttttagttcaagtccaaaggcaggaaaacaccaatgtcacagctcaagctgtcaggcaggaggcgtccctcttccttgggacagggccagcccctttgctctgttcagactttggctggtggaggaggcctacccgtatctagggggcaactgcctcactcagtccagtgactcagatgttaaaaccatccacaaacaccctcacagacatacccagaataagggttaactaaatatctgtgcatgtgtggccaagttgacacatgacattaatctgcatcccaagcagtgtgtgcccagggcaacactcaaggctgggctggggcagggggagggtgagaggcaagcggtgtctcagccattctccaacaggatggcgaccataagtggggcggtaaatgtgcttataacatcactgttggtggccccatgctgttaacggaaaaggttttccaggaaagtggcaaaccgtgagaagtagtgagggatccgagaggcctaataaagcccacaccgtggagaaagtctacagtcacggagcatcacaagtgctggctggacacgtgaacccatgatgacacacaagctctgacatccttgctatgaaggtaaattcagtcttgaggaaacatttggtgtttcaagtgctttatgtgaggcagaaattcttgaaagattatattggagtttcagagtttttgtgtatttgtgtattttgtggttttgtgcttttgagtgggttgagctaggaaaatgtaattttttgccatttaaaataaaggcatgtgggctcctgatattcataaacttgctatgctccatctcttcatgaggattagatctgggttaagaaggaggctttggacctggaatatgacacaccggaactactgtatcattctgtagtgggcagtgtgggcaaggattcagtagaggaaaagagacatggaatatgacacaccagaactaccgtatcattctgtagtgggcagtgtgggaagggattcagtagaggaaaagagttctgcattttctttctcaatgcacagggatagaggcatgtaacaggagaaaatacatgggtaggatgcatgacatacgaattttgtcagtgttgcctcatccttcaagtgtgcaccagccaaacacgcaaaccttccgacacttcctgaatgccaaaatcatcacatcagagccaagccaaatgaggcagaaaccaccatgctaagtgatgaatgcttctcttattaaggattagttaataatgaccatgctgtaaattactgtatcatatgtccaaagacatccccagtggactggtgagtaagtttcagtaacttgtatgagtaaaaacgataagcagggcctcctaaactctcccctatccagaatccgaattgagtaatatggtctggccttagagtttcactgtcacctttgttgaatgaaagaaaaatcagcttttgtgtttttatgtctgtgttattaaaaaaaagttttaataacatgttataccatatattagatgtacagaaaagtctaggcaacctaaggaaataatagagatatattacaagaaagtcaagttatccccagacaaatatcaagaggcctcttaaaatgttaccaaaaagagaaaaatctatgccacaactaaagatccacatttttacaagaactctcagcacctttcttctaatggcatttaagaagaaaccaggaaaacatacacatgtgaacttacaaagatgcaaaccgcatgaccttccctgacactagcactatgacatcaaaatcagcatgatttagactgagatgtgagtctagtgggcatctcataccacacactgtcaggacagtaccagacacagcagacacaccagaccacacctactgctcataggccatggaaagaagccaccaatgaataagctgggcatgcatttctggccctctgtgttctgcaggggaagggttctatcaccaatgggcccagttcctgggattccaagcacatatttcaatgcgcttacatgaaatactggtttttatttcaaagaacaactagtcttcatatttcttttaaggtcttaacaagtaccttgcaatacaataaataataaccaaacacaatgaaggcagacatgaagataaattatcattccaatgaggcttacaattgttttcctgacagtgaatgttctcaagcacagtgccagaatgcagcataaagaacaatgacacattccatacatttcgcttaagatatgtgatcagaattcagaggagaccagggtcttaatatgcttagggggcttctgaggaaggaaaatcacaaaacacacacccattgtgacgggaaatcacagcagaaaaaagagaaatggggtggtcgcgaaactccaaggccccgcttggtgggaggggagggagggcaggcaccagcaggtggagggggtggcctgggcagaggatgcaggtgcaacgtgaccaagtgaacaggaggactggcttcctacccctgaatctgcacccctcttacaacactcttgctttttcttttattcttccctaacgcttccccaagcatacaccaaaagaaatgctatcaatggtcacttattctcatgcaagtggctcattccacggtccttttggggcgtatttcttagcccaacatggtgtttttttttttccctgagactaatcccattcactcatatgtgcattggtaatccacacccctactaaataaagcaagctttttgcaagtattgatcagagaaaagcgttcaacttatccaccattaaaacaaaaaactcagggctgtttccagtagcaagaacaatcatataaacgaccttcctccatgttggaggtgtgtttcctgggtgcacttgtgcacacacactccccctggagccctacacacctcattcaggagaccctggaaggccagcgggcaggagccctgacctgcaaatgtgttgtcatctccacccatttcaagaccttccctccatccttggaggatgagaccctgtgcccagctcaaggtccctgctttgtccccgataccctgaacacttggtcttgctccttcctcccctccaccattcttcagcttgtcccccttcccaggcctgctcgttccccgccaatgggttccctccctcctataaagaagaaaatctgttgagcatggttcatcgttgactgctgctctgtgcccctactgccaccccctccccattgctgagcccactctgggagtcaccctcgactctctcatctgcttgactctgtggggggagtcctgggtcagtgcttacctgtgacagtttctagcaggcaagacggctgaaggggtattaggaactaggctgcttgactcttgctttcaagttgtagtcacagttgacatgtaccctgccccaaagccttggaaaagtctgtttacaccaggagtgtccaatcttttggctttcctgggccacactggaagaagaagaattggaagaagaagaagacgatgggctgcgggttggacaagcctggtttacacagagatttttgagagggaggctctggagcaatcacagagaagcaactggctttcataccaaacagcatgagggaggagagagcggccaccagaagccaaggtcataaaagtgagggcgtactgagcacgcatatgtcaggcactgtgcaaagcattttgcaaacattatgtcattcaatcttcaaagcaggcggagagggaggcattgctggctcatgtttagagatctggggagggaggaacacagtcacccgaaactataagccctggatattttcagagtccttagagaaggaattagacttcctacaggatacaggacacgcagcttgaggcaaatagatttcaaagcaaaatccaccatctgagaggcacactccaagcagcaccacttactcactttgcatctctaggagagctgcttagtctcctgggcctctgtaaaatggcgtgatcacagtacctacctcgtggagttaatgcagagatggcattaaccagtgttggtgatcagacactacctattatttatattattgttagtatcacccatgtatacatacaagtctctaagtatgcatttctatgtgcatacatacatagcacacgtagaatcaatgaatgtaatgaccatctctggctctctgttgagagaaacatgaaaatttataatccctgccctcaaggagttcagactctggtgacaaaggaataaactaaataggtagactgccaagcacaataaaattcattcccaaactggtcctaagcacctactaagagcccggctgctactaagccttgagtatgtcaaagtatgaccctttctctgcctcaggctcaacctggcgggaaagacaaacccgttacccataaccttccaacattccaagaaacagcctcagaagaggtttatcccaggtgctggaagtctccaggtgggacacaccaagttaatccaagatgctgagctggtggatgggacagcatggccacgatgggggctgggggctttgcagacgaggtgtcttagttgagccctgaaggctacttggacttccagaagttgggggtgcagggggcctgggatgtgtgggcaggatgactggggcagaagcaggggtacaaggacaggcgccccggcgggacagactgagaaggcggccgagccagaccgaggaacagcgcaaaaggtaacatccaagtcacaacaggagtccagagggtcctgagtgtgggaaacacaagctcttctagcttttagtccttggagtcccttccagtgtgtggaagagatccagcctgcaatgactggagggtgggagtggacgaagtttattctggagacaacaaggggtcctggtggcttttccggggtagtggagacaccgccacgtctgtgtctctggagaaggaagatggagaaggcatcctccggtgggatggggtggagctgggagaggccccagcgggaagcactcggaggagcgggggccaacccggaatcagcctctgttccttcttttccgcagctcacctgttcccggcttttcctcccagtctcctgggctcgccgccagcggtgggatccctcttcctgcacagaaccgcctcttccttcctcctggtgacagatgccccctgccacccccaggggctgcggctcccccagatgcccagcctcagcctcctgagtgctgtgcctgcccccactccatctgagcggctgaccagtcaccagactcacccccacccgccctctcccctccacacagggtagcccccaactccagccagagggagccaagacctcccaccccaggcagatcttgtgggcaaggtatctgcttaaagacattgatggattttatgaagaaaatatttaagccaatttaaatatttcagcaattgataagtaactcagcttttatgggctggacctttagggtattgtttgtaagatgtatatgattttcatatctatatcagtgcttataatattgtttgcatgaaaaaaaagtttctcatgtttgccatccatttacaaatgagctttacctatttgtaaattacgggctttcaacacgcagctggacgtggcaggaaagaggagacgattactccgtgtctcagcatgaagaaatggcagatgtcagatgtcagcgctgccaatgtttcagcactgcggttccttgctcactgagtaggaacagtttgcagaaatactggacaacctgctgtggataataaactatgtcccaggctctgtgtttcctcaggaatatatttacttagagaagcggcctattaacatttcccgggaaaatgcaaaatccattttgtgaagcagtgaggctgagttttcatagttctttcctcctccaggtgtcttcactccaagcttgtcacccgcatcattcgatcaagagtgcccagaacatcgcatgtgtcaaatccttaccgtttctgcctaattggcagttacagcctcggcccacctgtttccagggttcccagtgtcagtcggacactggaggggcctccctctccccaccagtctctggggcagattccccctcagcctaaacattctgcactgcagagggcctgccactcacaagcagcttctgtgccgctcttccaaattaccctgaagacattccctgtccgccccacgcctcccctttattctctttctcatctccaatgttaaagagtttctgaagcaaatgacaatgacagttgacagatttcagtctgaatttcccttttctagggccctcttctaggcatctatcttgcacttgctctttaatgtgaagctttttgactatttctgttgtaggagctctcattcagacgctgtaaaaacagctgttttccaaatacacaaataacgcagtctagaaaaactgggaactttctatgggggaaagtccttgctcatcctcccgagccacggatcaaggtcgagggctgcagcgtgtccctgcggcagcatcacctttctgagagtcctcaggaagcatcctcagtggccagatcccatttcaagggccctgtgcttcagggagcgggcaggagctttaggacatgtgatcccttatatgtctgagccgtcatctgtgggccatgaatgtgtttttaaaatggtcattttaattacccttatgaggtgttcacgtggttccccattcagagtctacagccaggagggaataaggcagacaccaagagccacttggcgaagtggagatggctgggctgaaagtcactcctgcatcttcctgttgagtctggcttgaaattcctgggagaaaagagcaggctggggccagtgctcggcctctgctatgcaaccagaggctctccaacttttccccatcccaagtgatttaagtcaccgccaattccaaaccattaaactcacactggagagaggcccgttgtttaagctgagatggtgctgacagcgaggcggtgggggctggctttaacgaagccctgagcttgttcttctgcggtgtgcttcagccatttctccagcttccctcgggactgactgagctcatcagaccccgggatccaaagcctgtgctgggatgcaggggtccgccctccctggcacctggctgcaggctttgctggtgtggctggcctgggccccggctgcctctgcctacagtgccatccacgctagggaacagctgtccccacaagaaccatgtggtccatgtctgggcagtgaccgcctcacttgcagccaaccccacactcttcagtggtgccgaggtcctgtggcagactcagccaatcccagtgtggacttgactcggtcttggacaccgggggccagtgagctagctgttgggccagtggggctcagcctgatactggacagagcctggacctggggcctgtggctggggaggggtgctcctgtgtgggccaacaggacggccgatggcctggaagacagtgtgaccgagctatcagctagcactcgggactccacatggatgcagaggtcaccgctggccatttcaggagacactacgcctaggagctactgcagccagcactgccaggcagcgacatcacaggaggacatttctaacaaaacaaaaagcatcttcccatcttcgtggacaactgccatgtggttctgataaccacttttcaggagaagagacacatgaaacttgggatagaaataaagaatgggaagagtgtcatggaaacctagatgaaaatgtaggaattaatcttcaaagttcagtgtgaggtgtgtgacagcagggaacatcctagggtgtacagaaagggaacagacctactcccgggctcctgggacgtgatggccttggctgggcgcaggctgctactgcaggggaggccatgttcctcttcatgattgtaccacatggggaagagcctacatcggtgtccttgccagaatatgccagaacatgcctggaaatcccaggctgctccttggcatctccaaagggccccttcacaggcgtaggcagtgtatcaggcagggacacctgagccctgccagccatgtctgaatgagggatggatggctaccacctcagtcacctcaataacctcactgttggtgccacaggtctgcccatccaccacatcaccagaggttctgtctccagatgattctgaagcaccaggctcaggcttccaggcagcagagctctgcacaggtgcagggggtggccctctcccaagctccatgcgatgctatggtccctggaagtccatgctgggtctgcggagcctgtcttgcacaggcccatgggtctctcacacctccccacccttgcctggaatctccccaagcctcttaagggaagcaattctgtccactcctggccctgaggtctctcagccaggagctacccttgctagaggggcggggatgagctctgagccagtccctgacagccccactcctgcacctgacaggctcagggaagctgggtgattggctggagatcacacagcccacgcaaagctgaaggtctcatctcccacactgttctgtgcctgtggcaggatcacagaaagcagagctggcaacagggattttccctcggacacagtgacttccataaaccctacattacatcgtcgcaggtgcaaatgtgaactaaaggagcttcttagcccaaagagttgcaaatacgctgaaaacagcttccagaatgggtcacatgaattaatggcaaaaaacaatccatgatgagccactgaggtaacccaggaagacatcacaaacacagaggccttcgctgcccttccgcagaacaccctgcttgctacccacaaaagcaccctttaatcggccatgagtcacatccatggtggcaaatcggatgttctttcctaagtgggatttgagaaatccaaatccttgacatgtgcttggccgtgagcctgcagccctgcctgtcctcccatgcagaccacatacttcgactcaaccttgtgattcactttccacacatccctacacacccatggttaatagggagacagtaacccagaggttcacgtgagtcactaaaaaaccagaaggaaaaatgagtggccacgtgagagcagctgtcagggaggagcaaacacccaaagttttgattaatttcccagggatctaatttaacataagaagtagacatggacagattaactatgggcacatgacaacacatcacggtaccaggtttctaagaaaaatgtttgcccaggggactagcttaaaacagagagtagtaaatcggcagcggactggtttgcttatagcccaatgtgcatttcactgtatcactgaactgagctggggtttcgaacagagctgggattgagataaatcacagcacatgctcggccctcagtctaaactggaaaacctgttcggaggaaacccatgcccttcccatggaacgagctgaattacctagaccagcaggagacaagaggttccatctctccccagcgatccgtgctaagcttacgtttcccaagggcctgtcagaaaaatggattagagaaacctatttccctctgaatctaaaagccagctcacctggggaaagagcacaccaccaaagtccaagggcacgccagtgcagcctctgcgcctggcagctcctcctcctgggaaacatcctgtctcaggtctaggatggaagaggaaatacctccaccgccagccccagaatcggcccttggacatcctgctctcgtaaccaagagaaaaggggacactggatgcccaccacaggcctcagctttcttggggtgacaggaatctttaagaatttcatgaaatcttggcattttcttcctggaaaaacacacacatgcacatccacataaaatctgtcacagactgtctggaattcctgagacccatccacagaagccatgttaagaaagcctgttctcagaggactgcattaaaagaaaattgaatccaaaatctattacttggccaggcgcggtgactcacgcctattatcccagcactttgggaggcttaggcaggcggatcacctgagatcaggaattcgagaccagcctggccaacatggcaaaactctgtctctactaaagatacaaaaaaaattagccggtcgtggtggcaggcacctgtagtcccagctactcaggaggcttgaggcaggagaattgcttgaacctgggaggcagaggttgcggagagccgagattgcgccatcgcactctaagcctgcacaacaagagcaaaactccatctcagaaaaaaaaaaaaaaaaaaaaaaaaaaaaaaaaaaaaaaaagcaaaattttttactggctaccatgttttggggctgaaacacataagacttcggagaccccactaaccaggcagagccctgccctggaggtgactgtgcttgtccctgcatagctagtgaccagcacaggcccaaagccatctctgaatgtatgtggcataattactgaaactagaaaacaaacatgcaaatcacaagtgcgttttgtgcaaataatgtgatattttaaatcagaaaatctgggtatcaatctagactctgcttcttcctgatttcatgattttgaacaagtacttttttttcctcttttaccaaatactgtagttgaaagtgtattaaaaattaagcttacattaataaacgtatacaaaagattatattctggatttaataacaaagaagggtattgggaaaaaaacaagtctgtaagtaaaaaaatgcaagtttactctaagttaatgggtacagacacaagcatgtcccgtataattattccctttccattggattcctccccaaggactggcacaatcttcaacccacaggggctgagaccccgcaggggccttgagactggccctggtttggcccattctgctcctcccgtcttccatggcgggttttcttctgagcgacctctccacagggaggcaccgagggctgggcgtcacgtgaggttagcgctgttcctgccctggccgctttccaagtgatgtttactcccatttcattcggctcccttgcagcatctcagatgtttgcatggtatgtgtctctttctgtagaagaaccttctgggtggtttgggaaaggccctggcctgtcatcggatgcctctgccctcgctgggtccctgctggggccgccctggaaatctccaggccaggcattctcaccaccctcttgccttctccctggacctgctctcatgaggggtctttctggtcactcccaggactcctctatgggcaggggccacatcgtaggctgctgcacggaccacagacaaggtcaccttgggagctgtggacttctgtgtccttgtgatccctctgggaactatacttactctgcacggtgattcgggacagcaaggatggcagaacacttctcaaaggacacccccctcgggaataggacatctccctgtactgacttggtgccgattccttgcaaagcgtcttcccctcgtccttcaggactgctggccagcactgaaacttacatcccaattctacagtcccaggagaaaagcctcactctgtactttcaacccctgccattgcgctgaggatcacaagattcacagaagagatgtcttattttcactttgcaggtcttaaaactctgaactaaagtactgtctagacaattatcacttgaaagaaagttcagcaagtcacacatataaatccaagggagaggctgtccagtatgagggtgacaaagggacacgttcccacaaaagaagcctactgagtacctgtcacctcttgcagcaaccccaagggtgtaacagcaactacgtggtctcagacccaggagcttcctgccatagctccagaccctcggggagcagcactgaaaaatggcagcaccccggtatggagaaacatgggcagtcaccgcctcctcaaagagaggcacaagatgggtcagcaatgggccctggctccccttccactgtcctgcatgccccgaagctgtttctgacagctgcacccactccccacagtcagatgttagggtcaccaatgacaacgcattgatttctgtttcatgtgtttcacctgcaaaaacaaaaacccttaaacttaggatataagaaattgccaccaatacttaaaactcttggacatttcagcaaatgaagtaagcacagaaatagaaataagaactacaaatatagctctaaggcagtatgcttgtatattcagcataaactaaaataaatacagcagatctaataatacagggtttagatacaaaaagaaatacacacataaattccatgcttataaatcaaaattagcatgacagtgagtgccacagggaaaccagacaacattcaaagatttactcctaaatatttaatagtgaatattaaaatattaaaaataacaactaaagggtatacagaaaagcaaagggaaacattacagagacacaaaggtagatctgaataagtagacaggtaggctgggaagactgagtatgttaattctcttcactgtaatagtgtttaacccagtttaaatccaaattttaagaggcctttttaggaatttaaaaatggcaaactttttctaaactttacacgaaataataaagaatagcataggaattctgggaaaataaaggcgtgagagagaagtcgcactgccagatgctaaaccatgctgtgaatctgcactgtcacaacagtgcggtgaggacgcaccccaggaccgatgaggccggccccgcatgcccagcaggcctgggagaccgaagcactccacacaggaaacagtaagcgcgggaccaacccataagggataccggggaaactgccatgaaattcatcaggtgaaaaatcgagtccttctccagttgccatcagataccaaaacatcttctatcggcttaaggttaaacgctgacacacacaacacagagaactagaagaaagaccagcaaagaggttgctgcttcccgaacagcaaagaactcaccctaaaagcaacagcagaaagacaatgatttagctacacaaaaacgtctgaactttaaaagctcgtaagcaaaatgaaaaagccaatgacaaacagaaaatattgagaaccacaaaatagtgtgtgcttgggcgtgtgtgtgcatgaatgcacgcacatgcgcgttctagcactccaaaataaacagtggtcaaaggaatgaaatgcacagttacatggggggaaatttaaaatccaagaaatatattctttaaagtagtctcattagtaatcaaagaaataaaattagataggtgagagacttttttttttttttgcctatctagttaattaaaatgttgagaataaaaatatctaacatttgccacgttgagcgtggtgacgacttgctgacaaatgccagtgtgagcgcagcttgaacggcctctggaaagcaatctggtgcatttgtatcaaaaatcataatcttgaaacaactgacttcctttttagaatttttggaaaaaaatcagagccagggacaaatacttctgtgtaaacgtgccatgttggcattatttatagtgaagaacagtggggggaataaaacccttacatcttctatattgtcttaataaaggcaaacaacagaatattatatataaaataaaatgcattcataatatttaataacacgagaacatacactataatactcagtttcattttaaacacaaaattctatgttcagaattttattaattttatagcaaaactcctacatagatataaattcaagaaagaaccaaaatgtccccagatattaaatatgtgtatctgagtggtgggattgattagggattctaattttctttccagttctctaattggaatatctgatacaatgtcttccatatattagctacccaataaatattgagaagaagaatgaaacgatttcaaacttccaacataaacatgaacgattactaattctaagaaaagagtgaaagcatgttataaaacaaacactaataaacagatattggtttaggaaggtggctggtggcctctcaggctggctaagccaagggatgtttacttttgtcaatttctgcagaaaccacacaagtggctggtgacgtatttagctctttcctcacagtaaccctcctgaggactctaggatgatgttctcacatagctctcattgccggctgctttccctgcctgttgccctgtggcagagccctagttatgggcttacagctcctccacgctccactggtcatatggcctggggataggggaccagggtggctgaacctggaccagcaaggccccctttcctcctgcctgtgacccctcactgagggtccttgggggacacaagcaaagaggaacatagcccacacggagcccgcgtcactagcaacggcacacgtgtctctaccctcatgcagggtgtgagacagagcagctcccacgtcctctgctccccttgaatctgcacgttcgggtctacccctgcctgctgaagaagaaaacaggggaaatgcaggaatgcagctcatgaggttgggcccagggagcccctgcgtggtcagagggagcggagcacaggaaaggaagagaaaggagaggctcctctgcatgcccagccccaccccacaccatgaggacagtgtgcctggggttcccggggtgcccagaagctctcgggagccctccttcactgacaggagggatggcccggtgcagggagggcaggagggtgagatctttggtctgtgggaagccacatcagatgcagaaagtccatttcaaagacaacactgaccctgcacaaatccagctcctctgccctgtcacgagaagggcactccatcagggcaggcgctcaccacctctggttagagcttccagaacctcgtgttatgaagcacattcagggacgggcagcaccctcgtgcaaactcagggaaaacagagggtccactgctgcacctaggttgaagaggatggcagggtctgcagggggatttttatctttttctacgtaaaggacagaagacccagcgcacgtgttctgatgcaggaagacgtactgctgtctatgtaaagtacagatcaacagcaaacccaggaataaattcctgctgaggaaggcatccaggtgcctccctgcagaatgtgcccctgggtcaggctgcagctgactttttacaaagtgagctcgccactgcaaagccccatgggttttgtcacactgactctgtggctccggcctcaccggcctttgctgcacttactcccattgactgccagggtcgtgaccgtaaacaccgaggttctcttccagagcctggtggcataagcttgcagcctcgagtccattggctgcgtggtgaaacagtctgggaacttcccagttttgaaaaaagttagagatggaacttcccagttttgaaaaaagttagagagaacttttaaatagttaatagagcattcagagagaagaaagagctcctcacgcatgtgaaggtgtgtcagatgcagcaaatccatttcaaagggaacgccgacccacaaagagcagccacgcaggatctttaaaaggactctcagtcctaacagctcacaataaaccatctctacgcggtccactcaagacacactcaggccctgccgtggtcattctctctctacagcacacagagggcaatggcaccactccttgctcttatcctgagtcctggcgtgctgaccgaggccaggtgcaagagggttttttaattttttaaattctttaaaaaaacattctggattcaggaggtccatgtgcaggtttgttacgtgggtctattgcatgacgctgtggcctggggtatgggtggccccgtcacccgggtactgagcacagtacccagtaggtagtttttaagttcacatgcccctccttccctcctccccagcagcccccagcgtctgttgttcccatctttatgtccatgtgtattcaatgctgagcttccagttttaagtgagaacatgcatttggttttctgtccctgaattaatttgcttgggataatgacctccagctgcacagatgtggctgcaaaggacatgatttcattctttttatggctgtgtagtattctatcacgtatatgtaccacattttctttgtccaatccaccattaatgagcacctaagttgattccacgtctgtgctattgtgaacgttgttgcagtgaaaatacaagtgcatgtgtctttttggtagaatgatttattttcctttggatatatacccagtaatggaattggtgtggtagttctattttaagttctgcaagagtattttaaataaaaagttatataaagataggagtaagatggaaacaggaaacatacaaatgattgcagaaaaaccaggttaattcatcaggtagcttgaaaagcgggactttctgaagcagtaaaatatctgactaggttctatataaatgaaacttgtattacctacaaatagagtagacttagtaagacaccaagaaccaccaggaagagctaccaaggatctacttttgtcaacagataagaatgattttaaatgaacaaatcgagaaagatggaacaaataatttaaaaatttccctggtctgccccactgctcccagataatttcaggtatctggcagaagaaactgactgccccaaccatgataggcacagccaccaacaaaactagacatgcaaaacgcctggctcttttaacacagcttttgtttacgaacgccatacaacttctcagagcacattggaggaaagattttcaacacataaaaactttgaataactacaatgattcatgtgatttttttgtctttgcattcaaaagtcagaagcataacacgaggctatgtgtgatccgggctcagggagtacgggggagcgctcagaagtgtacggagaactattttcagcgctggcttttgctggagtccagacctgccaaatcgagcacgagagggcaccttttgccaagatggaagcactatgaaatccaaggttgctcatttccggttcattgtgtttatcgtgtgaggctttccagaagggaaaaaagccagcttctattttaaatgacgatccactgatgagcagatgggtttggtgttgctttttgtttattctctctacatctgaaaatatttcaacattttaacttcacagaagtataatgatttttctttccttttttacatgctttcattattaaacgttttacctcaggagagttaagacctcagaacaacacctcccactgagctgaatggaaggacactaatgggtccactgcctctttatcaatgggaaccatctctctaaacacagaatttcctccatggattggtttggaagaataaaattttcaggtgtaaaggagctcaccaagatagcaatctattcatttcacatgaaaaaaaaattccaaagatgagaatgaatgacttgaggtcccaaataaagcaaaataggtgatatggtttggttctgtgtccccacccaaatctcatcttgaattgtactcccataattcccatgtgttgtaggagggacctggtgggagataatttgaatcatagaggtggtttcccccttgctattctcgtgatagtgagtaagtctcaggagatgtgatgggtttatcaggggcttctgcctttgcttctttctcattatctcttgccaccaccatgtaagaagtaccttacacctcctgccatgattctgaggcctccccagccatgtggaactgtaagtccaattaaacctccctttcttcccagtcttggatatgtctttatcagcagcatgaaaatggactaatacagtaaattggtaccagtagagtaaggcattgctgaaaacatacacgaaaatgtggaagtgactttggaacttggtaacaggcagaggctggaacagtctgaagggctcagaagaagacaggaaaacgtgggaaagtttggaacttcctagagacttgctgaatggctttgaccaaaatgctgataatgacgtagacaataaagttcagactgaggtggtctcagatggagatgaggaacttgttgggaactggagcaaaggtgactcttactatgttttagcacagagactgggcagcattttgcccctgccctagagatttgtggaagtgtgaacttaagagagatgagttcaggtatctggcggaagaactttctaagcaacaaagcattcaagaggtgacttgggtgctgttgaaggcattcagttttataaaggaagcaaagcataaaggttcagaaaatttgcagcctgacaatgtgataggaaagaaaaacccattttctgaggggaaattcaagccggttgaggaaatttgcataagtaatgagaagttgaatgttaatccccgagacaatggggaaaatgtctccagggcatgtcagaggtcttcatggcatcccctcccattgcaggcctggaggcctaggagaaaatggtttcctgggctgggtccagggtcccagagctgtgtgcagcctagggacttggtgccctgcatctcagccactccagctgtgactaaaaggggccaaggtacagctcgggctgttgcttcagagggtggaagccctaagccttggcagcttccatgtggtgttgagcctgtgagtgcacagaagtcaagaactgggggttctgaaaccacctagattgcagaagatgtatggaaaacgcctggatgcccaggcaaaagtttgctgcaggggcggggccctcatggagaacctctgccagggcagtgcagaagggaaatgtggggttggaacccccacacagagtccttactgtggcactgcctggtggagctgtgagaagaaggccaccatcctccagaccccagaatggtagatccaacgacagcttgcactgtgtgcctggaaaagcctcagacactcaacaccagcccatgaaagcagctgagaaggaggctgtaccctgcaaagccacaggggtggagctgcccaagaccatgggaacccacctcttgcatcagcatgacccggaagtgagatgtggagtcaatggagatcattttggagctctaaagtttgactgccccactggattttggacttgcatgggccctataacccctttgttttggccaatttctcccctttggaacaataactgtacccccattgtatctaggaagtaactagcttgcttttcatttttcaggctcatagatggaagggacttgccttgtctcagatgagactttgaactgtggacttttgggttaatgctgaaataagttaagactttgggggactgctgtgaaggcatgattggttttgaaatgtgaggacatgaaatttggaggggcctgggcggaatgatatagtttggttctgcatctccatccaaatctcatcttgaattgtactgccataattcccttgtgttgggagagggacctgatgggagataatttgaatcatgggggcagtttcccacatactgttctcatgatagtgaatatgtctcaggagatctgatgggtttatcaggggtttccgcttttgcttctttctcattttctcttgctgccaccatataagaaatgttttttgcctcctgccatgattctgaggcctccccagccatgaggaactgtaagtccaattaaacctctttttcttcccagtcttggggatgtctttatcaggagcatgaaaacagactaatacaacaggattggaacccaggtttcctgaccctcaagatgctgggcaacgtgttccttccctcagaagccacgtgccgtagactcctccatctgtgccctggactgggggctgtcctgctgctgcacacctacatgtactgtccttgagcttataattgggtggccctaggaagtagtgggatagtaggagcagttaagaggcctcaatgctggaggtgaacaggtgggatttgggtccgggcatcattatgtaggagctgggtgaccaggggcaagcaccttagccctccggcactttgctgttcacttttgcaaagcagagatgagtgctttggccttagggctgtgaagtttaacagtgttaaataatgcagaagaaagcaagcatcccacagatactactgatgacaataacacagctctttctttaacaaatgatggcttaaaaactaatcctggccagcatgctccaatctagagagcgaggttttgtaaacctgatcctcaggtgacagcagtgtctggaccagcagggctgctcacaggagtcaccgtgccaggatcactgtgctggagcaggcctactcaatcagagtgtctgggctcagctccgaggtcttccaccatgcgcctcgtgcattttctacacagagaaaagtgtcaattggcccaggatattgatgggatctgtgcagagatatgtgagggacaggaacgtcacagcttagaaacgcagtttatgagattctgcatttaaaacccaccttgactcaactgcactcagagagaccaaaaagcctctgcattctatatttcacatttagtgagaaggcccaggttagaaggaaacagtaagtctgatgtcgagcagcatggaaaacggaggatcagtggatcatgaaaaacaagccggaatgagaaggcgtgtcagtcaagacagccccgagccaccgcctggccgtatctgccaaaggggtttgtgatcttagacaagtatccgtttatgctgtttagaaaacaatctatagttgtattctattttctgcattcagctttttttgagtgccattatgataaaatgtcatgttattataaaatttgaagttataataaaatccaggttgagatgggcccaacaggtgcgacctgcattctgtacagaatgctacagaattcttggctgctcgggcccttcctggagtggtgctggcctgtcgcccacaggccatctggggaggaagaaatgtatgcaagaatgtcatgcttccagaggtttcggtggtggcaattctactgcaattattaaagatacattgttacactggctagttacaagtgggttatatttaaacaaaatttggagaaaaatgttaaataaaaaatgtttccaagcacaaaattgtttttggagaagatgaacatcctacgtcaccatgaaactggtgtattcaagattcaggccattaggaaacgccatgtgtcatgttacaagaaggaagcagcctgtgaaaagtgtcaaccgctcctttggcagaagaagaccagtgttgtggtatttaatgtcgctaaatttcacgatttgacattttctacattttcctttttctaagatctaaagatcacattattgaaattttatctctaaagaatggacctcttaaatagtcctcttttatgattatgcaaataactcacatactgttttgagaagaaaaaaaagacaactaaataatctgaggatagttcctctgttatcccagccaaaaagaatagggaatgcatagtgacaacaccttcctaactgcgacctttagaatcacggcacttcatcaagttcagcattgaacatgcttaaagggccgtctttctatgactcagcccggaggttctggagttgttgcccccatcacagtgggctttgggcccccgggcctgccccttggttctaatgatcagggaggtcctcccttatgtgcccactgaacttccagtctcaggctgactcacacaggacacactgtgaaaagctggagaggaaagggcccaagtgacacagtcacccgatggctctcagggacctgagggccggcaaaggtagaacaggtgtccactaagcctggagcgtagcctcaaacccactgtgccaacacaccctgacttcagccatagtcccgtgcatatccaaaggtctgaaggaaacttcagaggtgtccagtcttttggcttccctgggccaccctggaagaagcagcattgtcttgggccacacataaaatccgctaacactcatgatagctgatgagctttaagaaaagaaaggtgagtgcataaacctcataatgttttaagaaagtttacaaatttgtgttgggcgacattcaaagcccctgggccacgggttggacaagcttgctctggattgtacccagtccatgcctgtcattgtatgtgatcaaactaagcaaaaagacctgattttcagtctaccccacccccaacccctgaccccctcagtgggtccccagtgaggacggatgagaccagaagtcccaatgagcccagtgtgccttgtgtccctgggggaaccagacccgattggacacggactggattttcatgcgtagggggcggaggaaagggaggacattaaatctttaagtggttaaagacacaaaacccacaggaatgatttctaatgaacagaaaaagggctgaggaatttttcttttcttttcttttctttttttgagacgaagtctcattctgttgcccaggctggaatgcagtggcgcaatctcggctcactgcaacctctgcctcccaggttcaagcgattctcctgcctcagcttcccaagtagctgggactacagacacaccaccacgcccagctaatttttgtaatttttagtagataggggttttgccaggctggtctcgaactcctgacctcagatgatctgcccgcctcggcctcccaaagggctgggtttataggcttgagccactgtgtctggccagggctgaggaatttaatattgcacatacatattgtctatgattctttatgtgaaaatccactcaaacatccactctgcttttgacagcatcagcctttctcatgacaaaaccttcccctcagggcctatgcggagaatgccgacagcacctgggctccagcgccttctggggcctaggcctctctacacccacctggatgcgcaggtcaaagtgctttgcttctcagggagggaactgacgccccgctcagcccttccttctcctacgctccactgtcctgagggacttgatgtccaagtgctcaggtgggttcggcattttccacaaacccaaggaccaggcatggcagcctgttgaggccaccgagaggccggcttcgagtatgcggggcagtgggtgggtatttcgctgtgtccattttccttatattcactttctatttgaatgacagagaattatacccagaaacagactagtttagatttgaaagcccttggaaatcaccacttcaaatgaagacccaccctgggcgagatggggagggaacacccgctgggcaggagggcacggggagagggccggatggggtggaatgcccactgggcaggtgggctgggcaggagggcacaggaagagggtgagatggggtgggacgcccactcggcaggtgggctgggcaggagggcacggggagagggcgggatggggtggaatgcccactgggcaggtgggctgggcaggagggcacagggagagggtgagatagggtgggacgcccactgggcaggtgggctgggcaggagggcacagggagaggtgagatggggtgggacgtccactgggcaggtgggctgggcaggagggcccagggagagatgagatggggtgggacgcccactgggcaggtgggctgggcaggagggcccagggagaggtgagatggggtgggacgcccactgggcaggtgggctgggcaggagggcacagggagaggtgagatggggtgagatgcccatgggcaggtggggtgagcaggagggcacagagagggtgagcacagtggccactgaaagccgctgagccgtccatggagatctgaactgttgagctggcttccggtggcatgcactttttgaaataaagccttttcatttgaccatgaatgtgttcaacaaaaccaaacttcttgggagagtgaacatgtgttaaatgaccatatactaacccatcacgctgactgttcacagctgctcaccaccatgacctcattagttgggcggagatgaatatgcagccattttacgatcacaaattacattccacaactgaaatgtagcatggagctctgagagatttttcataaatcacaagttttatagtatgcaatgaatttttatcaaattcataacatagatgcatacatcttattttggaaaatgaaatggcatttattttctccacagaaaaagtgccaaaaaatgggcagtaataaaatttccattattcaagaggttagatatgatttccatcttgactgaaaaagccagaacgctttgaaagaacttcttttaggggttcttatgtaagaattgctattatgcatccaatgtgcagaggaagaaaaaacaaaacacaaaaaaacctcttgaataataaaagctatggaataaagcagtataataggttggttttaaaacttaaatatttttggtaacttgatgtggataataatttgaagatttaagaaaaataactcactatattttttaccttccacattttctcctactttaaaattcactcactttgtcttgacttggtcgttgactgcttttattcataattcacttgggataaacagacttgaagcatatacacgataattatttcaatatcaattctaataaagacaaagcagtttggtaagttttactcgcattcgcatacttttcaaggtatcatattacacataattagatcctagaaacaaccaaattgctacttgtgagctaaaagtgctgaattcttgcttgtttagaaagcacactgcctcatccaaggccctgatgtccagctcaccctagggtctagcactctgcaccctgtaggacttgcaccagagatcacggccttcttggggcaaaccacagcactgtcgctgtgatctgcggaaacggctccctccactttgcctcctgtgagtcttggtgattaaattgttgagcaacttcaaagcacagaggcgaaaaccaatgggaagaagcagctggtggtggagagcttaagcatcctgcgcaccttctctgagctctggccaggccgtgctgaaacactgcggaagtcatgtctacaccagggttccccacccactgtccagaggtgacaaaggagagacgctcctgataaatgtcttcacgtgacagtttgtcattaaaaaccgaagctaagcccactgaattcctgagtgcttattaaagcgccaatggccaaaagagacaagactcacaagactgtggctttctcctctggatggcagaagacgtatctcacttggcttgtttcagtccaggaggcatcacgccaaaggaagtactatgccacaggaagaaatgtgcaaactggctggttctcacgtttttctacagcattttacttccatgggttctatctaatggtaacataggttagagcaaaacacagtcaacacagttgctttagctcaagtaatttcatcaccttaccccatagtgatagtgaccctctaagggtcaacaaaaaggcgcatcttaaaatgtattttatagctctggtaggccaggtgtgcaacgaaacaaggttaataaatttaaaatgccttggtgtgttttgctcctttcttagtctgcctgagctgccataacaaagtactatggattgggtggcttacaaaacagacatttatttcccatagttctggaagctggaagtccaagaccaaggtgccagccatttggtcctggtgagggcccaattcctggctcacaggcagctgcttcttgcagcgccctttcgtggtggagcaagagctctggtctctcttcctcttcctctgaggacactactcccatcgaatcagggccccaggcttaggacctcacttcaccttcattacttccttacaggccctttctccacatagaatcacactgggggttggagcttccaaatgtgaacatggagggatacaattgagtccattaacattccatcccttatttgtagtaacagcatgaccatactcagtgatgacagggacactctaaatgtcaacatttacatcttacaacactttttatagctctattaggccagttatgtcatgacatcacaattaataaatgaaaaatgcctgggcattctggggatactcagcagctctccagatgttaaggaaactcagtataccccaatctggtcatttctatctgtgattgtgatcttttgcactttattttatagtaattttaactgaaatttttaacggaaacaaaggagctacgctgtcatgccaagttttcagtaaatacgttgaggagctgtgagctcagaaagcgttccaatagaattcatttctcatggagagaccatgattgatctatttgaaatgcaatattggtccagaaactcagaaacatttggtggaactcagggtttacaataacaacattagctaaagattcaatctggacctattttaagatcccgagggggtggcacattggtgtgtcattcccaagatgtctcaaaacacacagcagatttctgctgtagcaactagtgtgagaaaacccgagagcttcttggtcatctttgcacctctgagtgctgagcacacgtgtggtgacgatgttgctacaacgatgtggggtgcaggaagctcgagtttcaaaagaagatcataagtaacacatttttccttctagccagaatgccctgaaatacatgaaaaaagatgcagctctggctacgtgaaaaagaggtagtgagtgactcggggctgggaaacgaagccgtcctcgctgggatggactttcagtctcacatcttcagcaactttagcttcttcattatgactttttttctcttgaagattaaggaatcgaggattgctgacatgtctgtattgattagttatggttctccactatgtttactgccatcctaattacagaacctaattttcacatttacttataattgtgtgcaattgtccaggctgatcttttaaggttaaagagaaaatctcaaacatgacatcaaacaagtctttttttttttttttttttttccttattttacagctttattactgatttccctctaaaaagagactcaagtgtggagctgactcatctatagattaaggaatcacaaagtaccatagtcacttaacaaatgcaaaaaaaaaaaaaagcaattgttttacctttcaactgctgatgttatgtacaatctatcacaaaaagcatagctgtgcattcatgagctgattatatcaacctctagaattttagaaacgagcacatctaagcatatggatactctcttaccttacaaagtaaaagcattttctattttaaaatttttatttctgtgtaaaacaaagaattcctagaggtcaaataatataccaaacttaaagcactattaagtcatgaaacaaagaagattctgaggtagaagtcaagcaatataatccacagtttcaggtattcccagcaaccatcgcatttcgcaagtaagatctattttttttaaagtctcaacttccaaaaaatcaataatccattctgtaaaatcagatgtaaaactatgaccaacagaagacacccaaacttttctcatggtaacagagtaaatgcttttactaaaagctgccaacatttctatcagtagtaaccgtaaggaggccgctggttgtaaccataatgtccatattgctggggatagtaaggttcttgtctgtgttgcgggtagttgttaccccaggatcgtccatgccactgattggatcgattgtcacttggccacccccatctgttgtccctgcctctgaactgtctgttgtcttgcaaccgattgcctctgtttctttggttcccaccagctctgctattccattcctcaacaattggaggagactcaggagggcgtttcaggtattcctgatactccttgtcattttctgtgaatctactagcaaacatctcttcaaaatttggaacagcttcggcagtgtcagtcattctgaaaatcccaaaggtttgaggcagctgtattgcttaatgtttaggttgtttaaatccgccaagggctatgtctatccagctcaggccgaaccccgccggcgagacactgagaagcccaggagaggtggcctctggtccactacaccgtggaactccagaccactccagttctccaatgtaaccgagcgccttcctctccaaacaagtcttttaataaggcccatgaactagtccatatatataccagaggaggaaagaaaaagaatgaccacagtttattctgaagacatgacaaaggtaacacacatcagttatacacaaagtcaaatttcagcattacctccagggcagagggagccaacagctttcagaaatctctgctcctgccatagactggggctcccctcagctgcctcccagtggggactacattacccagccctccttgcaggcaggtgtggtcatgtgactagccctggccaatggagtgtgtctggatggtgtaccttaaagaagcaggtgcttctttcatagtctctttccccccacagctaactgcaggcccttagggctggtggagctacaaagaagaagcctgggtcccccaaatccccatgtggaagcaaagtggccagtcatcaggaaccctgacattagactaacacataaggaagaaataatttttcttttatgaactcagggaaatattttcctgaaacacaagagtgcacagtccagagaccctgggtcagagccctacaggcccaagaaaggcttggttggacactggcatgggacagagggaggcaagaaagatgagataagcacagactagagattcgtatctgcttttcataagtacaagagaaatgtaccatcaaaatcagttctaatcaccgtcactctaattgtgtggcatcagacaagctcctcacccgtccttggcctcagttccctcctatgtagaatgagggggtcctacctggattagtggttgtgagaaataaatgaacccacgcatgtaaaactcccagaacagtacctggcatagagtgggttctcaaaaataacactttagttcttcctgaatatctcatgcagtgatataacatctttcttgaacgagtctgccctttttgaagtctgccattggaaaaaaaaaagcaaaccagcataaaataaatattatatatatatatacacacacaaaaatgtaaaatatataagtggattcagaagtagaagatgaagggcccacgtctctgaaaagccacagctgaaggcgctgaaactagccgtctggcctcactagcacagtgggtagagtctgacttcctgctggctgctgtcattcatggcaggactttccgggactgtgcgctctctgccctgtggggaagaaccccgaggaggtgagagtgagaccctgcgccctcctcactcactcaggttccagccacaacagtgaatttattttgttttttatctgtttggcttatcacatctgaatgcaaaatatgcagcataaaatgaatgaaaattgagaccccagtgatggttagagaattctcgtatcatgaactaaaagtgaacttctttccaagaaacaggggaccttcgttttgctccccaatgtacacactgtgctggggtctgaagtaaacaaggcaggagctcagctccatcccagggccctcaccctccactgctccctgagtgtggtttaaaaagaggaacaaggacctccacaaagtcagcttcacattcagcaggtggacagcagaatcaaatctctgcaaagaaacagcctatgagtgtgtgcagctgctcacaggcctaaattataatttccaggtggggccagcgagttgctgcaggggtggctttctgcagaaaaaatgaggggtggctgaactggattccacaggccctagccacacagagcatcatgcacctgaactgggggtcttaggggactcctcttgggcacacgacatccctttgctgcctcctttccacagggaccctgcgctgggaacttgcagcacgtcgctgagacaccagaatctggggaaattctgcctgtccccaacctctcgctctggctgattttgccatctaatttgtagccttgcatgtacataattcctatttgtacagaaaaacaatcaaaggtggaactagatcgtctgatctcaactccagaatgtgggctttattgctgccctgtaacctggggctgctactctgccctgatgatggacacagggttcccggaagctcagggcccgaagagagtccagctgggcagtcgcacatgacagacagggtgcggcagccaatggccctccgtgctcactgtcaacccggccagcagaggccatgcataggtggccaggtgcgactacctgtgttccagcaagtagatggaaaaggaacactgtcgctttctcagggctgacttccaaattggggggaggaggagtgggtggttaagggcatctaggaggtgggtggcaagggagtgcccccgcagaaaaggaggaagaagctctaagcccttgatgagtcagagctgaaattagtaacattggggttgccactactctttcaaaatttaagtcttttataaaagagccccaggctttctggaaacaggtggtcagattgaaataaaaatgatggctatggggccagtctcctcctaccaccagcaaaagccaaaagtgaatttatgtttcacagccagtgtggagaaagcgtctgctcaacagctcaacaggaaaccacggtgcattccagggcccctcctggggttcctttgctcattttcacataaagaaagaaaaaggatgggaagtattaatctgcagcactaagtatgcacttttgtgagcacttgttctaaattattgccattacatatccacactggaattgaaaaataacccagctcaattcatcggccaaagacacccagcctccatggtcagagtatcttctatgcccgacaggagggactgtacccttagaattgaaatcagttgaaatcagtcatgcttcatggaaggctgcataaacaatgtcattctacccttaggtattttaccctcattaagtcgcagaaaataagagcctaaagggaaactgggaaattgaactttcagcttttactatcagctccaatagagactgttggtagaaatgggcgcacatcacctgtgtctccagcatctctgcatgaaaaacagagcgtggtctatcagtcttacagaagactctcacccagtgctttggcccaaacaaatcagatttgttggaaacattttcaaaatttctaactcctagatttgatatacaacataaactaaactgtggcatgaacagaatggagagagacttgggatcttaccgggagacaagatcatacccaccaacccaacaaatgaggccacaggcatgcaagtgagatacacagaaaacaagaacaggaagggccagaggaagaagggcccctgggcagcttgattggggtgctcagaggaggaggcaagggaactggggggaatacagacggtgctgtggagagggcattcaaggtgaaataaaacagctcaagcaaagacacaggggctggaattggcaagcatcatcgggatgataaagactaaatctatttgattagagcagccttctggttttgcttcttttgttgttttgcttatactttttgcttaaaacttggacatagtgggaaatagaatcagaacagtaaattactagttcctacatcagtaggctttgaggagcaagaacctactaaacgctgataagaatcagtcattagggtctggcagatacagcatccacgtaagattaagttcacagattcccagtgtgaactccgtgtcagactctgctttaggaggagacagatcctatttcagggctgggcacacctaaagatggagcctggcgaggagcatgacttagggtgagaaccatgccatcagcctgccccagaagaatccagacatgcagcagcacaattgaaatcctcattgaggacttcaggtcgttgcactgtactatacaggggattcgtgtggaatgagttgattgctgctgctcttgccccacaacacacacacgcacgtgcataactgaaagcacgtctatgttaatgggctttcctgcagtaaccttcttactatctctactcatttcccgttgcatcatgtataccttaaacatacacaataaaactcattttaaaaaattaaaaaaaaaacctcattgaggcagtgagtataatcaacactaacggataagtgatggccccaggcaaagagcataaataagggaacggaagagatcatcaaagacacgacttagagtaaggccttgctggatttaaaaacagattaaaaccaacccacacaaacctttgcaagtaaaatggatctgcctgccatgtcacagtcaatgaagagtcaaatctgagcattatttaattacaagcatcacaaaagcagaaaaacaggttgtctcggtctgactttagaattctcttctacatattaaatgccagaagatgccagagagcaatgttcactgagcatcaggtacaaaaaggttgcagcccaggcatttcacagtcgcccaggcactcttcatagatgcaggtgatggaaaaggccagcgtgcaaggactcagcaaacacaccctccacgggaggccctgggggcacctcggaaagatgttaccatcattcaacgcgaccaacagtgccacactggagtgccttctgggatgagcagaatgcctttagaccagtcacagtgtggctgcttccgtccaaatggcgctcggcatgggcatggtttgatgtgtgccccccacccctgaaaaaagacgtgttgcatgtcttgacttggaaacatgtgacttgacttggaaacaggatcactgcaaatgtgattagttaaaacgagatcacagaggaggcgagtggccctaatccaagatgactggatgaccacctaatccaagatgacttctaaaaaggccactggaaagcagacacacaccaagaaggcggccctgagatgatggaggcagccaaggagtgcctggggccaccagaaaccagaaggggcaaggaaggatcctcccagggcgttggagagagcttggtcttgcccaggtatagtctcggaaatccaccctccaggactgtgagagcataaactcctgtcggttaatcccacctgttcgaggtagtttcttacagtagccccagaaaactaacccagcatttagtttttactaaaatctcatcagtgtacccaccatggccaccttcaagcctgtgtgtattacacactgagttccacaagacagaaggctgtggacaacagcccccaaacccaagccggcccacactgatggcactggctgggcccactgtacctgcagaagacagaagcatctgcaatacagaaatcactcagagcttagacaatgagaaaatgatggacgttctgtttaaaaaataatcaccagccagggcgcagcagtgaaccagaaagttctcagaagtcctgaaaagtgggcaagagatgggcctggcttgtagagaaagtgacttcaccaaataccagcagaaagagaaagacttctcgagggaactagagagtcacatattataaatagtagcgagggtcatggagaaatcaacaggataatgaattctctgctctatgtggagtcctggcctgctgagagcttctgatgggtgcacctcagattaaaaccagggaactcacctgcggggaagagggccccggtgtggtgctgtgaggggctgacaagcccggcctgtcctctggatttacaggggactacttattcacccaatctatgggctaggcagaatctgtgaatctcactttacataagggaactaggaggtgagaacttactagttattcttataactaataagtgaggagctggaatgtgaacccagaagcccagagtcagtgttggtgaccattctgctgtaatgcctgatacgtgaggggaagaaatcagaatgtgaatcagcgcctgtccttatatcaggcccggattgatgagagggacagaagcacagaaagggacgggggagggcaggcagggcagccaccgcacagaactgtactacagcgcttcacttccaggagagcactcctacctgcccacctgcggtctgcccttacattctacagggcaacggctcttggctatgtctactgtgactcaaagaacaggccttcggggaaacagatcatgccagcgatctatcctaattatattcctaattatattccttatgaatcaataacaaaaggatcattagacatcggagaccaaaaacatcagcacaaaaggttgaaggaaagtatgtttgaaactcgaattcaacatcaagctgagacagttctcacaggaacaggacaaacagacgtgttagtcactcaagacctcagagctcaccactgatgcaacctcgacagacaccagtgagcaaaagagcagttcaggagaaaggcgcaggacacagcagaaagaagctttccgatgcagtgtgagcaccaaagaaggcggcatgaagtcaaaggagaattcaggggcccttaaatcccaatcaaatccccaacatatacttttggattctaagcgtttggaagaaaaattctttataggtaataccagagctaaaagagaaacagaacagaatacaacagaacaaaatagaatagaatgaaatagaagagaatggaatggaatggaatagaataaaacagaaaagaagactatataaaaacagaacatttgacaaaagtagtatttcagattgtgggtaaatagctagttctaaaaccatatgctggctcacactacagtcaactggaattattgtgatcaagtgttaacagagtaaaattataatatagccagcacagtacaggcaaccaggtccacaaatctcagaatggtatcgatttttcttatgcaggtacaacagcaaagagataatttataaaggaaataatttatagatttggttacattaaaattgacgtgcgtcaaaacattccattaaaaaatgtaaacacaaactggttttcggaaaaaaaaaacttgcaaaaggcaagagctcttaatatataaagagctcttacgaatcagtaaggaagacaaatagttcaattaaaatggcaaaagatctaaacaggtgattaacacaatcaataaacatatgaacaaacttcaaactcactaatacttaaaatgtatatttttaatgtgtcaaacttctataaatgataaaatgatatcaaaaattctgagaatataggagagtaaaaatctcagataactcaggtaacactatcacaaatgtaaatgcacagaactattctgttcatgccattgacctaacaattccattcccgacaatttaccctaagagaataaaagtgcacggacaattctgtgttcaagaccgttcatcataggggttttagtaatataaaaatcgaaatgaatttaatattaaaatatatgattaactaaatacagcttactttatttgatgtgtgaccattatacttgtatgtgtggaatatttaatggtggcggtaaaattctgaaaatgtcttggtaagtgatatgaaacagtttctagaaggtgattcaaatttttaaagaactgcacatatgtatacatgaagaaagaatcagaggaaatcaaaaatttaacaagggtcattctaaagtagaaaatgttaaataatttgagtttttaaaaatttatttccctcataattttcacaataaaatgtgttattttagtaagcagatcaaatatcttattaaaaaaattgtcacgtgaaaaaacaaaacaaaaaacttgtctgtccaaacacattttcttttttttttcttttttgagacggagtctcgctctgtcgcccaggctggagtgcagtggcgcaatctcggctcactgcaagctctgcctcccgggttcacgccattctcctgcctcagcctccccagtagctgggactacaggcgcctgccacgatgcccagctaattttttgtatttttagtagagacggagcttcactgtgttagccaggatggtctcgatctcctgacctcgtgatccgcccgcctcggcctcccaaagtgctgggattacaggcgtgagccactgcgcccagcccaaacacacagatttttcaaagatctgtcctaaactatcactttcatagtgcttttctgctataaggttctcagaacaccaaagttctttccatccagtatttactgagatgcaaagaaacaaaagaagtaaaaagataaaagaggcaaaataacataatggaaggagatctggaaactgggtctgggattctaacattagtcttgaaattaactggttctgtgacctaagccaaagttcttggtcttggttttctcacccaaataaacaaagaagttgaaatgaataatttttttttgtttttttttgagacagagtctcattctgtcatccaggctggagtgtgatggcaggatctcagctcactgcaacctctacctcccaagttcaagcgattttcatgtttcagcctcctgagtagctgggattacaggcacataccaccacgtccggctaatgttttgtattttagtagagactgggtttcgtcatgctggccacgctggtctcgaactcctgacctcaagtgatctgcctgcctcggcctcccaaagtgttgggattacaggcatgagccaccgtgcccagccaaaacgaataaactttgaatgcaattttgtaccctaaagctctatgatgctatttcataattcccaaaaagccaagttcaacgacagcaaagctgcccagggaagcggttgtatcctccacccgcacagactgcggctgtccactgggacttcaatccccagatatgcttgtgattggaagccctttttcctctctgaaatttcaaaaggtgctgcagtcacagctggttctattttgccactgacaggcagacacatatttttatgcattagtaaccttaggaatctcagcccctcagtgatgtgagtcaaacaaacacatttcatgtttctaaggagagaatccagtctaatgttaaatgatcttaaggaagtcattctgtccttacatgatctaccagtcaaggaagacaggcagaaagatataaaagaataaggatgggtacacataaaactacttggaggaaaactcccttcaatgtattaccaataaaggaatggggttccctcatcagtcagtcctgagccaagcaaatccaagcctggtcagaggccaagacctctgaaagagaatggcttttagaacttattgtaatagtatccaaccagttttttaaagcttaaaataagatacacaaggtttggatatggaaatctttgaagagtcattggtatcttatctcacagaaagggaaaggctttcaatgggtttaaaatatgtgacttgcactgtgatgccaggcaaactgcactcactagagttgatgtgcaggaggtttggaaggcggggcggcctccagacaggggtcacaggccatggggaagataggcggtaaggtccacgtgatgatcaaggaaggaggtcggtttgagtttatggtcaataatactctgtgtgatgattaatactgactgtcaactttactggattgaaggatgcaaagtattgttcctgggtgtgtctgtgagggtgctgccgaaggaggttaacattcaactcggtgaactgggagaggcagacccaccctcaatctgggtgggcaccatctcatcagctgccagtgaagctagaataaagcaggcaggagaagatggaagagcagacttgctgagtcttctggtcttcatctttctcctgtactagatgcctcctaccctcgatcatcagactccaagttcttcagtctttggaatctaagacttacaccagtggtttgccaggggctctcgggccttcgctcacagactgaaggctgcactgtagtcttccctaattttgaggttttgggactcagactgatccaccactggcttccttgctcctcaacttgcagatggcctatagtgggactttaccttgtgatggtgtgagtcaattctccttaataaactccctttcacatatacatctatcctattagtcctgtccctctacagaaccctgactaatacactctgtgaggaaacactgggcctgaatatgggagacaaacagggtggggggtttccaccactgaaatctttactgtgggaccagcagagctgtcccaccgtggatggacaagctatgtaggggtgagggggatttcgaggggactgtggtgattcaccacagatgcgccagttgggagctgcagagagaggcctgggtgatgggcacatgtgatgtcaggcacagtcatgggaacagatggagaaaggacacggggaggggccacagatgctgagaaccagcccatggtgttcacccacgaaaacgagaccaagtgagatggagagaaaggaaaagaaacaagatagtgcacgccatgggaggcaagagaggggcacaggtggctggggacataggctacgggataagtcgaaagaatggagtctctagagggcagagctggtggcgaggcaccccgtgaggccccaaaggacacagcccccgaggacgaatgggactcaacaggtggagacagctcatctctgaggaggtggcagtcactgaagggagaaaaaaaggacaagagacaaatgtgaagccaacacctggcagccaggccatgggggccatttgagcatctctacaggacacagagctggggaaaaggacggcagtggagcgggtgctgggctgcagggtggaggaggaactggcttcagaaggaggaagagcatctcttcttctgggaaaaaaggtaggaggattggaataaagatagaggagacatttaacacataaagaaaacgtaagccattttggaaacaatcgttctggaatgcaatgatcatggagctgataacatgcaagattgcagctctaatagacactgtaggcaagccaaaattttcatgaatttttcatggatttaactagtagcctcaaaatgaccatttcatattattaaacatcaagagacaagaaatatccaatgggtgacggcatcatcgagaagagaatagaaacagatttccggagtccacgggctggtgagatgctctagagagcaggactctgctctctggtgtgccagccccagccgggcaccgtgctattgttggttttcatcacccagttcctgtcagaaccactgcagtcatgccacagacagagcttttgtgcaaatggtattttcttccctattaaaatgttctactctgttcccatctaaatgggtccaggagcagtcccagagacacctgcaaattgcacagaggcatggtttgatttcacatgctcctgatgaccataattgttgctattattttccttactatttcacctctcaggcagaaagtaaacaaaacacttctcaggagagagcggggagaaaggaagagaagacattgtggggccaaattggagcacaggacggcatttgttgaaccgttctgatttcctttgatgctttccctccctgctgttcaggataatgccttgttctcctccctaacttggtgtggaaggaatccctccaaaaggcaatgggggcagacagaccacgcttttattttcttataggcatttatgttcttacaggaatggtttagagaggcttatggatgaattaaatggtttgcaaaattaagactggattctctaccaagtagataggcagggacaataaaggaataaaaagccacatttggagctaatggcattgcaaaaccaattctggatggagaagttggaatcagatgaccctctgaacttgaagacatttggtgaaacagcctggagtctgcccatcatgcactgagtcacgggtggttggtgtgggtagacgctctaaacattttggctctaagcgcctctgtttatacaacattctttcccgttgcgtcaggaataggaagcctgttttctctgagataatggagtcaggaagagaaatcatgtcccaactctggtagattttgtggcagtccaggaaacaacaaggcttttctttgtataagcacacagcaccgctctttcctacctcccttctttcctgcctccatccttgtattccacagctgatcaggactcagctcatccccatcagacacggctcactctcaagtggtcctccaggtggggttgaaacagtggggtgtccgatgcccaggcagggcccagcccggcctgtctcaggggttactgctgcttgtccaggtctgtaactattgtcccaggttcggtgatcaaaatctctccagataaatttcatcctaagaaataattaaagaatccagagcaggagtcacctggtgcgtgccatatgtaaacaaccactcttgaggatgtttgaagaagcactggattggtatcaaggactgaaagcaggtagaggtttttagaaaggtaaattctgctaactacagacagggagattggaaattagcttgacaacgtcttagggaggaagcagtgatcaacaataatcaggagagtcatatgaaatatgtgctgatttccttctctcctctgatgaggttaccagatgggtaggtgtggggaaaatggtaaacagtgtctctggttttcaggaagaatttaacaaggttttctcattatatacaccgaataaaatgaagaaatgatgactggcagattaatagctgcctcaaccaaagggaagtaattaagcaatccatgtcaaccaagaaggcagttctgagggcaccctcctggctagctccattcagccttctcattagcgccaggggaagcacgaagcttcatgacacggggaagacagcaggtcacttgcaggatgatgggatatgtatctctaaaaataccaaccaacagacgcatgaatttaagaacaaaataagagacataaatgcaacatcttactcttattaaacaaaaaacaaataagctgtagggggaggggccagattagcaggagtgttagcccaatatgcgctcagtaatgtgaggatcgtgttaagtgctgggagaaacgacacaggcttctgtgtgcatcttcccaaggcaggtctccttcccactccatctccatcctccatgcgtcactctcaaggcctagagcagaagccaccatctccctgagccctgcctgatcacctccctagagtagctccttccgtcatgatccaagggacacccagcctcccctcctccgtatatgggtgagggtggtaagtttgtttgtttgtttgtttgtttgttttgagacagagtcttgctccatagctgaggctggagtgcagtggtgccatcatagctcactgcagcctcgaactcttgggcccaaacaatcctcctgcctcagcttcccaaataggtgcacctactataggtgcaccaccacgcctggctaatttatttttgtttttagtacagacaaggtctcactatgtttcccagaccagtctcaggagctcacgtgatcttctggcctcagcctcccaacatgctgggatgacaggcacgagccatcatgcctggccaaggttactgtttggcatctggcttcccaagtggaccatgggctccaagggcagagacgatgtctgtcttattctcagatgtttagccaggcaatgcctggcaccttgtagaaactcaatcaaggcttgctcagtgaagataaatgaatgagtcaccaccatcagatgtgattttcttccgatctaaattcacctggtttccctgtttgacacactgtcttgggaatttggaaatatcccttattcctgatgggttttgagatcctttagtgcaggaagtccacctgattatctttgaataagaacctacgagagtctaaaaactggttgcataaacaaatgggagaagaaaacactaattcttttaacatacaagttgttgcacttgccctattttcaggactaaataatatagctgcatgtagcgtatttgaagtaaaatgaaatttcagatgtgtagaaatcagtgaaagaagctcattgcacaaagtgaatagaaatggaaaatggaatatgcatgcattttgaaattggtcttatcaaaatcagtaggaaattaaattttaaactcagtcattcttattatattatccctattgaaattcatcttgcttttgcctgtaggcagggagcaatttattaaaatactctgcatatccaatatttcttaaacaaacaaacaaaatctcttatactcagctcaaaaagatggtgacagatgaaggaagaattagaagtgttaaaaaaagaagaaaaagaaaaaacaactaaccacgtggcctatcttagaacctgactgatgattccattcagataatatttcttgggcacccacaggccacaagccacatgacattagatagagaaaatgatagaaatcaagccatatttctctacttgcaagcaagttatatactagcagatacatacaatacacaaaatgctcttaaatccaaataaatcacattttcatgatgcaaatactgacagcttaaatcgacatagcactccattggttacaaagcacttctacctaaaacatcttatttaatttgaaagtaagttaatctagttaggttaaagagttgtgtcaatcgcaagttgtctccaaaagctacctggagcataaagaaccaagaagagctacgacaatattgagaaaacccgataagataaaggtaggagagacttgctgtattagctatcaagacttcttttaaactgatggttaataggacagtgtggttttgacataggttagacacatgaaacagaatagagccagaaatactccatccttatagggaattgtgtgaattcagaagtgcttgcaggtaaatggagaaaggatgaacaacacaataaggggcactaaaaaaattggttatcttatttaaaaagcagaaaacaaaactagttccattctttacactacacaaagaatgcaagtcattaaagaccaaagcgttaaaattaaaactttaaaaattttagataacagatcacttttacaacttcagagtgaggatagacttcttaattaagacacagaaagcatataatgtaaagaaaaggatgaatcaattcagctgcataaaaatttaaaacttctgtataaaaaagtttaaaagattggccacaaacttgatagcatttacaatgcatgtaactgatgaagagttattatacagaatatgtaaagaactcttataaattaactaaaagaggcagagaaaaggagaacaggaacactgtatagatggggaacgcaaagagaactatcaatgcccctgacatgtgaagggagtctgaccacactggccatcgggcagtgcgtgttccggccacggtgggacaccatctcacacacagccgatgggctgcgactcagtgcctgatgtcctaccaacagcaaggagggagagaatgagaactcacatctactgttggtgggaatgcatcttatacgacgactttggaggaaatttggtaacatttactatagttgaagatcgtgtgctccatgacccagcaatctcactcccaggtatatacccgagagaacctcccccaacacctgcccctacggtgctcaagggatggatgcacaagatcattcatggcagcactgctctcagaaacaccagaaggaaacaacaagcatccagccccagggcaactgacacaggactgttggcacagtcagatgaaataccacgcagaagcaaacataggaaccaagcgctacccatcagcatggatacagctcatgaatgcaacctggaacaagacgcattcatgcatacacgagatgactccatttatatgacacgtaaactgcaaaaaacaatacagtgtttaggatacacacaataaaacaggaagaaatatacaggagtggtagacctcaaatccagggaaatcgtagcctccaggtgggagggagaaggatgagactgggggaccataaatggtgttcaactgtatcgataacttcttgatttcttaagctgaatttatgggtgcaaaggtgtttcttaacagtattttgattcctaaatatgtctgaaatatttcctaagacaaatttgaaaagggctcaagtcaatatttctgttcactgagtagaggaagttttctgcaagccaatggtctatccacagtgagaatctggagagagagagaggtgttggtcaggggcacctaggaacccattctgctttcaccctctggatgagttcattcaaagactaagagacctaaacatttggaaatgtaaacattcacttacatctgcatctgttaagtgttaagttctgacatgagcttagtctaaaagggatctgggcgggatatcaagaaccaaacatcacagatccagaaagagccttccctctgctacttccctgtctgcggtctctgcgtgacacaagttatggtttctaagggacagggaagcttggctgagatcactgcacctgctctcggcttgtgtgggccatggctctttcaaaaaagatcgtgctgcttagcataattaaaccaggaactcagcgcagcctcagagtgcgtggggtggggcagagctctgggaggccgagtggtgacttcctccagtccagcatccaccagccacacgggagatggtgtgggatgtgggatctgaaaggcttcatttggcctcataaatgggattagcatgggggcagctaccgaccagtcaccttctggagtcgagggcgcccaggtaaagggctttggcatggaagtgcaggttgctgaaggagtcatgggaggggacatgacagaagatgcttccacctgggcaacacctgtcattgggagggcatcgtgaacatggctggcacattccgggtgatctaaggctcaagttagacaaagttaacaggcacaggaaggatactgaatattgcgaggttgcagaagggaggccagggaatggctgtggcccaggtgtatcaaataaatgcccccgtactgttgtttgcgataacaagtcaggggtgttagaggagccaaagaccccctcagcacccaccaaacgggcaatcgaggttgttttaggcagaaactggattgccgcaaagctgacatgttggaaggggtgagatgagagctaagaacttctccaactcgtcctaacgtgtccctcctagaagtcacgaagagaaaagggcgagactatgaaacaaagtgtgtaaaggtggaaagaagtaaaaataaaattaagaagagttccatcctgattaaccctccatggaaaagctccagagaaggtgcctctgccaattgaaagtttttcactgtgagcaactctacgtaaaatgcatctggaccagcacattcccctgtggacagctctgcatggagatgtgacggggacaaatgatctgggaaatcattgttttcgtatcagtgtttgtaagtttcagagtttacttgaatgggaacataacagctcactaataaaaaatgaggaatgtcttactttttttaaaaaacgtttccccaaataggtttgcttatatgatctatttgggggtttggaatgagtatgtggaaaactgaaaaaaaaaaaattcagaaattaataaagacataaactccatgttttataatgcccagagtggtgcgtgcttccccgctggggtaactgaagttgccggagctgggttcactggggatcgtaagggagcttcccgggcggggccatccccagctgggggaggtggcatccaggcacctcatatgccgtgcctcgggccttacctgagcatcagagtttttaaaagtccttctgtcatgggcttgctgtaagaagtcaacataaatatggacagtgctcagaacatggggcgcctgatgtctggagcagcaaactgtgatcaaacactcatatttccacagcaaaataatgatccacactaatggaggtaaagaaggagaagactacgagccttcctcacccaacgcagacctaccagggctctgtgcgccagtgccacaggcatcccttgggtggtcacgtagcctaaaatacgaatgagactaaatatagggatgtgaaagttctgcttgacacttaaatgtgcttattaagacttaatccaattatattatcgggattgatatctataagtctctaatagacattcctatttaagttttaaaatatcatgcttcccacagctggcccctcaggccctcccgttccagggcttcactgcgaccacgtggcactcttcactgggaatatccctcttgcctctcctagaactgcctccaaccagattctggcgggagatgatgcaacctgcaaccaagtcacctgcacaggggccctggcccccaagggccttgggtgttgccagtagatccatgttcattttatcaacgacattctacccctctaaagccacattgtgtttgcaatctacaacaggtagatgacatcaagtcttacagcatttacaataatttcaagacaatgactcttatctccttaattagattacgagctccttaaaaggcatcccttgggtggtcacgtagcctaaaatacgaatgagactaaatatagggatgtgaaagttctgcttgatgcttaaatgtgcttattaagacttaatccaattatgttatcgggattgatatctataagtctctaatagacattcctatttaagttttaaaatatcatgcttcctatctaggcacgtaaaatgccatgtgacattagaacaaaaaattagcatgtagaatgattagcatgtgaaatatgatattagaacaataaattaacatgtagagtatgatttaatgtgaaagggccacgtgaggtggcattttagatagaaatgcactcacgcacacacacaagcacagatacacctccctccacacattcaactgagatctttcaaaggtgacatcaaaataaaaatagcacacaaattttatggaaaagagcaaatcaaaagattgttttctgtagtgataagacctgaaatgaaaacacatgaccagtggtggagacataaaggcattacgctgcccagaggcgcagcaaccaaaatagaaagctctttactttgcaggttgatgtgatttagcctaaggcactaaatcagcacctgttatcagatcacggtccttgggtcctgatttccttctgccagcaaagcaccttgatgagtgtctacaagagggcaaaggcagcataatgccgcccatggtaggactgcggggctgcacacattaggctctttgacgcttttattacagctacagcccaaggatgcagttccaactcctgcccttatgaaaataaaatggtgcacaccatacaagactatttaaatagaccagacttcagccatctgcaccccacttcttttgagacccacaaggtcggagtgcttgcacgagaggtaaaatgatttccctggaaacacgctcacctgtgcaccatgagagacccaaagctgaatagccctcttgccttccttgctcgattacacaagaaaagcaaaagcaaaaagcacctggcatggtgaatttaattctgcaaaaatatatcctgaatacaactccctattggaaatgtgaatatctaagcagcgttgtgtaggcctttcaaagcgactgcaaattatggtggaataatatggttaacacagaagttatggcatttttgctgtaaacaataccatcaagaaaatgaaaatacaacccactacggggaaaagtatttgcaaataatatgcctgagaaggcacttgtatctagaatatatacataattcttataactcaacaataaaaagataaatcacccaatttttaaaaatgggctagtgacctgatgtgacatttctccaaaaacatacagccaataaaaacatgagaagatgctctacatcatttgtcatcagaggaatgcaaatcaaaaccataaggaggcaccacttcatacccaccaggatggctgtattcaaaaggtgaacaataacaagtggggaaaaaatggatctcggctgggcatggtggctcacgcctgtaatcccagtactttgggaggccaagatgggcagatcacctgaggtcaggagtttgagaccagccttgaccaacagggtgaaatcctgtctctactaaaaatgcaaaaagtagctgggtgtgctggcaggtgcctataatcccagctactagggagactgaggcagaagaattgcttgaacccgggatgcagaggttgcagtgagccgagattgtgccattgcactccagcctgggcaacaagaggaaaactccgtcaaaaaaaaaaaaaaaaaaagctccatctatcactgctgggtgggaatgtacaatgttgcaatcactttggaaaatggtctagaagttcctcaaaagctcagacatagagttgccatcccagatccagcaattccactcccaggtataaacccaggagaaataaaaacatatgtccacacaaaaacctgtacaaaaatgttcacagcaccattagtcacaacagccaaaaagtagggacaacccaaatgtctatcaacttactaatggattaaaaaaatgtagtatatccatgcagtggaatattacttggcaatagagagaaatacctgctacaacacgaacgaaccttgaatacatgaggctaagtgaaagaagccagccacaaaaccccacattgtatgattccgtttatatgaaatacccagaataggcaactctacggagacagaaagtggatgtagggctgcagggggtcgtggaggggaaaagggggacagggttctgttctgaaggacgaaaacattacagatgtggtaacagttgcacaaccttgtgaatacacttaaaacatggaattgtacattttaaatgggtgaattgtatggtatgtgaattagatctcaaagctgtatgcaaaaacagaaacaaaatgttatggcattcagggcaatttgaagcaaaacaaatactgagatggttcttcagaagggactttcctttagccgggcaccaggtggcatgtacctgtggtcccagctattcaggaggctgaggcaggaggatcacttaagcccaggaggtggaagcagcagtgagccatgatcgtgcccctgcacttctgccagagcgagaaggcaaaaccttgtctcagaaagaaaaaaaaaaaaaagagagagagagactgtcttggtgccttttattatagtgcatcttgaagaatggaggggagtgccttcttccacacatctagctttcattctgagtccatactcaggacagatttggaatttttcacaaagactcccaggaggcaatggcttagtgtatgataagtaatttcctcaggatatttgcttcctggcaacaaaataaaatttagaatgcaaacaatatggtatattttgaaacagagtcccccagagggtagacaacgcttctcttagccactgtatagaacagtctagaagttggataaccttatttgtatggtagtaaccaatatctctatattcatgtgaattcaatccaatttggtgctacaaaaattaaaaatgcttgactcaaaattcttacatctaacctgactcaacaatccatcggcgcatgaaaaaaaaaattcccctttaagaatttctagttattgaattcaggattgtttatctctgagagggagacaaaatcagaagtaagtttggagtctcagggaaaacataacaagttgattattgtttaagtctaaaaggcaccaaagcacttgtccctgggtaccactcagatgcaggcaacattcagttaaagtgcctcatggctttttttcctatgaggcctacagaatggtccctcacaagttttctatttctgttctgcttcaaagaaagactttctcaacttttttagggctccagtcctggcccatcgtggatggtgagatattctttagatgtttgttctgtttttttttaagttgatatatatttaggcccaaagtcatgtttattcacaaatccaaacaaccggcaagctaaggctaattttttcatgtagaatatttatgaaagaaaacaatgaataaacaacttaagattggggatttactctgaagggcactttccggaacatgtcataggctcagccccagttcaaccccatctccactgcggtttggaaaattgtcaggcctgagagagagcaaggggttctgtttactccactctaggattaaggaatggaaatatagggagagccaagtaaggaggttgtgactcagttcctccccctggataaatgtctgcacagactttagacttctggttttcaaactggggttcaataggaccctgagttcagtggagtgggaggtactacagagatgaagcagatgcccctaaaaagtggctctttctgcataagatgtttaaaaaactgggttccgggtgtgagataaatggcagaaccttgatttagatctactttcggggttgttacagaaagatctgttgggctgtctggggtgagattagatgattctcattatttttctatggttaaaattgctatagctaccatggtgtattgcaaagtttggtacttatatcaatgactcaggagcactgagacactgatatactgaattatcaaaagtttaattttttttttttttttttgagacagagttttgctcttgttgcccaggctggagtgcagtcttggctcaccgtaatctccgcctcctgggttcaagcaattctcctgactcggcctcctgagtagctgggattacaggcgcatgccaccactcccagctaatttttgtatttttagtagagacggggcttcaccatgttggtcaggctggtctcgaactcctgacctcagctgatctgcccgcctcgtcctcctaaagtgctgagattacaggcgtgagccaccgtgcctggcgtaaaagtttaattttatttagacaagttttagtgtcaagtatattttattaatctgtaattactcgaaaatgggaaatttacaaactggaatactcaggcaattggaaaacatctccctacacttatttgaagatttaaaaaatgtattagcttcggactagttattcttgttctcttttacatatttttctaatcattcctactcattttctcatcttgatttttttctctcctcctatctcctcattatatctcttgctatttagttcaacatgagatcttttacaaccaaatagcttgctagaaacagcaatgcttcatggtaaacagcgtgagggaaagatgttctgaaatggttatataagcacgtgtggcatcaactacaacgtgaggcacgtcatttgatcaatgtataaatagcaagtcgtaaatgattctttccactcctgagcagcctggcagtagcacagaaggtaaatgcaaatggccttccgctcctttcccgtgaataaggagataatcccaccaacataggccttggcagcaggaagcgcagcaggaaattcatgtgaatttctgaattctgagagaactagttacccatcggctgtagcaaaaatcaagaacaaaattcaaaggaaagaattcatgatggttaatacagataaaacctatgcaactgggttacacacttcatgaggccaaacacttaaatatgcatttagcataaaatgtgtttctgccgagggccatggaggcctccaaaaatgctactttcacccagggcccctcaggagtctttaccttctccgttgtttcctatattaataacaaattccttctactaatttatcaaaacataatcactgcagttaaaaggcagcgctgccaaatatttgaccataaaatcatatggaaagtagtggtaaagaaataatgttaccatgttttcataaaattcatcctaccaacaaatatatgcatatacaattattacatttattatagagttataacagaatagtttttaaaactggaaagccacatgtaataaataatatacctttcctaaaatcagtacttatttctgtctttcttttttgaatcctcacttctttaaattactatctgcatattctggattttagcctgggagagtattatgagaatgagaagtacaaagaaaaagaacaaaagtatccttaaacctactaaataccctgaaaggataaaaagaatgattgcagacagataatatatttatttttttcaacgaatgaaataaatttaatcctatttatcccagtttactatctcaaatagactggtaaaactgaaaaagcatttctactatgttttgaagcaaatttaaaagtattattatattttccaaatatacatcctattaagacatgcccatatttttcacatatagccatttagcataatttcaacaagtccaaagctgctaaatataccatatgtgcccatttattctaatgaaccaataacacaaatacattaccagattcatgcccctctgctcagaaagtatcactagcctgtagctgctgaaaagctgttccatctcagtcacccactccaccatcatccgacatgacctatcctgctcctggccagaggaccttttcaacattggattccaattcctcatctaggcaaaaggtatataacatacttatcctcaggcaagcttcttgtacagagtgaatgagataaaatatgtgtgtcacaacgcctttatctgtgtcagagaaaatccaaatcaaactggcttaaacaatgaaagaaattgcttggctcatataactgaaatatctcaaggtaatgtggacttcaagctcaggctgatcagggctccaatctcatttctctgtggatttcccagctctttcctctcgtgtgttggcaccatccttaagctgggtaacttatggtcacagatggctgcaaaaccgcaagtcaggactccacgtttccatgtttctccacagccactgggcagggatctcaggttacatcctatttgaccatcttgggccacattctcaaccctgagctcatccctgtgaccaggaaagtgccatgggtagggcacacacgcccaggatgcagatctccctggggccaaacaaacttaaaaacaaaaagtttctctaaaaacaaggtaggcttggctttctccaactgcctcatcctctaattgcacagaagaaatactgtgaatgaataaggcatccaacccattctccaacacccctttcccaggcctgtttgttctttttcctcttatttttcctccgtcgtccaacatcaagatgcaagggccgcaatctgagtgtgagggccagggaactcactgaccatctgggggggctctaggaaaagcctggaagagactctctgtgggaagctcaggggagtcaagccccttgacgaggtgtgtgatgtgggcaggtgtgatggaagaaaagagactgggacttgtcctttctggcttctcagtggtctgctcagagacgtttatcctccttgcagctggtgcatgagtgaaactctgaatttgtagttttccttaggagaaagatggcatgcacccctgggtcacctggcaaagctataacacacggtggctcctgcagacccctggctcccctcgcgggcttgcaaccaggcactcttcctctctccctccatgacagaccagggcgaggaaaggagaaatgatgagctctgagctggggccttgctgcccgactgcctccactaatcctgctcatctgaccgaggtcagacactgctttgcagagcccgtgggctgtgctccatttatcactctgtccgggcgtctgttgttacccatgctcgggtaggaaaatgctgagtgaaggtaacaggactgtgcagttgggaagctcatctcctcttacatttggatgttttcccaagtggccactgccaaatttactccacatcagcctctctctctccatgcccttgacctgtcctcctccctctggccctgcgcactacgtcccacttgtttcttgactcttctccactcttccccttctcttgtctttcttcttcctgcctcttctctcccctctcctcctgccctttaattattgtttaaaagacagatgcttgagcagtgtttcccggacctcccagagaaagctgacccagaggacacggagctatccatttgggtggacttttcagggcctttccctgtatttcaagtccttagttaaaagcacgtgtctgaattttctaagttaaggggggaggtttgatttagtgatcagaaaaatttccagtcctgaaacatgcctgcttttacctggaatccttcactttcagtggcatttgcagtttgacatgaatgcttccggtgctgcatttcatagacctgctgatttgtagctcagcctgtcgccaccattcaggcggctggggtgcaagagctaggagcagtgctgctgaaagtctttaagacttcagtgaagcaaacagattgcagtataacgagaaacatggagttttttcaaaacaattttgtctactgctgaaatttgcaaaacacgtcaccgaaggagtctcaggttgatcctgtacagaggagagctctgacctgcctcactaacccacaccctgagctactcaccctgcttcacggtcacgcctgtttctaaaaggtagctcaggctgaagatctaggagtcatctttgatttttctgtcatgtatagtgtgtccaggctatctgcaaggcctgtccaccctggtgtcggatggcagctccgagagcttgctagctcagtttcttctctgccagccttcaatctaattgcacgcatcacccaaaggatccttttaaattgagatatgatcccatcactcccttatgtgaaacattagggctttccacggccttcaggacacagtcgggctttccacggccttcaggacacagtcgggcttttcacggccttcaggacacagtcgggctttccacggccttcaggacacagtcgggctttccacggccttcaggacacagtcgggctttccatggccttcaggacacagattcctccccaaggccccaagagctttgggctctcacagcccaccccatcttccccgtctttctggggacactgacttctggcaggtgccagatgaggccaaagcccagtcagctcaggaaccaggcttgagccacatctcccccagaaactctgccccacaccctctaggggccaatcacctctttcattcagccctgcggagatgtctccctggactgccctctcaaacactgtcctcctctgccactcatggctccctgccatgccttacaatttgtgtatgtttgagatcagtacatttttctatgtagacttgatttgtagacagatatagatgcagccgagcttcctacgcctgtcggaggctgaacatctggctctggaatgccatgtggacatctagtgaacacctcgagccctctatcgtaatacctcgagcccccattcccagaaggacactgggacacagctgtgctgcccggcccgcttcctacccaggccccgagggcaggtgttcaccttctgtgaccaggccctgccctgccctggcccctgcccgtgtccctcccacactgaggccacagccctgcctgcgtcctgtctgctgcatcttctacaacatgctatcttcctcaaagctgaactgaccagaatattcgctttgtcttgctgctgtgacaaattccacaaattcagtggtttgaaacacagggttttccctcccagttgtggagatcggaagttcgggatccattttgctggtgttggcaaggccggtccctccggtgactccatgtccagccctgggggccacctgcgttccttgctcctgacccttcctccacccctgtaacctctgcctccctgtcacaccctttcccgcttctgcaatcagacctcctctgcctcctctcacgaggactcttgtgattacatttagggcctccccagattatccaggaacatcacgccatctccaggtccttaacttgatcgcacctacaaagcccattttgccacatatgggaacagctccaggttccaggcttaggctgtggctttctcgaggagacattatccagccttccacacccaccaagaacaccaggggtctacacctgagcacctgcgtcagggctggatgtggggctcagccggatgaagcccaggtcccgactagtcctactttatttcctgccattgaaatcccagcaggatgtggccgcattgttcattagcaccttttttcagaagttcagttctgataattaacattccctctcagctgactcatctgactgggaaacaagcatagatagatgttccactgggggctgagccatgcgactcccgcaccacacaccagaaagaacatcgtgtctcacactcccaggctggccttccagccaccgtggactccctgtgcacagtattttggtcacaggtcacaaaagcaaaaaggaaacgtagaggaagaagatgtagaataaagggaggagtaagaaaagcatttctgaagatgattgaagatatcggaggggatgcctttttctttttaatgaaaggaagcagtggacaaaggccaggctgacctgcccagtcacatcggaaggacctgctgaccccctggggccccagagatgcccggcctttcccgcttgaaacacaaacctgcggcgcacaggccaacggtgcccacacaccgtgtgctcgctccgctcataccaggtaggaaacagcaaaagcaagagctgggtgcaggtgctggaatgagataccgatggtctccgggacctctctccttatccccgctctatcctgtcctggaccatcttgaacatcagagagggagagcacacccccccaggatgggcgctctgtcccctgtgctgcctgtggggtctagacaccattgaggacttgcccactcagcgcaggactcccgcccactctttgccctttgtgaacaaggggatggatctgctgcatttgggagacatctccctgcatacacaggcctcactgcagtcattctcattcaatggaattcagcctaaatgacgacgctttttagacacccaatccctgtaacagcagtccctgcgctaggcctctaccgtgtctcttgccgtaccctgccacccactgtgtgtgggtgcagggacgcagcctcagtggggagaaggtgccagtcagaccacaccccggctgacctgccatgccacctgagagccccccagcactctggagtttcatttattacgggtcagaccctgtaaggcagatgttatactaattttacagagaagaaaattgagcctcaagaagttcccattggtgaccttgccaaagtcatatgagtgccacatagcagagccagaattcacaacatgggggctacctccaaagccccaaccccgacgcatggatcacaggcaacagctcccctcaccagctgcaggagaaatcaccaccaccactaacgggacccgccctgctcaccagcagcagctctcatgcctgcctgaggccatgtcaaccgagtcgctcctgtccagcaacacgtgttcacatacatgacggtacagttgcggacagctccggtaggtgcatggcgcaccttctacagcctagggacagccaggctcaagagagggagatgaacatgcagaacccccgaccctgactccggaaaatggctccaaaggctctcagctgcaggtccatccttcccatccatcctccctctgccaggccagagcccaggcccacagctctgagctgcatgtgggtgtcaggccagctggggagcagggcctgatggccacatgtgggtgtggcaggatttttgccctagagacctgggctcacacaggggcagtgagcccactgtggtgcccatggggggctgcccagcaggagccacagtgctgacctagcccagagccaccaaggcccctgacaacaggtgcctgactctcctaatctaaggtgcgccaaggcccctaacacccaagaggaagaggaacaaatgaatgtgggagaaagaactgagcccagaaggttcatgggtccaggtacaggagagcccttgacagaagcccggctctgcctgacagaaggtgccgggcgcccgctccatcgtgggccgaaggcagtcacaggctggaatgtgcagagggaagtcattcatcacagaaactcagcgtcaggagtcaaagactttaaatctcactataaatctctatcagcaatgtcacgaaggccatcttcctagaataaaacctattctagaagcaacagcttttaaaacaaacatccttattgacttttcctgtttttctatttcttaaaaattaccagcattaatacatgtggaaatctgtgcattttaaaaaatgttgatagtttctcaatcttttaagatattttgttgcttttaaaaatttttaagtaatcaaagttgttcggggattttttcccaaaaatgttattgtaagataacactagatcagctatattgtgagcctagattagacattttttctacagaaaatttttcaaggccaaacagtagttagtaagaaacccaatgccagcaccacctcatgctgttatgtggttctctcgtggcttctgagtaatttgacttacgcgacggttttaatgacctcctcctccattggcgtcaggtaagcaccactttttgtctgcattttaaccctctacacccaagtcctactgataatttaggcacgtagtgaatagtcagtccatggctaattcctaagataaaatgtcctaaatgacctccaaggactttgtacatattaacctagaagctgcgaattacatggagaatggccacgcatggctcgggggcaacggtcccgcaacagccacagctgtctgtggctgccgagcaaacgccaagtccagcctgcggcaccttccttctgcacaagcttcaccagcatttttagcggcacagaccacaaatcagcccgaggttttctgtaaattcacacacagcaaagaagtattatggggtccaggctgatgacaccattggggagaacccgtgtgctctgtcccggatggctgagagaacgtgaagctctgcagactcggagcctggccatgcaaggggacctgtgattcaggacacttcttaaaactccagaatataccactgtgggtgaccaagccttgaaactccagaatgttcccaccatgggtggccaagccacatcacagggaagaaaccttcaatgtgctttctgtgcagcacactcctctcttctgtgatctgaacacgaaccaccacctctaggctaggactcagatgcagtgagctccactatacccacagtcacatacggacagtaacttctcttcccgaatcctgtctggatccaagtgtccctgggccagagtctccctaagagacagccctgagtccaagcccctgagaagctcagggccatgcaaagcaggaggcctgggtgtggaaggggtatgggtagggcctgagaatggactgaggggcagacagttcagggaagggaagatcactggggtagagaggtgacctggagggaggtcagcgtgggcaggggtgagaccaaggaaaagattgaccatcactagaagatcaggctcacaggcagtgagaggccttggctgagtgggaggtggagatagtaaaatgaaaacacgggcactactctataactcccatggcaattcgggcaaatgcccatcacctccgttacatccaagcttcgggagggtaggacgagcgtctcagacgtacatctcttctcctgcctcacgcacacagagtgattgtggccagctcattttagcaggtcacactcccttccctccatcagttgttgttctgctgtcatgagccttgacaccgcagtacgacgcgctcaggaagacatcaggacagaggtctagacgcttacaaccctgagagacacactggacgctgcgcgcaagagccctgtgcatatggactccgattgacgccatcagattcgcccacaagccctgtgcgtatgggctccaatcgatgccatcagattcgcgcaccagccctgtgcatatgggctcccatcgatgccatcagattcgcgcacgagccctgtgcgtatgggctcccatcgatgccatcagcaaagttttttcacttctttgttgggttgtactctacaaggacttgactgagtcacacatcatgatccatgcgttttctttgttaagatctagaaataagagacagacccaacctcatgctgtgtctcgggttctctggaatgaaggcagtcagctatagtcaccactttgattcccgcagcccgtctgttcagtccctgaagtgatgagaaaccaagaagaattcaagaagtcaaaggtgttctaaaaataaatgctcttttgaaagttgttttgtttgtctgtgtttctttccttcgctatgttcaaagtcaaccaatcaacagagttgctttaacaagttacaggcaagagggcttctcgtagcacctttgcaagcatagtgtagaacgcagcagtctctccagggcttgaccctgtgacagagagcccagggccccaggtgcctgcaggagctgacggccatgtggcctgaagtcttaaggctcgtggagggcctgcagagccccctgggcttcctgcctcctcccagccttgcccggctcccagcttttctcacacagagtcctctcaaagccatcttctctgctcctcttgtgttttacccacagttcagaacaagaggcttccttggtttttcaccctcagaaagattgtccacatgatattatggatgtaaaactatttggaagctaatatgatatctgaccttagttctagagaactagttgcaattatcctgggctgagagcattaaaattgggacctgtgcgagcttcttaagtagtcgctagggcatttctaccataaccattccaaaacaaagtcattcaaagtaaaatccccccactcctcctgttataaatttggcctcacagtttaatgagtaaaagctgcaagcccacaggcccttggcaggatgtgtggccaagatgtcttggtgcaaagaatgttaccgtgcacttcgagtgcagagactgctctccacagcaggccccaggcttgcattctggctaatgtccatctgaaaattcagattgtgaaactacagcatacgaatcattccacaggtatgaggcctgtttttcttatttgtcaatctcattcaagcctttcttttctttggcaacaggaggaaatacactggccaatacctaagtactaatctttgattcattttttaaaaatcttgctaatttcatacagaagacagaataactgaaagaagaaacaattcttttctctaaaaggctagataatttctaccagtgccttctcctttctcccaacagtccccactcagccattccttgtgggctgatgccagaaacagcgtggaaaacaagtctgttttccaagaggggctattaccacgaattatgtttaaaatgacagcatcaaagattaaaccatcattgtatataaacttaacatagctataacctaggaaaagctagtttcatggtgataatactaattagaaacagatgtgtattcaaaggggcaaggaaagaggctggcaggagagaaaaaacatttttcccccataatgtagtgcaagaacctttacagatatggtctcaccaaagtcagctttgtgcaacaccacggatgccaagtgcaagctgtcctgacaaggcacatttcactgatgaagcatttaataaattgcagataacccttattacagggttacccctattttgtagctggggagacaggtgctcagaaggattcagtggtttggcaagggagacagcaagaacactagggcagtgtgaggtggctgggagaaggggcagccggcaaggtcaggcacttcccacggcaggagactggcaccgagcaggggcaggagggaaacagggacaccacctgctccatgcctgcagaatcctacctccacggggcaaggcaagggcaaaccacccagcctggggagctttgcacaccaaggctcatagaggaagactggctagggagcattcgccgaatggaatcaggtagggctctcatatcagtagcattcttgggaacaccctctgactgatctccaggaacgcatgcaaatgactgcataacatatgcaaatgactgcataacaacaggtacacatcttggctggtcggaaacactgcttctggcctgcttggtaataaatcctaggtgtatggttacgcacatttgtcctccacgccctgatatgcaggtgcctccggcttccttgtagctgcaccattattttcccctagctaagcagttagcaggcaaggcttctcacgcagctgcaagtcagatgtgattaacagtatttcatatggaatatatttgtgtctgatccatttgcttgattaaatcacactgtagcttaacagcctatttgttgataatttttacttatttgaattcaatgtaatagcttttactagtgaaaatatatcagcaaacataaaacgctgagaaaatgcaacacaacctaattcagtgtaatcagaaataaaagcagagcattctagagaatgctgctagtcttagaccagctctgcttatttaataagcacagatccttggagcaaaaaaggtagagtatttctggctaagttactggttaccaactccacgtcatacaaagtaaactcatcctggtcccccatatcaaaggagcactctcctggcagctccctgaaggtccccaaggccgcacacatctctggttgacccgaacgttgccttcatcctgaagctacagccctaaagcctctttcctccccttccccttcacagccagcagccctggaagctgcctcagagagttcatacttctcccacccactattaaattgccacttctgagaaactatttgccccacatgtgagaaacagaatgaaattccaggtaaatggtaagtcagaggatgtgaacatagttccttttttatttaatgggcttccacttcattcttctacttctgaatgcatgaaaaatagtctgaacagtctttgctgtgctgggtgtggccaaagacagtcagcacgtgggtttacggaaaaggacgggcaaagcaaaaggggcaaaatctcactacgtttagttgtcttttcacatcgtttaaaaaaacaacaacactatttcggggatttttcctgaacgtaaagagagaaagtatgtaatgaaattccaagcataaggcatatcacagaaattgtgaccacaaataaggaattaagcttaatgtctttaaaatgagtatataaaggagcaaaaagaagaacaaattccaattcagtattcactaatatggactatttattgtggtttttttttggctgtcagaaaatccaataaaattaagataaacataatttctttgggagcatttattgagagtacctgaaaattatcttaattagaaatggttttcttggaaaccacccaagatctagaagaagagctcacctatcatgccccaagaataagccttagtggtaaactttccaggaagctttctttttatccatgactggagccaatattgttcctgatgcttgctaagagtcccttcacacttcctttattaggataccatgttttccttaaaagggatgagcaattaaaatgtctttatatgtacagatagatgaattctgatgatctgtgaccaccagaaatagaaataaattgacaattgatctaatcagaccatttaaatccaaagctgccaataatttcacagcacttataccctgatagcaagcttcttttgacttgtttgcctctattgttagacattaagctcactgagggcagggatcctatttttatgtcccagttgcttagcacaatgcacacagtatgtgctaaaatcttttgagtgtatgaacaattgagcaaatagataaataaaacgaaattctccttccactcagcagttcatcactagcaatatcccaggtagagtctcgcattttgtcttcctcattcactccctactgtctttcaggagaaatgccagttacagctgaaatagctcaaataataggtcaccaaagagaaccctctggctttggtaactccaaactaataactgcttcctaaatgaaatgactttgcatattgacacctttagcaagttggtggaagtcttgagttaataatctcacttttaattagtttaaatgtacattccctgttggaagaaatacaaactaagctttggaggttccacatcccatcttctgaggctctactggcgtgtggaaaggttgagtggggagaagattcctttcagctcagtggacctatggttctgctaagttaggacggtgagggtggtgcatttccttgctctcaaagccaccttagctcattaggcaactggcatgggtaacgtattttgtagataagtgcagtgactcataggccagacactcagagggtatcctatcccagccaggtgacggtaactccagcttagcaaatgggccagtgtcccctttcctcatctatgaagtggactgttgaatgagatgcaggttactctgcccagcaatgtgtcgtggttcttaggcaatactgtcaatgccctgaaagcagagctctcttggggatgagggtcttgcggtcactgagacctgacacctttctggggcacacccatggaagtctatggaagatacccagttttcctctagaaacccccaaaattatagttgccagagtcaacaacttggccatctcacttggttctatgctgatagaggacaaaaatattcagtgaatttcattttaatctgtaattaataaactgtttccaaatatgattaagtaacctgacttctctgtcacttagggtttagcaaatgttgggttatggacgtaaaatttattttaaaatcaagtatgttcagagaagttttgccaagcataaatgtaaaagagaggaaaaaaaagaaggaactttagaaatttctcattatttaaaaaaataaaaaatgaaaataaataaaatcaagtatgaaaacattaggactgagtctctctctgaaagccttttaaatgaagatattgttttcaacttaaagtaactacattaatttcctgtttatgtcactagactttgaatttcaaataacaaaaattttcaaagtctttgtatatttcaaaatataaatttcacagaaacaattttaaaatgtttcctattataaaacaagttatctttctcattcatccacacagaggaaatacacatctgtgttcagtactttgtgtcctatttctcaacctcaatccattgacagacctcccctgctcagttttacattttttgatgagtgcttcttggcctataaccagctgtgaacacacaaacgaacaggcagccttctcaagtatgggtagggcgcagaagaggaacttactggactggggcacaaagtcagctgcttgtgagactcatcactgggtggaagtgccctgaggccaggacttctatgtctcgtgtctttttggacacagtatccagaaaaagaccagcccaagacccggtcctccataaacacttgcagaatgaattccttggaaagcttttaacaagactctcaaactctcagggtttcttccccttagcaatagaatgaggaaagttacatatgctaccccgattttcacaagtatcaaataatagaaagctggggaatgcatttgtaaaaaagagagcattgtattagcattgacctttttttttttgagacaagtctcgctctctcgccaggctggagtgcagtggcgcaatctcggctcactgcaacctctgactccctggttcaagcgattctcctgcctcagcctcctgagcagctgggattacaggcacgcgccaccatgcccagctaatttttgtatatttagtagagatggggtttctccatgttggccagaatggtctcgatctcctgacctcataatccgcccgccttaggctcccaaagggctggcattacaggcatgagccactgcgcccggccattattgaccatcttagtgagacctccagcacctagtacgggatctggcacacaggaagcactaattgactacttgctcttagactacatgtattttcagcccatttgacctcctacatcgctgatggtttatgtatgacttctagaaattttatttctacatggaagaaacctcgtttcctattcccaccacccccccacccccccccccgcttgtttcccactgtattctttccggaggcacgcctgcagcccagccctccttgcagaaccctgtgacaccagaggcgtgtgtatccagaatcaggcagattcctgaactcccactggtcagccagtgtctagtgctgctcttcataaacaatgcctggagtgtgctcacacgtgtacctcttcttggcaaagacagtaaatggaaggagacaaggagttgtctaataaacttggcattgagatgaaacaggaaacaaagacatgtatccggataaagataaatactgttctgagtttctgatcttgtcaacttcagattttttaagtgcctgtgtcccaggaaaatgatttgcctcactggtgtgcttcatttctttcaatattagacttaaaagcaagccctcctccagtactggattaacagttttgtttgaaagatgtgttttaccctcgggaaccggccatactgatcctatctagtacttccaattctgatttagggatgccataagagaaactttttaaacaagtaattctcttctacttttttgtctattcctcaggtctctcaatggttacagaacccatgtctgtgtctaatatcatggcagctgggacaaagaaaaccaagatgaaacatttgagattgttccagctgaaacaaaccaaccaaaaccccacaggtgccagccttgaggcaaaggcgggacagtgtcaggcgaaatctttgggtcccagcctcagtctccccatcaccatgtctttttcacttaaacacgtttcactgttttgtcatctatagattcaacaatgtgatttggacactgggaataagagaataagatttgatggttgaaataaaacacaccacgagagaaccgtccacaaggaaactctaagatgccaagatgcgggacaggtagaaaggacagggctttgggagtactctgggttttcaggacgaatctgtatcagcctcggcgctgcgaggatattgcatcaggctctttactcctgaacgccgttttagacgcctaagcagattgtgctgctgcctgttcttccccgttctgtgaattctacactgacttcaagtgcacgaatgagctacaagataaggtggaacctgccggccgggcacggcagacagcacctgatcagcgcctcggagggcggagctggggggcttctccactcgggactttgagggacccccgcggagcgctccgcgccactcggcggtctagctgcagagaaagcccctcctcacccggggctccctgtggcccacaggggaccatcccacaccccgtgcagccagcggcggagaaaccagctggaaatgcagtgggggtggagttgcccccgcgaggacccacggaccgcccaattactacggagtcccagcgataacgtttggagccgtttggttcgattttcggaaccggaccagctttccagtaacttgaactccctgacgggtctcggggtccacccaggggtggcgaggcgggctcgggcgaccacggcccgctcagtgcccggcacctgcgcgccccgagggcggccgcattacctcgagccggctcaggctggagctcttggagcgcgacttcctgcgcaggtacacagagaagaacctgcgcacggcgaacttcttcatgctcaggtccatcgccccgcgcccagcccggagcagccgcagggccgggggacgcgcatccccggcatcccaggcgcggggctcaggtccgcgggcgggcacgcgtggccagggagcccggcacggcggccatgggcgcggggcgtggggcgcgagctgcggtcacaaagggcaggccgcgccggccaccgcggccggggccacaatcgctccctccgcctccttctccgcctcccctgcgagtaccagcgccggccacgcgccacgcctacaccacgcccaccaccactaccaccaatcagcgcccgccgctccgcgccccggcacgcacacctcctcctcctccgccccgccccgccactacggccaatcagcgctcaccacccctcccgttcccacccaccaccagcactgccaatgagagcccaccgccccgcccgggagagccccgcctctgccgatacctccaatcatcagcgccgccctgtggttccaggtgcccatccctcctcctctttctactccttcctacaagaaccagctccgtgcagccccgcccccacgcggttccgcccacggccccgcccacagcactgcccgccaatcagtgcccgcagccgccgcatacctaatgagcctcggcccgggacagctcccggcccgggcgagttgtgcagctgctccggagccgcgcagtcgcgggcgttcctgtcacgcaacttcggcccggctgctctttcttccagcttggggccgtcattatgttttccttccttaaaacatccctatgcacactttgtcatcatgtttttctctgccgaaccaaactttaattgttgatcagcaaacgcagccaaaacctcagcggcacagcgagcgagggaccgccgcctgccagcgggccctgcagctcggccaggagccgccctccgcggaaccggcgccttccctccgccggagcggacaaaggcgcccgagggcgggggctcaggcagccctcggggcgcctccctcccgcggctgcagaacaaagacgcatccgccctccgcagccggtcccgctctaggaaacgtctacacagatggcttatcagggcccgcgctgggaatacccgggcggggtgacctgggtctagggcaaggccctcagacccgctgctggcggcagcgccgctcgggatccgccttaaagggaaacacttttttcttttttttcctagaaatgctcaccaagggctgcagcagggccgagaatgcgggctcacgaccccgtgcagcctgctctgttttcctcttgtgcacgtgttgagtttgtatttaaaaacagggagaaaccgagcccattgacatagcaccatcaccacctgcaaagagcagaaacgagtgcggtggtgagttgacaagtcttgcttgctcttttgcagtgcgaactgcaaaatcctcgcgttgttttgctccctggactagtcagatgttgcgttaatacttgtgtagtctattttggctaaggtgggtagagaggtcagaatgtccttaaataagagctttaaagtcatgctgcatccgggctgaggtgaggtcagataggctctctgggtttcctggagacccgcgttgagcggtgctgctccggagtggaagccgggagtttagcaccacgactctggcgctgccccttccttgcttggtgaacttgggtgccgttgcacgttgttcccacgactcatctctaagaggaaaatacgagtgaaacctgtctcacctcccttactggataccaagaggcttatgcaagatcacggatgtgggagtgctttgtgaatttaaatagtgcaattgattttcatattatgtattaaaggatctataatgactattctttaaaaacagaagtgcaggaccccacaaggacaccaaacaccactttttgctccttttcaagatggtgtgccagttaagtgcccatgaaaactgctttgcctgcttcctttaaggttctgctgggagggtagtaatctgtgctctcagaaccagcctcttagtgccctgtatccctgctgggaccctcaggcatcctggctctaggcaaacacaaagacactctgtacccagcacgggaagaggtagatggacctccaactggacacagactccgggaatgagggaggaccaacccgaccatgcttccctcggaaggggagccagtaatactggccggagacaggagtgctgaatgccacctataccaactcatgggcatcctgttcaggacaaaagccccaaggcaggcaggcctaagtcaaggcttgtgttgtaccaacaatagtattttgacctgatctgacaaaattggaaaggaaatatttcatgggacattcattagttccccaaatttgaaggcaacaaaactgttctgttgaacttgggagggaaaatcattcagatttcactggaattcattgctagaacaataaatctgtttgcctttgtttttctcctggtaaaatacacgtataccaaaatctctagtgatcatggaacactacttcatgtgattatgtaatgaaatcctccaaaaccactaaatctagggtaggtataatatcaagacccactgtaaccgaaatccaaattatccttaccaaataccagaaaagaaagtgaacttgataaaggctcttgcccagatgatggaatgggagaggactgaagagaagataaagagcttggtagacctctgagtatctcacatttcctctgactcaagcacagtaagtttgagactgaattccgtggtgactgctgcttctatgagtaccagattagctgatgtgtggtcaatgcaattccacaagtgattatcgagcactaacatctggcactgtggtggtcatttgtgacacaaaatgattacaacatcccaagaagttcacagtcttatggaagagaaggtgagtgaacagacaaagctcatgccgtttttatgtaaagtgaaagaaatgcgtaagagatgaatgagaagccaattctaattggcgaagtcaaggaggagatggcctttgctctgaacccctgagggtaagaagatgagggaataagtttcctggacagacaagaggaggcgggagtcccaggctgaggaataacagggcactgtcaggcagctgtgacaaggtttcccatctctccctgctacacaggcaccttgtgggtaaggctggtgtgctctctgcatatgggaagatgccacattctcggggcaccccacaggagtggcttgagtgacatccaagagcttctaattagtcaagtaccacaaatgtctgttcgtctccaaacagtcctacaggctgctgaaagtttcaagcttctaaaactcccacatattttcaataaaacgctaaattgcacttcaagtgaaactatatatctttaaaataaattgaaacattcggtcttcattaggactaaagttttgccatgggaggtgaattcactaggttcacctgatgcaaaacttcaccaggatcaccagggtcacctggtgctggccatctgcgaaagcaggaagtcgtgcttttccggagtatcagcattcgaaggctctgcccatcacaggcatcctgctggatgctccagagacagtgtccagccagtacgagggagggaggtgggcttcagtgtgtgcccctgtgaactacttcctgtggctgtgatacaaatgggtttagtcaagcttcccttagtgtagtccctgagtgtacagaaaggaatccttttcctgggctgtggatccccgtgtacttgaaatgtttatgactttgaagtttcttgaatgtaggaattagtccttgctcaggaagatggtcttaaagtcctgagaccctagaaggtaaactgtagtggacagttcaggtgggggcacgttcggagcaggtgtcagcaaggggcctggagctgtcagggaagggcttcttgggccctcggcaaaagtcagaagggatcaagtttgcctctggtctctggctggcccctggccctcacccacaggacacttgggtctcattcacatctgggtgccaaccaagccatgtcagaatgacacctgtgccctcagtttaacagtttaaaatctctgagcatatcgaaaatttaaaaagaaagtcttaatgcgtaaaagtcttcaaaatgacagaaataaagctctaatggtgaagtaccaggaaatggaatttacatttgaaaccagagggcctggtttctgagtagtcaggagaggcaggtggaaacccacaggccagttgtacttgacccttattgactggcttacatttaggaagaaaaaccacattgggtttcaagctgtggaaaccatcatggttggcttcctccctccccgctggagccctcatcccccatccaacctgggtaggaaggcacagggctcacagaaggtgggcttcacctgcaacacctcccccgccagcccgctgtgaggacagctttggattttattggtttttaaatactatgttccttcataccactttcttttgaaacccatttataaaccatagggccagaatctacagagaggctgatcaaataactttcctggtaacacagattttttttcgtccctctgcctggggcactctggtgccttccatggtgtcagcggagcacggctggagtcatgactcccaaacagcgagaagggagggccctgcctcagtgagccctttttctctttgagacagtggaacccaagagatagatgcgaacacacagagcagtcatagacacagcggagcagagacagaccagagagaggctgcgcggcaaacggagcccagacaggtggcacctcagggcagcaccagtatcagctaaggtgtaaatgcctcgaaaagacctaaatcaaacaccacatgagagagatgaaattcagacagagaggcggtggggacagcgctcctctccgcacatttccaggatactaactccagctgccatgcggtgccttcaacctccaggacctgtctgcctcatagctgaagctttgtaccctttgagcaacatcgcccttccccacccccagccctggggagtttttagactccacagataagtgagatcatggacatttgtctccccatgtctggcttattccacttagtatgatgtccccaggcccacctgtgttgcccgcaggtagctatgtgagatgatgggtgtgttcattagcttgattgtgggaacccttacatgaggtatacctacagcaaacaccatggggtgtcccttaaattatgcaacttttggctgcacggggtagctcacgcctataatcccagcactttgggaggctgaggtgggcagatcacctgagatcaggagttcgagaccagcctgaccaacatggagaaaccccttctctactaaaaatacaaaattagccgggcatggtggcgcatgcctgtaatcccagctactcgggaggctaaggcaggagcatcccttgaacctgggaggcagagttgcagtgagtggagatcataccattgcactccagcctgggcaacaagagcgaaactccatctcaaaaaaaaaaaaaaaatttctttgtcaattatacctcaacaaagctggagaaaataaaaagaatgaatgaggaaggacatacagaaatcaacagcaacaacacagaggagaaagaccagaagacagacacaaagaccaggagaccaagaaggaacttaacccaaaggaaaggaaactgggagcccgagcttagtgagggaggagaaagcagggacagacagcgcaactcaggaacagggtcggggagaggcagaggcacactgagcggtgtggggaggccagaggacaacgtggactcaacatgggcgtgaaatacctcggggccgggcgcaggggctcatgcctgcaatcccagcatttcgggaggccgagatgggcagatcacttgagcccaggagttcaaggccaacttgggcaatatggcaaaacccatgttttctctactaaaaaatacaaaaattagttggatgtggtggtgtgtgcctgtggtcccagctacttgggaggctgaagtgggacgatcacttgaacctgggaggcggagacggcagtgagctgagatcgtgccactgcactccagcctgggtaacagagtgagagcccatctcaaaaacaccaaaaaccaaaaaacaacctcagaggagattgcctaagtccacagagcaagaaaggaaattggggcagagtaaaggggtgagtttcttcttctacctctggccagtgtgtaaggatgggatgctcagagctagcagtactttgggcccatgaggtcatgctaagcatggcacagcagaaaactggaaacattttggatccttgataacactgttgagttactgcattaaccaagtctgcagccaaaccgctttgaggcttacttctgtggaaaataaatcttctcgttgagctgagttttctgtcattagcagccaaaggaatcctaactgatatactgagcaaggcattcgttattcactcggttaatccagacttaaatctagttactaaatctaaatttttataaaagttacttacagattatttaatagtcataatatttgtaaaacattatggtagaaaatgctgtgagattataattacagttataattataggatggaagaattacttgtttgaatttattcacgtatcatgcatttcatgatctcttcctctgtactcagcactgtgccctctcacaagatcatcacgggctagtgacaaatgatcagatacaaaaatatactatgagtcagcggaacgtgccacgctttaaggcagacaaacatgcagctggcccatggggagggaggaaggactagagggacacggggacggtttttcaaaccaggcaagtggagacgagagcagaaagaaagagcagcttgcgcaaaggccctggggtgagtgacactgtgtgggcagagtgtgggctcagggcgtggggtcaggcagagggaatgacgtttgttctcagcttaacaaagaggccactgaaacgtgaagccaaggacgacagggacacacttgcatttgagaaagttctcctggcagcagggtgcacagcagaggaagcagattcggggaggtgcccctgtgacagtcttgtggggcaggacagtgtcctcatgaagagcaaaccgcagtggccacagtgatggagagcaagaggccgaggtgggcagtaacactgggagcagaacttgccgcagacccacgggctgaggggaaggaaatggggccggacgtttccaggataagtccttgcgtccacaggcgccacctctgagttgctcctcccccttcctcatccctccattttaccacctcgaaatcaaaatcgaaatcgaaatcgctgagcttttacacagttcactcagatgcttccctgtaaatccatgacttgcaaaactgtcaggttttattccaacatgaccacaaacatggaaaaacaaagacatgtgtaaattatgtgagatgagaaaataacacataactctaaaaagggaatttcatttgcaaatgttttttgaggcagaatctcactctgtcccccaggctggagtgcagtggtgtgaactcagctcactgcaacctcctcctcctgtgattgttgagtcgctggggctacaggtgtgcgccaccttgcccagctaatttttgtacttttagtagagatggggttttgccatgttgaccaggctggtctcgaattcctgacctcaagtggtccgcccacctcagcctcccaaagtgctggggttacaggtgtgagccactacactcagtgttcatttgcagatttttttagtgtttggtatagtttcacaccataaatacctcacatccttaaaaatccacaggaaaaaaactaatattcaagaactagaacaattttttaaaatatgaggaaaatgagaccataatttttaaattataataattttaaaaagacttgtgataacggagagccaacggtagtacgtgaaagtgaccgtgtggggcatacttggttgtattcatgtttgtgactcactaattatcaatcacttctctcccacgtacaccttggcatgaatgagttagagaaccacggcaggagcccagtgtcattcatcaacccaggtcctctgcgcatctactgtgcctgctgctgtgggctgtgctgaggctgggatctgaggggctgggcacagcagggactcctgccctgacgggcactgcagtctctggggtagcacagacaagccagggtgcgttcactcccaggcaggaagggctttagaggggagagaaagccctacgggagcccccagaggagcccttagtctcgcagatgactgctacattcacaggctatgatgagcaagcgccagccagatacacagggacagacaagggtgttccgtcagggaagctcaggctaaaggccagtgagagcatggtcctgaggaggttcatttggctgctgtgtgagggtgtgttggagtggggacagggcagaagaggggtgctaggtcacatggtagagagccccatggagtttaccccagaagaggaggaagagcccgggaggctttggcaggaggatgccatgagcatcacctgggtgtgtctgcagaaggacgttcaactctgagcctgcccacctactgcgctcaccccaggacaagccaccatccccaccctggggagaaggctgcatccaccccaggagggtgacctgggtgtgtccggtaaagggtgtcttaagtctgaccctgctcgtcttctgcgtccactccaggacaagccaccaaccctactctagaccagggtggtcacctgctagcttggccgcccatggccattccacataaatccaaatccaatcatccacttctctgcttataactcttccaggcttcttactttcttgccagtaaagtataataaaacccaaactcctcgttctgcctacactgactctgctacaaagaccctgggtctcaccacctaccgcccatcccgccctgccccaccctgctcctgggctccaccagcctggccttcccttcattcttggaaccgccaaggccgtcccacctccagccttgggttctggctccttcctctgcctgggcccctgttccagctcgctctcaagctttggcttccagcttgaatcagtacctccctgcagaggcctttctggatagcctatctcggacaggcttgaatcagcgcctccctgcagaggcctttctggatagcctatctcagacaggcttgaatcagcacctccctgcagaggcctttctggatagcctatctcagacagggcctctctccactactctctagaacacctcatgctcattttctttacaaaacttctgataatatgtgattcttcttccttttctcctcctccacatatttctcctcctcctcctccttctcctcttcctcttcctccttctccttcatccttttcaccttttaaatgcttgtctccagtaatcacaatataaggccctaaaggacaggaactttaacatcccagaggctgctgtgacacagagcccagctcacagtaggcactccgtggatatctgctgcccttgttgaataaagacattggggaacgaggccaggagaagcagggtgtggccgaagggaagtggatgaactccagggttaaatttagaacaaacaggatttcaggattgatcatttgaaaggaaagtttctaccaactccctgagatacactaagtttgaaaatttcaaggacaaatagctataggccaatttttaaaaaaaagtgctgagaggctgttccaaaaccctgacactgctccggtctctgagaacacaggatggcctggagagtaaaggaggggagcatgcaggggaggaaattcggcagcatctgtgctgagcacccttcctctccaccacctaaagggctggggaggtgccgcctctgttgttgtagcccaggcaggatgactttgtggggccccttggggagtgctgatatgctaggaccaggtggcttaggtctggcttccactgggaccatctggaggggaacgcgaggaggacagagaggctgtgtggtggctgaccctgtccgcgcaaggcttgttggccaaggacacacgagtgcttcctacaggccgggcctgggccaaggaggggccatgcgaagtcctcagagaccctgcctggagtgaagccaacagggacctccaggagagaagggtcaggctggggaagagaggagatcagtcgaagcccattctctcccctcctcttcctcattcctggctctggccctgagaggaacaatgagccgagaggaacaatgagcaggtgccaggtcgggggagagggtggtaggggacacacaaggtggagagtaggagagccagcaagctcagactgcaggctgcctgcgcaggtctctgaaagggacccatcctgaagaccggaaatactaaccaagcgctcagaacttaaagtcagtgtgggctgtctgttgtccaagagtgggaagaaaagctgtggaaagtgatagggtcctcactggagaagggggcgtttgtcccactggtggacattgaaatgtgtgttttgacccaatctcaagccaggtttgttcaagtcaatgaggtgaggaagcagaggcaggaaccaagaagcgggttcagatttgcagcataagaccccgtgtctcagccgtgggggccgcaggggacagagcccactccccaaagtggggatccagcagggcgctgcacttggcctgagggcggggctgagggaggaccccataaccccctggatgaggaatcgtggttgaacactggcgctaagcagggggccgggagcgtgggaaatcctctgggagtttgtggccacagccagccttcgcccaggggcacggcctcggttcaccgcctgtgtgaaaacagcagcaccaactccggctgacaatttaaagtggtcttgagttgttgttgccctaggtgcctatcagaaacaatcacaaatgctttctagaggaatctgcattagagccaggcttcaaagaaatccctcagacacagctccaaggagcgcaagctcgcaatcactgtgcgcaaaatccacaagaccgctgaagtcaggagcacagcccgaaagccagccagccgcagactcggctgtgagcaggctccagccactggaccctccaggagagagcagtgaatgtcagatttgataagcttaaggagataaaagcaagatatgaaaatgccattaaagacaagagactcaaagtgaccaagcagataaaaaaatgaacaacgtcgctcttgaaatggaaagacatgaattacatatagctgagcacgtgtaccatttattaaagagcaaattagatgtagctggagacaggcgaaagacggatctaaaaacgaccgcggtaagcaggagcctgtgatggactgtacactgggaagtaaaatatcttgaattaaatttctacccgctgttcagatcctatgacctgactttggctgaaattctgagtctctagaacagtggttctggggcggtagaggatgggtcccaggggacgtctggcagtgttagagacatttttgattgtcacagctgggtggggctaccggcatctcgtgggttgaggccgggcactgctgaaccctctacagtgtacaggacaggctcattaccaagacgtgtccatcaaaaatgtcagtagtttctgttccttctgctcagtttgtttgagaacctaaaatggctcttaaaaaataaagtctatttttaaaaatgttgatggtgaggttgaaaaagctcactttaggatgaagagggaggaagaagagggaaaaaaccctgttctcaccaggtcgtcacctatgcaaacagcaatttcatgcagttaaaccaatatgtggaagggctttataaatcataaggtgctcaatggagttattcgtagaaatcctagagtttcacacagaaaattaatgaaatggctgggaaggcagtcgactcccaaatatgagaatttgtatctgaaaactcccctattcaactgtattgtcttatgcaaggcataaccatgtgccccgctgcccaaaccagaaggtaagacttaccgtgacctcctgacacgtccttattccctacgtctctagttactgagatttgtcaactgtgccttctacatgttttccccgtcttgccttctttccaaccctgccctccataacacagcgtgggtcctccttagctcttgccagaaaatagtaattactggctaaaggctttccctacaacccacctgtggtcctgccaccagcctgatccttctagaagcgaatctggttcagttaccccagggcatgcatagctccagagcttggaagcttggaagccccagactctgttcttcctagccaggccttcttccatgttgcgtttgcctctcctccttcctccagggtgcagtctctgctcctgccccgctgacttactcctaagaagatgaactgtggtgtctccgtgacatcattcacgcagtggccacggctgtccttcctgcccgctctgcctctgcccactggccacatctccttccagcatcttccagacccagcattgctccaggaagccacaccgagatcactccaccccacaggccctgttggggtctctcctgggttcctctagtttgctcactgtgctgtattaaaactttgggttcccctctctctcccaccaatgttaaactacttcagagaagcaagtgtccgtagcgttccatgcgtgtgtgtaaacagacgttactaggattattttcagtgggttgctgattaggaagagctttggtctacattattatttctgtgacacatttatctacgaaagagacacagcgaacccccttatgcagtgaagatggtgaggctctaggaggttaacacagaaataagggacttttccaagcctatacataaattatagaggaattcaaaaggaagggagtcagcaggaaagaggaaacaggttacaactatagcaggaaggatttctgtagcttaaaaaggaaaaaaaaaacccatcatagaaaaatttctcaagatctggcatgggtacaaaagagaacataaaatctttgctagatttgttttagcaaattttcattgtttaaaaatatttcataaacacctatagtatttcaggcactaaatacctctactagagatgagaacttgatgaacacgtaaaagccagacagggggagctgagaatagcccgtgtggcagccccgggagaggcgcgccctgtggtgcggtctcctcctcccctcatcaggggagctcgggaggaagctggggctgggaggcagcaccgcccttccctgctccgctgggtttttccctgttctgggcaacctgctgggtcacgtatgtagagagagccttcccggaacacatgagaatgctagataaaacaagggggaaatctcttctaatgaagtgtggctggtccgatagtaagcagggaagaataaacgcaggcaaaaatgaggataaggagatattgtgaggtcgagcactgttctgagcagtgcctgtcctgcaggcttatgtgagtctctgccatctagaccagaggttcagtggggggccaagcagggtgtggggggtcggatccgagtcggcattcccatagagcagactcaacggcgtgaccttggaagaacctcactgtgaagaaggaggcttgcatcttcaggtgggagtgtggcaaagagcaaggggtaaaaactgccctctcagatttctttagctcacacttcagccagttggaagccaaaatcctcactgctagtatggcctgaaaaactccaatccaaacttatagtttttagaggttccagattggtagcacccagaggaccaggcagaggcaaatgtaagtacaatcaggaggaacatgctttaaacacgtgtcacagtttaaacgggaaatttctaaggggcatgagctcgcaaacataaatcactaaataatcacagatacaaactgtgggcaagagtcagcagagacaacaaattccaaaatcagacctgtacagatagcaaaggttaggaatttgtataaataatataaaatatgtgtcttcaatacatttgaaaaacagcaaggaaggttgaagcattacaagaaaacaagagattataaaatgaccaagcagatttgtaaaaataagtaaaactttaaaattgaaacagtaataatttaaataaaaaattcaatagattggccaggtgtggtggctcatgcttataatcccagcactttgggaggctgaggtgggcggatcacttgaagtcaggagttcaagaccagcctggccaacatggcgaaaccccatctctactaaaaatacaaaaatcagccagtgtagtggtgcatgcctgtaatcccagctacacggactgaggcaggagaatagtttgaacctgggaggcggggggtgcagtgagccgagatcacaccactgcactccagcctgggtaaaagagtgagactctgtcacaaaaaaaaaaaaaaaaaaaaaaaaaaaaaaaaaaaaaaaaaaaaattcaatagatcaattaacagcagtttgggcaaagtccaacaaagagttggtaaaagagacgttggatctgatgataattgagagaaagacagaaatacaggaaatatgaaaggggggttaggaaatatggaagatagaaggagaaaaatccagcatgcctctgactattagaatgagacagaagaaacaaagaaaaacagaaaagcactattcaaagaggtgaggcaatactgcagaatttttcagagtagataaaatataccgatcttcatatttataaagacccccaaaatccccaggaggattcaatgaaaagaaaatgatacctaaatacatcatattaaatatttgaaataccaaaaaccgaaaaaaaaaatctctccagagcaaccagaagaaaagacaacttttctacaaatgaatgttaattactgtcagctaccatctcaacagcaatattggaagctgagagagtggaataatatatgcgatgtgctaagagaaaataactttaaccttgaattctctgtcctacaaaaaaaaaatctttcacaaacaaggacaaaacaaagacatttccaagtaaacaatcgaagaaaattctcacttccagtgaaattgtgtgggtaaagctagacacacacgagctgcatgaaagtaaatcatttgtgtattgtataatttgtggacttaagttggaattgatgtcttaaatatgctatttaaaaatagcatatacgggacagtgatcagttaaaaccttctaatgttttcatatttttctgaagataaagaggcttgattacctttagacaaaaattcaatagattggttaagcatacatgctaaagtttccaaagcaatcaattaaaggaatataaatccaatgtgtaattgccaaactaatagaggtcaaagtatagaacaagaaaaaaatttcaaatgatagtaagaaagcaggaaaaaagacacctggaaaaagcaggataagtaaaaaaaataccaactgttgggaagggccaccgccatgggtcctgagcgtcactgcaccttcttgctgagtatgtgacgaatgtcaggcactgaccactgttaacccaggccattgctcagtgtcacatttgcagtgagcaaccttgggaaatgaggtaacattttcctccaagacaaaagcaggcttgctgacctcttgttaaagaacaccaggttccccaagctcagctttcctcaactgagatgcagttttactgtaaacatagaatgcatctaggcccccataggatgtggggggcaaaggagtcctatgcaaatatgatactcatgccattttctgttccttgaattaaaatgtcctttatctctgatcttccaatatccaccaactcttctagtagctattattgggctaattagtagtttgtaagtgaggcaaaataaaatcctagaccatatacaatctaaatagaaataaatcaaaatatgtaaaaaaataaagtcaatgttaatgagctaaactctctagttaaaagacaaagagtgccaaataggtttacaataaatttagttatagaaaaacatatataacaagatacataaaaagtttcaaataaaataatggaaatagatacatcatgcaaaaactaatgaaaagaagtaacattaatgtcatacataggatgcaacaagcattcatagatatagaaaaagcactacatattgatgaacgtttcaattcaccaggaggatacaataattctaagcttacatgcaccaaataatatagcttcaaaatgtattaatcaaaaaatgacaaaaccaaaaggagaaattgacaaatccattattatttagaaaaatttttgtctcaatatatgtcttgggccattgtatatcttgctactctcatctggacgatgtggtacctgccttcaattttgtttaccaagattaatactgaatcctcctaaagttctgacctccgctgtcagtccttcaaggatgctctctgtgacccccagacttagtcaggtgccctggcagatgctcttaagatactaggaatttcttagatgggaatacttacttaggtgtatgtgtgtgagcatttaattaatgcttttattagactgtaaaccctgtgagggcaggaattgtgtctccttggcaaatcactatacacagtgcctgttactgatggctgatctacttagaacaaatatttgctgaatggatagacgagtgaaagcagtcactgaactggcagccagatggccactactgcttttttgacatgcactttgtgccacaggatggaagtgcagaatgaggattaacttgtgacaattggttccctctctctcttctcctctccttcccttttcctctttttaagccagtaattagcacataaccttgggcaactgaggcaataagtcagtaactctacatactatttttagatttgctaagggcatacaacatgtactattcaaaaacgaaaagaaagggaattatctagtagggcacagatgttatattcacaatggtacatcctgaagttcaacacagggaaaagcccacatttcttcaaatcaatgtgcgtcccatttactgtgcctgctcccccagtccatgacgtcacttcttccagttattcttgtgattacatgtccttccgggaacaactggctggagattctggtgacttttaggaagtttgaggctccaatcctatcatcattttccaggagcaactgctttagctaaacctcccggtattctcagggaaggatctgacttaagttgcgtgaaagtatattgcaaatgtgttttggcttagacgtattttaaataagggcccatacatattaaaaagtaaagagagaaattacagcctaggggtttgtggtgtccatgtagcattaacataatgagtgctgtggcttacttgcatcctgcaaaaagccaccttgaagtcctaacccctagtacctgtgaacatgacctcacttggaaatagggtctttgcaaatgaaatcaagttaacatgaggtcataattggattagggtggctctaaatccaatatgactggtgtccttataaggagagacacatacacacagaggaatgcctggtgaaggaggaaacagagattggagcggggcatctccaaactagggaacaccaaggattgctggcaacaccagaagctggaaagaggcatgaatcagattcttccctacagcctttagagggagtgaggcactgcccacccctgattttggagttctggtctccaaaactgtgggaggacaagttcctattattttaaactgtccaatttgtaatgctgtcttatggcagacctagaaaatgaacgaaactacttacgcatcctttaaagctagctattaaagtttcctatttgataaagacttgaaaatgtaacaagatgcataatagcatctacaagtattcacctttcaatatgaagaatggcaaagggtgaccaggctgccaataagataaattatggagctggaatcagaggcacaacgttagtttttgaattaccagtcgtgtgggggaagctgtttaagtaaaagaacactgagaatgggatcagaacacttgggctggagtttccgtttagccgctttctatatatttcccctaagcactggtacaccctgttccttctgccagtcacaaactctccacctcccctcctctctcttcaacctgctcacctctgtccctctcctaggccttggctaagactccactcctgggaggtctgccctggttcctaggctgggttacaggacctcctggagcagccctgccatgctcacgggaatgtgcccccccttctctggatctacctggagatgggggcactccaggaagcctggccccagctcatcatagtccatgttgtacccacagagttcttggcacataagaattcatttttagctctaaataagtaaaggtatgaattaaacagtagcattaactttgccatagttttgcaaactcaaagtgtggtttacatgtgtcaacatttcaacttaaccacagattattttgcctcccaatggatatttggccaagtctggagaaacttgtcagaaggtgaactaaaggatgcaaagacaatctgtgcgtgcccctcaaagctgccaaagcgggcctggagtctgcaagtgctcgttagaacaaaacgtttgcttctagggccagtcctctgtgcaattagagttgtagtggtgaggttgtaaatcagagttgatagctcctattgttagggaatttagctgtaggaattgggaaatttgccatggtccctgagcactgaacccatgacccaggggtggcttggtttccttaaacttagtgcccatctcagttgatcagagggcatctatttcagtctctcagatcacgtggaatctcttgatcggttccacatggaccagcttctgacaccctggctgcagaacagaagcggcggctgggagaggtaagtctagacccaggtagcagggacccccctggacccacacgcccacacggccattgccctgagagccaaaccttccaagaggccctgaaagagaaagaacacaaccagccaagcttgggactggacaagccagtcagcagcactgaaccttacaggataagtcctaggccacggaggagccagtcgaggtcagcctggagtcttctttattcatgacattgcatctgtgcagcgcaagggccccgccaggaagacctggtccagccgcatgccttggctggggcccctgacacgctccttcctggggtcacccgcgtcccagcctggcccttctgggccacggtgcagctctcagggaccttcttcgtttcaccaggggctcctcacaccagagcttaccccaaagaagtgaacccctaagcccccttcagttcctaggatccttgactcctaccaagcaaacccttttgtcctcaccccttttgaatctcctttgagatctcagaggtaggcatctcctgctccattctaattcaggcacctttcccctctccagcaagttctcctgcttctcaggccgtggtgggtgtgggcctctgtgcgagccgctcccctgtgtgccttcggccgccactcctccctcagctgctcgcattcccactctgtcctttctccaggctgacgcccagccctccagacctcctaccccagttcagagccacaggtcccaaagcctccgtggatgtcctccaggcactgccagggaagaattattccacaaatatctgtatatcagtatgtgccagaaatcgttctgagtcatgccgatctcccagttcaccatcttttttgccccagtgttctcctattttttttttaactctaaaccactcagtaaatgacactgatgtcatcatgatcacagttcttcaaatcatcctgatttctcccctttcacggccctcccaagcccagccccttatccacactttgcatcctgtgcgtttgatcgctctgtcaccacacgcccgcctcgtccccatggccgcaatggccagaggcatggcttcatctcttcttgccgggttagtgcagttctctgctggtggggatgtgggcctccaggattcctccccaatctgtctgcaccgctgttcagatgtgttttaaaaattcaggtctggtcaagcccttccctactctacaccgtcaataatttcctgtacttttaaggataaagttcacatctctcagctgaccacgcaaggttctacatgcccgttccacctctttccataccgctccctaacaggaactctttactactgctcttaaattatccaaacgtagcacatttgaaaaatagccccaccatttagccaattgcctctcatcctttgaaacttttaagtttttccaggaggcttcctatacccacaggacacacatacatgcacacacacacacacgcacatgctcatacacacacatgcacatgcttacacacatacatacacacatgctcacacacatgcacatgctcacacacgcacacgcacatgctcatacacacatgcacatgctgacacacatacatacacacatgctcacacacatgcacatgctcacacacacgcacatgctcatacacacacatgcacatgcttacatacatacacacatgctcacacacacgcacatgctcacacacgcacatgcttacacacatacatacacacatgctctcacacacatgcacatgctcacacacatgcacacgcacatggtcatacacacacgctcatacacacacgtgcacacacacgctcatacacatacatgcacacacgcacatggttacacacccatgcacacatgctcacacacatgcacacatgctcatacacacactcatgcacacacacgcacatgcgcacacacacacattcacacaggcacacacactcatgttcatacacacgcatgcacacagtatgcacacacacgcatgtatacacatgcacacacacatacatgcacacgcttctcctcactccctgatttttatgctgtttttctgagggcctggagaacattgtgcacgcctccatcttaccatatacaactgctgcacaatctgcctttgtacctgagactgggcaagaattacttgagagcagaagccatgtctcatttgacaaacaggcagctggcacgggaaggggacgggcatttaataaatgtttctggattgaacacgtgagtgagttcgtatattcctgaatgactcgccattttagtattttcacctatcaccgccacgcagctgacttcttaatctgtttccagctctgccctctctcactagctggaatcccgtctccaactctctgcagccgactccatctgcgcatcactccgatctgtattacagtgattactccggcgtctgcatctcgtcctgaggtcctgaactttgggatggcaccgaccatctgtgactgtccgactcaaaacatcggtgcctggcacaggaagcatctcattctgtctctcctcaccccccttatgcatttcacccatcaccaaggcccatagagtctaccttgcagcgtctcaccaattcacctgtctctctaaggccactggcacctcatgccagccctactaatgggctccttccttcgcccctcctccagtctagtcaatatgttaccaaagcattatccctctccactgctctgcccttcaatcatctgtaccacaaaatgtgactcaataaattcaagctgctattccaaacgtggcctcatttgtcacaccagcctcaagcttcatctcgcaccactcagagtctgctccacaccaaacccagcaggaccaggtagtatttccacatctgcccctcgcgttcctgcccctgcgcccgtctgcgctcctgcccctgccctcccctcttccttcttcttagatcatctatccatcttttaagtccaaacttaaataggacctttgttcatgcatttcctcatttcccattaagataaaacttatttctcctgtgaaaccctgagcactttataaccactgcagtataacttgtgttctaactagaatctgtttccgggtcatcctccctgttaaatcccatgctatgtatcgtaattcccaacaaaacaaatgagcatggtgctgagggaatcctcctcatggtatatagatttccagatttttagggaatgagagcctaatgtcaccctatctgacatttctgaggccaatggtcttttaggggtaatgaagaattattactatgataattatttgggaattataccttactcactcatgcaacccccactcccagggcaaggccttgcaggcaggaggtgctcagtaaaggaccatgcaatggatgggattgtagacccagtgagctgaagaaaaaccagaccccggggggttttcgttccacatcaagcaggtgagctgagaccacgggctgtcttccttggaaagcacagagaacctggcacgattgttttgctaccaggactgcagggctgtctttctgcgaactttcattaccagaggtttaaaggctcgccagcagaaacttcagaactgcatgcccaacatgatctcgataagtagtgggtcattgcggagggtagagagaagtagtctctgagttagtcttattaaaacaaatctttattacccttaaaagaacattggcctcagaaatgttagatggggtgacattaggctctcattccttaaaaacctggaaatttatataccatgaggaaacttccctcagcaccaggctcatttgttttgttgggaattacaaaaaaaaaaaaaaaaagcacaattaacttgtaccacaagatgctgagccagagcccctctctactgcggagggaatgagataaggcctcccctggggtttctattctggggtctcccacaggaagcctttcatcaccacattcttattcatagacattgaaacaatactagcatttaatttgcaccaggaactggggtagcaagaagagggggcattctccagctgtctagaggtgggagggagggggtccatgttcaccgtcctcttttcacggccatcactttaggctggaggtgggagggaggggggtccatgttcaccgtcctcttttcacggccatcactttaagctggaggagagaaggaggaggggtccgtgttcactgtcctcttttcacggccatcacttccgggtcaggaaatgatgatgactgttcaggcctgtgtcctgccttcactagggccagccagcggcatccatatttttgcagtgttgtatgtgagggtgaactgagtcaggcttgcccaagtaggtggcattctgctggttcaggaaaactcaaattgttggcttcaagttcacttggttctctctctgtctccagtcctggctgaaattctaagtgattttttacttctggagccatctgtaagaaaggctcttcttggaaccctgaagactgcaggtctcgtttgggcaggtgagagggatttgaggtgactgaacagaacccatgaggctcaaggtggttgggtttaatactttgaacctgaacataggaatagatcactttttaaaattgttttcagcacctaaaattatggccatggacagctccatgcaaaggtcccctgactacaaggacctgccccgtgatgtggttgtgttacccagaccctgcctgtccagctgtggaagccaggctgtcaatccgaaaatgtcagcgccttgctcagatcactccagtgtgtgaggatcacaatttagataagaacccagatttcttggtttaaaattggtattttctactttatctcatacttatatcatatatatataatttggtaaaaagcagaacatattctctacttctagaggctccatctgcaagcatttgtacaattcagcaagtacagaaaagtgttggatcatgtgggcagcaattcaaagatttttttaaccaaattatgcaattatctcaatgcacaggattatgtaagagtatctaaaaaacaggttattacaagcaataaagtcagagatttgcagttgattggttttctatgtatttctaaacttggcaatgggtttgtaatacccagtgggctcttttgttgcttagcttaacgtttttcagaagtagacaattcttcacgggaagacaacggaaatccaaggaaagctacgaaggctgttatcagagaaaaatttcctcgaagcactttagctgtcactttgaagtgttagtgacatcctttggcagtgattaaatgtgccacatgccactaatcttgtttagaatccttaaagaggacagcagcccttacacaggatgcttcgatctgatgacgatggtgtttatgcagtgatgtgtggctcacaggcacgtatacaacaccatcaactcttccatctcatacctcatcagagctttccatctgatcccatttggagaaggatatcacacctgaggaatccacgtgtaagctattgctcttgtatgagttcaggtgcacacgcactgtggacgcacactgcactgtgccccccaacggctgacaacgtggagccgggatgcaggagcatccgccttctccaagtgagttctcggcactgccgtgctttcactaaccctttatttacttctgctagtagactttcaacgccactgagtgctagaagaatttaagaatgttaaaatagatatgatgagaatactgttttttgaacatcttcacatatgaagagtaaaagtcagaggatagagcttcggattatctcatagaagaaaaacaccttcgcattacatgtggcatgagccattcgcgggtattatatcttcttcatttgctattgttttcttttaaagcatctcaccaagcactcgcttcactgtgcattttatattctggttttatttcccagttcacaattttattcagaatcttaaattaactgtccttgggaagtatacaactagttttacccaaaggatggctgaaaatgcattgtcttcaacacaagataaattaacctgttttccttgcgatgtttcccatgaggagtttgatcgtttgcaccttattctcttcggggaacttaggaaaaaccacatggaggttgtcttctcgatggcgcaaccatgaactggacacgtttcttgacttaatcaagttatgtcctatttttgcccgtattgatctttatgtcactgaaagccaatgtgtacatttgtcagtgtcagagcaccctctgaccaactcaactctgatctcttgttgttaaaatcccacccggtgacctgcttgggttcccccagctaggcgagagttgagtccttagtaatttcaggcggggcccagagatcatggaagagatgcgggtagtggtgaatcgtaccgagattttcaagctccatcttaatcagtgtagaataatggaagcttttttaaattcagcaggcaagcactataattaaactcgcatgtcatcaatattccatcagggtgcaactcagccgcctgtctccctgcctcgtgccttgggtggctgggctgtcttcatcatgctgggcccagcagcaggctatttgccagggcacccactgtggacactctgccttcccagggtagccccgggccacagaacctgccactaggcattgcccattattccatttttctctcctaatgattttctgttgttgttcagagggagtctcgttctgtctcccaggctggagtgtagtggcatgatcttggctcactgcaacctccacctcctgggttcaagcaattctcgtgcctcagcctcccaagtagctgggattacaggcatgtgccaccatgcccgactaatttttgtatgtttagtagagacagggtttcaccatgttggccaggctggtctccaacttctggcctcatgtaatccgcccgcctcagcctcccaaagtgctgggattacaggcgtgagccgccctgcctggccctaataatgtttttaaggaggtgaataattcccatcgacttaactcatcccagagatttaggtccagcagagccaggcccacacagttattgaatcagacacgagaagacggaatcgacatggcaatcagcatttagacaggctactaagtgctgccatcaatcaccttctcttcccagaaaagtacagatgtctccctggatttcttactaataaccagaaatacagctgtccaggccctgcacatattttgtatcacttgataaaaatagctaatagcattctatctgtgactcctggtttatctcataaactaaatggatggaaaagagaaaggaatgctacttgaaatcccatctcagcggcacatgaattccaggtagcggctccctggttacaggacagaagtaagtgaagtagcacacacaagagaaatatcggaaaacagaaaataacttctagaggaataatttgttgcacaaaatgcaaacaaaacatgttcattaatacgttttatttaaacatattttcaaatgcttacaattgtggattttaggaggctgtgcaaaaatcatgaatatttttaatctgtcttaacaggcttctctcccacctctcactgtgatactgagcagaactccccaaagaaaaatcatttctcaactgtgaaactagggaagactaaccagatgtgatagcacactgtattctgatcgaaagtgaactattcttccatcatattggtcaagctttcaaaaacacttacctatacttcagggcgaaagattctcagcatcctctaacaaatgtttgcctcagaaccattgaaaagaaaaggtttagaattaatgacagagaacaatgtacccacagctgcattttgctcttttgaaaattagatatttttctgcagataatactacagaaccacaataaaagttatcatcatgcttcacatctagtaatgaacgtgaaacaagcaccctcgaatagctgcatcgagcatgaaagggcacgggccccactgccggccgggtgaattctagacgggccccactgccagccgggtgaattctagcagatacttcacccaaaatgcttcagtgtgcatcaaactgacacgagctcctacacaatcacaatataatttactcgcctgagagattcagtacacaatgtccccagtttccccccaatatccttaaactgatttattctgcacaattccatcacaaagtttttcacttatttgtcgaatctcaacagtattcttgaatgaagtatcctccagtttttgttgctgtttagacatttacatttatgaacaaagagttcagggcagctgctctgtagaatgtttcatagtctggactgatttcgtggtttcttcataattagattagggtaaaatatttttagctgctgtacatcacgttaggagacctgtcatgtcaacttgcaccattgtgggagacactcgcttctgcctgccgggtcgcctttgtgaagataacctttcccatcgtaattaataagtaggatgtggggcaatagctcctcaacctttcccctcatggctttagcacttataaaaaatgtaaaaaaaaatatcaggtgtccattttcaaggctgagggtgggggaagaatctaattaactttgaacagcacctggatggcagaatccctctagacactgacaacccaccgcaaccccaaactttacaactatttcacccaactcttttcaacagaagttctcatttttgttcatatatattgaatatttccaaactattcaatttaccttccacagaaattgctcctttttattactcaaagttcatcggatcatagtaattaatgatcatacttcagtgtatctagggtaagactgactacaaggtacatcagtagtttacatgccctacaggaagaaaacaccaaggacacataacaagcatcactgcaccacccacaactgatgttggtgacaacgtgcagacacaatatttgcacccggagtcagtgaaatgtggtgaatgatgtcatgtgtgcaaagtagtacaaacaggtcagggaacaaacagagcggactcctgggaaccacgtgtatctccagtggctgccaactcaggccggtctgcagaggattctgccacagcctgggctggaggctacacacctggctggtggatctgagacagagcagggcgggtaactgaagaccaggctggaaaggttctagcttcacataaggtaccaaataaaaaattaaaactctccatcagaaccaagatgcatatgtctttcttgttataattcaaaatatctcatagctagtaagatcttactgactataaaaggttggaaacacatgaagcagccaggactcccacactgggctggcgagagtgtgaacgggcgccaccagtttggaaaacaacaatctcatcaggttgaagatgtgcaggcccacggctcagcgactccacctcaggactacatggagcagagccccagcaggtgcactcggagacacgcccaggaatacctgtagctgtctttgcaggatagccacacgccagaagtcaccacaatctctagcaatggtggaaggaacaggcgccctgcggtagatacacgtggcagaacactacacaacagtgagcatgggctgcctgagtgtgcacagcacacacctctaaacacaggggaagctcacgcctagaaccgtgaacaaaggaagagagacacggtggaagctcaccgagagcttcttatttacataagcctcaaaaacaggtaaaacacagcttattgcttagaaaatgctacatgggtaaagatataaagaaaacaaggaaatcattgacagaggggtctggcgttagcggtctctgagaggagatgaaagggagggaggggagaggcagggaagaagaagaagggggaggagagaaacaagagagggagtgggcaggacgatggtctgggaaatgctcttcgccccaacccaaaggcgtcttcctctgtgaagggttgggcgggggtggaactcggttcaccccaggggcctcccctgccctgcctgagtggtgtggctcggacacaggggcatctccccacaggcctgtgcctcctgaatgaggaacagccattcccctccagcagggcctcggcaggtgggcccggcaggtgctcccgtgactctgcctccgcctccagccctggtctctgggatgcgaagatggatggaaagaccatatgaagcagccccgatttcccggagctcccagctgaggtcgcattcatccacacaggcaacagaagcaagtgcagcactgcgcggttcacctgctgtgggaacggcaggccagaattccctgtggaaaagggaggatgggaagggccccgatccccagcccctggctcaggtaggtgccatcgcctcccagggccgttgtccagattcaccgcggtgcatgtgaaagcccgggcaaacagatggtgcccaattaacagaactattcttgcggcactggggtttggtgagactctctctgactcagagaaatgacgcaggatggccactctgtccttggggccccaagcctagaatctgagtctctgactccctgccagaacctggtcgagaccttgaactctcctagctgcttcctcacccaggaaacgggaagagccccacccccaacacagagacggtggggagcagggctggagctgcggagcaccagccgcacctggcgccaggtcccaggagccacacgaggaaaaggagaacttcatcatgggctaggaaacccactgcctgggcgggcgagggcatttctttctgtttggaaacacacagaataacaagcaaagttagataagggaatgagagtccttgtgaggggtaaatcagtgttagatgataattgtcctgcttttgacgattttctaaaaacaaaacagaacaaaaaaaaaaactttagggaagctttaaacagatacgagagaaaagtgtcttattttcaacgacaaaaatgaaagtaaattcaccaaaagatggtacagatgaagctcaaatatttatgataacaacattccttggttgtagaaaaagaggaatacgtcctcattgcctgaaactaacgacacggaacccttgtgggaaccaggggagggaggtgttggtgagcagttattatgatggttaatttaggaagttgtaggaaggttctgcagagcattcgacagatgattaaaaggacaggagccggacatctgggccttgtggtttctaaggagagtgtgctaggcgttggaaggagaagaacgggaagaggctgagccctggtgccaatttgcctcagaggtgcaggcagatttcgctcacttgagagcagggcgagttctgcttttgaggccagaagtcatacaaatgcggacaagaggcctgaagaccgaaaacctgaactgcagatgtgtttctgcagaaaacctggctgggaggaattcacttttctttctttttttgagacggagtctcaccctgtcacccaggctggagtgcagtggcgagatctcggctcaccgcaacttccacctccccggttcaagcgagtctcatggctcagcctcccaagtagctgggatacaggcatgtgccaccatgcctggctaattttgcatttttagtagagatggtgtttttccatgttggtcaggctggtcttaaactcccgacctcaggtgattcgcccacctcggcctcccaaagtgctgagagtacaggcatgagccactgtggccagcccaggattttttactcctgggcgtgatttgtgttgggggtggcaccaagttgatggcctcggtgaggaagcagggtcagccctgctgagcccagggtgcatccgtgactatgctgaacgctgcatgtgatgcccgacagccctgtgcacagccttggcccactgtacgcagagatcacaaggcttcccgagccaaacccttcaggatctcacagctgcggagctggtcgccgtgtcactcagctgtcagctgctctctccttctctggtgtttcatggatacttcactttatgcaaatcccacaaatgacacaaggcaggggtgggacagcatcgggggtcagagaccacttcaaaaccacgcactgaaaacttttcagacaaggccagactacttgataaaagtcatcttccatgtcaggatgtaccgggacaccctggcagagccagcccagggcacggggagtaggagacactgataatgataaaaacatgcgggatgggagtgccagggttcgcctgtgcaattcaagagtggtttgtggtgttgaagttggcaattctgaccttcatctgtgcaagggaaacttgttgaactatttaagtccgagaaacttaaggccctaaaccctccgtgttcctcaacggcatcactagagagactctctctggaactcgcccctgctctgtacaagacacatgggtcagcatggggtgaggagagctctgggcaaagggcagacatgctgggaacccgccccgacacgtgactgagtaattagataccccgaccaatgacatccacaggcttccccagaatcatacatgcttctccggtaaactgtggtcccagtgacccttgggaggtaagaagctccccacaacacccccccttttgtggcgcttacatggggatcacagagtcaccaactgactgtgcaaattggacaggtgtccaaaatgaagcactaatgagcatgaagaaaatgagcatgaagtcagacaggctaaaaaaaattaagacaaaaagtgccatttcccaatttcagccctattaattaaaaaccaaaattaaaactgtgtggaatcgctcattatgtttttaaattaaacacaggctgacaaaactaattgcactaacagtctcccccagctgttccctgctgacctctgcacagttctggaaggctctgggtgaggggtggccggggaggggagagggggccatcctcaggaagacgatcgtgcaggacagagccaaggccactcagggaggatggcttttgttgcttttacttcactaacctggaaagaaagtatttgcttccaaattttgtcttgttttccaaacagaggctgtagccataaatatgcatcttattgaacatctactctgtgcaaggcatagtaggttatcaatcattccagggagtggagcgtaaggagaaggagagtcatctggcaccaagaactcagagctgggggagtctgtagttatttttagtgctgccactggtcagtggacacgggtgggagccagcgctggacggcgtggtggcttgacgtcctttgcccaggctggccctgccgccgtacagctctagcaccgactgcgggatgggggaccagcgaacctcgggagcccactccctcagtgacagcatgcggtggtagctgctcttatctcactggctggttgtaagaatccaagtaaattaagaatgtttaagaactaatacattttttgtatttttttttttttagacacaaggtctctatgttgcccagtctgaccttgaactccagagttcaagtaatcctcccagctcagcctcccagcgtgttgtgctcacaggcgtgagccaccacacctggccaataattaattctataaactggaaagtgttaaacaaacatttcccattaggagaactgaggaattttaaactctgttttactttttttccactactttcaatagctcattgtttcataaattagatggatacatgatgccactttttaaaactaaagaatccataattgtactgcccataagtaatcagtgctattgttctggtccattttttctaatgtgtaagtctgcctcctgtatctcattgtgtgtgtgcatgtgtgtgtgtgtgcatgtgtgtgtgtgcgggttggtgtgtgcgtgcgtgtgtgcatgtgtgtgcatgtgtatgggcatgcgtgcgtgtgtgtgtgtgtgtgtgtgtgtgagagagagagaagaagggagggaggagagagattactgaacaaatatttgagtgtctgcctgtcacacaagacatcatgccaggcatagccttcctagggacacagtgacaaccaagataaacacagctcctgcctcataaggataaattctatttgaagaaacataaagtgaataattacctacacaattaatagtgtaatcacaaaaaggatcagtatttcaaagaatcatttgggttacatgagagtgtgtaacagaacacccaccaaacagcctttacagtatgtgctgttcttgagcccaatctcttcccttagtgctgtctagcaggcgtttcctcgggttttctgacggctgcataatatcctctttacctgggtggcatggtttgactactcccccattgatggatttttttttaaataaaaaataacagcacagagcattcatgaacgtaaatcgtgagttaattccttatggtttgcttaaaatgcgttcctgcaaattggagtactgagttaaaagtcataaaaattttgaggttaatgagacatatgtcaacttgctttgtaaaagggtgaaccaatccataatcttacctcgtgtttctcaaataatgcctgttaacattaagtattgccctttaaaaactgccaatttgtatggccaaaatctttttctttttgttgttgttgagacaggctctcgctctgtcgcccagcctggagtgcagtggtgcgatctcagctcactacaacccctgcctcctggattcaagcgattctcctgcctcagcctgctaagtagctgggatcacaggtgcccatcatcacgcatggctaatttttgcatttttaatagagacagggtttaccacgttggccaggctggtctcaaactcctaaactcaggcgatccgcccgcctcggcctccccaagttctaggattataggcatgagccaccgctgtatggccaaaatcttttactattttaatttgcatttatttgattagtagtcatgtttaaaatatttgatggctgtttgtattatttttctatttgtaaattatgtccgagtcctttgcctcatttttcctattgcagagtcagcaattttcttattgttttctaagagtttttggtatatgactgaattaactttttatcatagtctccctatataataaatataaaatctacatttatattttctagtctatttgccttatcatttttaaattttgacatattaatagttttcaatattttagtaagtcaaatcgaatagcttctttttttgtgagattttctttcctttgcatgcatgcttacaaagccttttctctttctgaaatcggttaaatattctagagtattttgtctttttttataattcagttatttttatttgactgtggcccatctggaagttgttttcgagtacactatgaagggaggagcttctttacccatagccaactttcccacatgttgtattgaatcgtacatatctctccctttataacacagtacatattgaagaactatttcaggatgttttactccagttcaattcctcgttaacacaaattcttaacgggactagtgagaatccctgctttgttcctgatttaatgggacagtattaagtgagtaaagataggggttgtttatcatattatgaatatttcttaatttttacctacttaatattttaaaatcagaaactgtctaaaatgttatcaaattattctttttaatctttgaagattatcgtaggtgttgaattctctgcttcatgtacctttaattcactggtattcttttttctgggatattgccattgtaagatttggctgctattacggggtgacagtcttttcagtaaggtaatttagctatccattggcaggcaaaggacgtatttgatgcaggggtggtaagagatgggttggcgcaggaggtatgaaaacttactccaaattacagacactttagatatctgctttctttggggacgtaagaacagctctgcttgcaaatccaatgcctatgttacaggagtgcagttttatgtttggaaagagtctcttagcattatgagggttatttatgttatgaacaccagttagtttgcaccagttccaggaaagagattcaatatgaaaatatggacacagattcagatatagtgttgggagtatatgaatttgacttgtgtatcatatacctggattctctggtttagcttgtaaacccaatatttcatcataatccagtaaaccaaattaactattatggactgaattgtgtgctctccaaattcatatgttgaagtcctaacctctggtacttagactgtgactgtgtggagagaggacctttcaaaggggaattccattaaatgaggcctcggagtgggtgcttatccgctctgactgctgtccttagaagaagaggaagtctgaatacgcagagacaccggggccgcctctgtgtatggaggaacggccacgcgaggacagggaggaggcgccatctgcaagcaagaggagagccacggaagacaccagccccaccaagacctcgaactgggcttcaagcctccagaactgagagacattaagggtctgctgtttgaactgcccagtctacttctaaaaggatgaaccaatccattgttaggggagcctgagcagactaatatgttaacagaaaactgagctgtctctactgcttctctcatcaaagatcagaattgaaaggtggccaagaaacaaaaaccaatagataatcttcctactgtatcatcccagaaggcaaggatgaaaatcttcactcaggtcagctttgctctacccaagggctattaaatgcagctggaaaagagagctcccaggagggcagaaaaacctgcgagtgacaatgaacgtgaatctcatagtgctctgcagcccaccccagcccccagaacccaggctttgcaccctgagaaagcacaaagcacagtccacttctctactgagagcgggttctccaccacggccaaggagttcttcagggaagatgctactctgtgagtggctggatagaaaaatataaacagggttattcccctctttgggtctttggtttgtcccttctccaaaaggaataccttattttccccaacagcgtggcttcctgtcgaataactattcctaccatccctctaagaacatgcaacaggggaaaacacctgctgggaagctgccgccagaggccccaccctatcccggaagggccttagaggaaggaagttggggaggaggaggagggtcagggtggatgggaggatgaacacagcaactgctgggacacaggcttcggcgctgcacccacctggagctgacagtcaagcctcacttgatgttaaagaaagaggaaatatggtatcagaaagagcatgagggtaaatggcaagacctgagtttaagttcaaaattgattattagctgtgggactccacaaaccacttagacttgagatgtctctgttttattatctgtaaagcagggccacctctacccatctcataggttttctgacagttcagtcatggttgaaagtgctttataaacattaagtgtcatagaggaaatttgttagaagcgttaataacttatgtgtccatctgcacattgcacataggataggccattctttttagcattgcctttgcaattgatttaatttcccaagctctgttcaccttctgagaccataacaaacattaccctgaagtttctgtttccatttccattggtcccactctaagtgaaccttggcaatcaaaagggcatcatcatccctccttctactgagcccagtgagctcacagctggaacgctgctccacgggactgaaagtaaacactttaagtttccgggtgataactgttggtcatggtcaatgtcagcacactcatttaagaggcgcattttcttggaaccactcactgaaatatacactcaacaccaaatgtgagcttcagaagatattttaagggcatcaggaagatgaaactgtgcctgccccttgcggcatggaggaatccacacacacacaaacatttctacacactcacacttgtattctgcttctgtgtgtttacatgttgtttcttgtaagaatagagattgcaaagctcaacttaaaaaatattgaatggtaacataaacaaattattaggccaaccacagagaattgcaaaacttttgactgttttttagttacaaaattcagttttatacattatatattaagaacctactgagcaagaaaatattctattaagtggtatttgcaagagattattctaatagagagtgtgctagaaaagaaaagaaagatgatacaacggatgaggcccctactggatatgaggtgcagagagccagctttcgcctcctgaacacagatagtcctcctgactcctttaggaacatgagctccattggaaacatctggaagttgaggataagagaaaacaagtctggccaggtgtggcggctcacacctgtaaccccagtactttgagaggctgaggcaagaggattgcttgagcccagaagttggagaccaacctgggcaaaatagtgagaccccatctctacaaaaaataaaattagccaggcatggtggcgtgtagccttcagtctcatagctgtcagggtgttcaagttctgccttccatacagaacaacatctgcagggctcacagacagaggaatgccccccaagatactaactcaggtgaaagattgtgagatttcatcctcaggtacacacaccatggtgtgacttacaggagcaccccgaggtgtataagagtgtccctaaattgatgttaagaatactaatgaaggatgaactgagtctctctgcagctgcctctgggctttgtctggtgtgcctatacccaatgtcacccaaacccaaagaagggtttgcagcagcagctgcacaaagctgctggacaaagccgaatctccaggagcccagtcccaccctcccctctgagaagacccccatgtgacttccccacctttgtggcgcatggtatgaagagtacaggaaagaacaaagggacagcagccagggcacagatgcaaactactttcagaaacgtgttctcttctgaaagactccagagccagtgcgaccctcattagaacaagcaccggagacatgaagtttgctactgaaggtctcccagcaagctgcaggcggccctgaccaagcttaggtcccatgaaatgagccccacttgcagagcttgttctgaacctcgttttggggagaaacttggttgttcatgtcacggagaaggaagccgagtgaggatgagaaaagcaaccttcacagaggcagagctggatcagaagaaggtgcagctctgctcagcacggcccccagcctgcttcctgggcaggaaattcacatgtgaaatccagtttctgagaggctcaggagccttctttgacatcatgatgatgaacccaatcatgtatatatagcttaaatcaagtggaaaagcccacatcaccacaggctgcgatctgaaggagcagagattagcaatctagaaatagaaaagttattgaaagccaatcttctcccagctgattgatccgcaaatgatggcaggaaaaagctgaactcacttcagaagttggtgtctaaaattggagactctttcagcaaggcctgcctgggtcacggggtctgccccatctagtgagtgctctgctgtgcatcagagagagggggcgggactggcatcttcccagcaaagtagggggcaagggagcactctgtaaaagcaggggatgatgtgtaaacccatccatcttcctagcgcatcaataataatgttccactagctagtcaggtactcagatcctgacatttgtcagttgtgtcaaaatgctagaaagtaccatttcaaatgctgttatgtgttgtttataaaatataaggataatttcaccaaagaagatatacaaatgaccaagaagcatatggaaagatgctcaacgccagtcactaatccttagggaaatgcaaatcaacaccacaagcaaatcaacacccgataagataccccctctcacctgttgggatagctacatcaaaacaaatagcataatgagtgttggcgagggtgctgaaaaattagaattgttgtttactgttggtggaaatgtaaaacggtgcaggagctctggaaaacagtatggccattcctcagaaagttacacatagaataaccatataatttagcaactttcacttctgagtatatacccaaaaagaatggaaagcagagcctcaaagagacatttgtacactcacattcatagcagcatcattcacagtagccaaaagatggaagcaacctcagtgttcattggtggatggatgggtagcagagtgcggtgtaggcacacaatggaaggaaatgacgacgcacgttgcaatgtggatgaacctggaggacattatgtgaagtgaaataagctgatcacaaaaagacaaatactgtatgattccgcttacgtgaggtaccgagaatactcaaatcatagagacagagagtggaatggtggcaccagaggatgaggattagggggaaaaagagttattgcttaaagggtagcatttccgttttgagaaaggaacggagttctggagaaagatggtggtgatggttgcacagcaatgtgagtgtacccaataccactgaactgcacactgacacatgcttgagacggtaaatttaacgtcacatgttttactcataattaaaaatttttaagtgtaaggataaatgtaactgcagtatatgtgcatgatatataacagcacatagttacacatagttatgtcgataatttcttattctatagcattttaaactacagaaaatatacctaatgaaaattactaatttgcctgctattttgttttaacatgcttgaaccataagctcaaaacacctgttgataccttgtgcctgcctttgaataaaacctaaatccttctaatgtcgccatagatgagatgtacaggccggatttcatgtcatttagtcaggaaaaatgtcacaggaaagcagtttctcatagatatcagctttcaaactttctacacctgaggaccacttgggtgggtctaagagagtgactgtgcaccccgaccccctgcaattgtggaaactcagaatcacgagccaaagaaggtaaccgggataaactgggtagaatcagcaacttttggagggaggggatcacacctttaacactacagctaggcgttttgaatgaggtaaaacctgaagacaatctgaataatgagaaccacagcccttggtgtcataaggaacctttcaagccagtgcctgccagactctgaaacccctgggccctgagtgtacaaagaaaagagggagttcctgcctgcgtcgttggtagaaagtaaagacacagatgccagaggggaagagcacagcccgcacacagcgggagctcatgagatgtttggagattgatgggcacatatacagaacacagtctcctggattaaagcactcagtgtgcagggtggggccagggaaaggacaatgccaggttcctggagagctggagtgacacaaacgagcaggaacaggactgcaatgccaccgagcagtgcaagcgaggtttggtttccctgagcatttggagaaactgaaggaaatgcagagtgaagacagcgttcctgaacacaaagcatgaggcgtgaagtcccaaatccaagcccaccctcgttccttcccttgtgtggggcccttggcacctcacccctcagttcatatggtggggtagtgttgagagcccgtcgctttcagccagattgtggccttttccattccaagccacaagagcgtcagacgtgaggctgtgcttcatggccaggcagggactcggcatctgaacgactcagggccaatcaggagagcgggaaccacagcagttatttcacagaaagtgtttcatacaaagaattggctgagtaaggctggaaggctggaaaggcagaggaacccccagtaaccccaagatggtaactgcagggaagcagctccttagaccgagggaagagggtggtgtcgtgacaacctgggaacactgagaacggaggcagtgctcagctgctgggagcctctctgaagaggcacagggaggctggttctgggaagcaggcaaaataaatggacatgtaaatgaaaaccagaaactggttccaatagcttttgccagaattaagaggtttcctttctttttttcttttccttttctttccttccctccatccctccctccctccctcctccatccctccctccctcccgcctttctttctcttccttccttcctttctttcttttcttttttttttttcagggcctcactctgtcacctaggcaggagttcagtgatgtgatcaccacggctccctgtagcctcgacctcccaggctcaagtgatcctcccacctcagcctcccaagaagctgggaccacaggtgtgtgcctcaccatatctggctaatttttgtattttttggttgagacggggtttcaccatgttgcccaggctggtcttgagctcctggcctcaagtgatccgcccacttcagcctcccaaagtgctgggattacaggcatgagcccccgtgcctggccagcattaggaggtcttaatggggacagtgacaggaatatgaggcagagctgggggatcagcacctgctccttcccccgggctgcctgtctctctggcaccctctattcacagggtgcatggggcagtggacatggaacatggacgaggctcccagcccatctgctcccccaggccatgtgtagagggtgggtttggagctgagagaggacagctatgtagtcaacacactgtctgatcccaaattcatgttcctggattctgcctcaccctcgcctctgttgggggttgagaacctgccccaagtcaggtcctactgcgttttcatgatggctccaaagagtctcccttgagtgctggaattgcacggggcccagcaccgttggctgcaagactgtctagtagcctgcacttccaagtctcgctgccttctgggtgtggccaaagccctgttgctgcctctgggatccctgctcctccccatcccctgccagctcactctccagcctgacccaccgcgtttgctcttggtttatcagctcatgcctgtgatgcttcatcccagtgggtgaaagacaagattctggctgctccctgcctcaccccctcctcattcctcactggtgattcctaccgaggtccagggtaggccagggcctatggggagacctactatggtttgagggtagccaccctcctgcaggtgtgatagcaaggaggaacccacgtggggcccgggaagtcctatggaggagttgccaggggcaaccactgtgggttgagggttgctcctccctcttgcaggttcagaactgcagcctttccagggcatccagagatgagggcactcaggagaagggccttgcaggcatgagcctcacagaggtgcaaatggcagtgccaacacattgaataggatgtggagaatgtacacttccagtcacaggaaagctcaggtgctgcgttcagggtgcccttccctatgtaaaggtaatagggagtggaaaatcacactcatccttcaccggtccgtgcggccttgcccttttcggcagcctggtgagaggtccatgtggtgaggctgtaagccctgcaacacgcgcatgagtgaatttgggagtgattccccaacgtcatccttcggatgagaccacagccctgcctgacagctggatgtagcctcatgaagaactgctgagctgcagccacacttctgcccccacagcaatggtgagacagtaaatgcctcttttgttttttaatgccagtaagtttgggggtaatttgttatgtactaaaggtagttagtacacctcgtaaaaaattgaaacatactatttcattctgagtaacatgactgccacactttgaagtgattagtcttcaatgagtatccctcctaaaacataagtgtgatcttaattttagacatcaagattatccaggtaaagtgggcttttgcataacattcaagaatatgaccctcacctctcagggcctttgtattcacaattttgattctcatatttgaaacgcaacaattgatagttcctacagatgatgggagtttctctactcttaaggctaccctcaaatgtcagctaaaattccactaagtgtccaacacgttatttatttatttatttttagacagggtctcactctgtcgcccaggctggagtgcaatggcatgaggtcagctgactgcaacctccacctcccaggttcaagtggttctcgtggctcagcctcctgagcagctgggattacagcctcgtgccaccacgctcagctaattttttgtagagacaggttttcgccccattggccaggttggtcttaaactcctgtcctgaagtgatccacccgtctctacctcccaaagtgttagaattctaggcatgagtcaccatgcctggccccaacatgttatttaaatgcaatgttccttttgcctgttttatgagagccatgcagagtaaatggtcatttttcagacaagtagaatgatacttctggaaaagttgaagatagtcattaaaattcaggctgagggaacaagaatctcattttgtcactagtcctggtctgttgtaattacagcaaagatggtgtgtctggtaacctctctattcagaattaaacaagacacgccaacctgtggctgcattgggtcgaaagcatttcctattaacacctgggactgctgggtctaaatagcaacaatctcaaggcagtcatattcactactcctggagcccccatggtgtactgacgctggtgacctgtatattggagggggagccgctccaccacacgactcttctcatgatcaaagtacagacactcagtttcaaccacaccagcccagccaagttattccagtaagaaaagactcaacacagcctcagatggcaaggtcagcaatctgacagcgagctgccgtgggtaatttgtcaacatccactttcttctctgtgctctgaaatctacacagcgcagggaaaaatgcaaagtcagggtgcagatatcaggctgagtctgaaaacctggtaacagggacaagcagaggctgcccagcacatgggagggaagggtggagctggacactggccagtgggctggccagagccgggatctcagagcatctcacaccagtaagtcagcagcctcagagatgcaaattgggtggggcagagctcaccgaggttcagattcgcaggaggacagcaggggattaggaaggtccattctcagttcagagggaggagtccaggggtctgacacctgtggccaaaccaggcgtgtctccacctagtcatgatttacgagttatagccaagtgcacgacctcagcatttcctgtgggtcccgctagttgctgctggattagaggttgtgtgtatattctaaagtctacttggaaaaaatgtacagacaccaaggaaaaccctgggttaaaatgttatcgggaggttaaagagacccagggcggatatgagggagggactgctccaggtatgtggggacggagaacactacggggaacaagtcccacgcacacactgagtgctgcatacctcctgcaccacaagcgatactcaaccagaagccgccaacattcagggaagagaaggaaagccggcagatactattcatctgctagattcacagcagataacaagcataaccagtcaacccacggatgctaattaaaaagatacttaactgatttcctgacctgtccccctcgagctccaactagcactgcagaatgtttccagtcatcgtctgggctctgtgggtgccatggaggcagagtacccatcgctttatttgcaggcagcaatttcaattggataccttcaattctttttcttggtttctagatttctgagtcttaccatccaaaatagtaagaaaaaaatgcttactcctctactgcgatactgtttacaaggtttattttctgagagaaaggaatgacattgtactggacagagggctgatctcagaggggggccggctcaccggatgagagcagttgaggatgccaccatcccctgtgtcccagggagcctgctgcttctgtgtgtagtggggacaggaaatccttgcctccttcacagatattgcctctccaaagggaaggaagccttccccttggctgaaagagaggcagttgccgtaagccttaagcctcggcagaaggaggctccgcactcttccgcgtccctggcttggagcgtgggtttgatgttggcgtgggcttgctgcagccagctgatgtgcagcagcctgacctgcaggctctgggtgggcccccgagccctctcccagccctccccagagctgcccttccctccccacttcctcccatctgctatactaggtgcacactcactgtaaagggagatgcagaacctcagtctcccgctgcctgtccctctggcctgtgtcacgtatgtgcctgtggatgaagggcaccttctctacactgtagcgctctgagccaccctcctccacgtgcacacagacccaggaaggcctcctctcaggaccaggggtgcaggctgcggctctagggatctctgtgctgtggagggtcttgggaagcactgatcctgggtgcagagcagtcttgtccccccagagctgtcattccaactgcagctgccataagggggtgcccaggaccaggctgcactgaggtctggctgcccagtcagtcaacaaggaccctggaggagaaatgactgagtcgctgtccctggggggctcctggtgccctgtcgacaactctgcacagccctacggactcccagctgcagagcacctggccctgagcccatggggccagctgctatttgatggatggagggtccacatggctcaggaggcacaaaacaggacaaaagtttgcaaactctaaaccaaacttgtccaaagcgcagcctgcaggcggcacgcagcccaggtcagctttgaatgtggcccaacacaaatttgtaaactttctaaaaatattatttcttttgtgatttttctttttttagctcatcagctattgttagtgtattttatgtgtggcccagagaacccaaagattgggcagccctgccaaactaagcttgccgtaagacatgccaaagcatccaaaatttccttaccatttgctgttaaaaatagctttgatttgttatccagacctactgtgccgttctaaagagttaccatcagataaatatacataaagagccatgaacattttctcctcagtgaaattctatggagctgttgctatcttcacaaagcgtgtcaacagccctgaagagagctgcatcgctggggaaagagagttcgggcaagattgttgattcttctttctgatcaagaaaattgtgtactggtactcttagagccctggagagtctgcaaacaggaaatgctgagttcctcatcaagacaatcttttatagccatccatgtcaataaatagattatttttaaaaaggaaagcaacataatgcattcaggaagttatttgtgggaacaggaaacctcttatttgaaagagttattgactttgattggggacagtagtgctttgaacatggcaggtgggcgctgggcagaggctgctgcctggctgagggggacacaggcatgttagaggcctgtggtgtccgttctgatggggaccacgctaaaccgtgggactgctgccctgggagcagggagaggcagctcaggggtggtctgtctgagcaacagcaggacacgcaacccagcaggcaccaaggacaagaggtcgatatctttagagggagaccgggtgaggaaagggcttgggaattaggaaatacaaaataggaaatcaaggaatgtgttcagaagctgtttatggaaataagaaaactcttacttcaaagatatgggacatgaaccagaaataagcatcatgatgatgaagacagtgttttgtttttgtttctgagatggagtctcactctgttgcccacaatggagtgcaatggtgcaatctgggcttgctgcaacctccgcctcccgggttcaagctattctcctgcctcagcctctcaagtagctgggattacaggcccctgccaccacgcccagctaatttttgtatttttagtagagatggggtttcaccatgttggccaggctggtctctaactcctgacctcaggtgatccacccacctgggcctcccaaagtgctgggattataggcatgagccactgtgcctggcgaaaagacaatgtttaaacttcatatttctacgaaatattctgccaccaacacagacacataaagagtgagctgcagtgcaccaaacgaatcaggtcctgtggttctcaggttcttctgttctccttgggttccagtgccatggccagggctttctgcatagggatcctctgcccagcttgccagcaagcggagggcactcacactggggacagggcccaagtcttctgcttaaaagaaaacaggacgaaagccaaagggaagagggtctctcccacatatcatcttcatgcctgggaggaggccggcctccccttcccagtggggaagcccctgcagttccagcccacctacccctgctccttcagtcccactttctctccctctcccccagcccaacctgccatctctcagccctggtcctgccccagtttccacgctgttaatcagctgcctttaaagatgttcgtggcacagtcgtacctgcaaaggtaaccaatcccacaagagcagagaggctgtgacacccggcaaggccctggaaaatcccctccccagccccagcgcgacgtgctcctgagatcagccctgctgggtggtcccctccacagccatggacaacatgcaggctccttccttctcggtgggttaagacataaggaactcaccaataggaaatatgaagatctagtaaagtttcctctcatttcaatcctattttgtgcctgtttccagttccactcactagaattcctcaacactgtcccaatatttgtttttgtgttttagcactcctattttaaatcgggaggaatgctttcacttttccagttattccttatttgtttcatcctgtttgttttttggctattgtgtcatatcttcacagtctctctaggtttttaaaggtctctgttccctgagttctatatgctgcttctgaggtcaccatttgtttgcttttctctgggcaggtaaggaagctgtcaatcgtcataacagaaagttgagtgtaaacaggcttcgccgtaagggattcactggctcgccaatgaaaagtcctgggaggccgggtgcggtggctcatacctgtcatcccagcactttgggaggccgaggggggatggatcacttgaggtcaggcgttggagaccagcctggccaacatgatgaaaccttgtctctaccaaaaacacaaaaattagctggccgtggtggcatacacctgtaatcccagctactcaggaggctgaggcaggagaatcacttgaaaccaggaggcggaggttgcagtgaaccaagatcatgccactgcactccagcctatgcaacagacttaagactctgtctcaaaaaaaaaaaaaaaaaatgtcctgggaggtgcagcctgcacaactgccttatccacttctcttctcctgaagggctggccctgccccaggccggtctcccctagaaagtgtggccggttgatctccggaagcgcaagtccaccctgtgattccacgcctcaccctctagcggctcggctccctattacacgggaagattcctcttgatttgaagtcagccatgatcagatctcacctaatctccatgtagaacttgtaaccaggaccgttccaggcacacacttcagactgtcccctcctggaggtgtccctgtgctgagccctcccgtgaggccgggcatcagataataagacttttccccttgaaactccacagccatctgcttcatgtttccacagcacttaccacactctgctgcgaacactgctcccaacgtctacatattcacgctcaaccagatttaaacttccttcaatctacatgtttgtatgtatcctacaataccaaacacaatttactacacttcaaagaggctcatgattatgaattgaattttttctcttgtccttcttgttttgactgattagttattggagaaactggaactgagaaaggatttctttaatggtccagcacataggagtagtgtgtcgtgatgttctcttgagaaagcctgggcttctcttcaacggagttttagttaacttggagaaatcttctgtttccagtatgctcaattctaccaaatttaggtgaatttatatatagttgttttgcgtattttgaaaatttataaccttcaagggctaccaggtgtcttcacaacagaaagcttgaggtagtactaggatggaaggtcagaggttgacaccttccagaaagacggaacggaaggacatgggcatcaagccaaggttaggttttatacctaagaggcagaaccgcctgattctgagaaatagagatataaaatagtagaagatactatacaatacaaataccttctactgtgtagttaaaaataagaaacgtgttcatatcagtttttttttttttttttgagacagggtctcactttgtcacccaggctgaagtgtagtggcatgatgtcggctcactgcaacctcctcctccaggctcaagcaaccctcttgcctcagccttccgagtagctgggactacaggcatgcaccaccactcccagctaatttttgtatttttagtagagacaaggccaggctggtctcaaattcctggcctcaagtgatctgcctgcctgggcttcccaaagtgctgggattacaggcatgtatttaccaacctgagtaggtattaatgctattccatctttatccttgaaaaggggaaggaagatatttttggattattctaaaattaaaagtaaattatatgatgcctaggacttgccacaaaataacctggagctgtgtgggtaggtggagaaggagagggagtggacacataaataaaacaagactggcctggtctggtaattttggaaattatctgagacagatctgtggggatttattacattctttgcttccacatgtgcttgcattttttatgataaaactcatcttttttaaagcaggggtttaacctctcaagcaaatgagtgtgactgtcacttttaaaatgcttctgatattaaaatcactcccagaacagcataaaataagtcatttttaaagctggtgtgggatgtagctgtgatcctgggaaaatataaagctggtttccggtatggatccacacctgtgctgtgttcataccaacagcccggctcaagaacatatgccagccgtcaagttgtgcaaccagcaccaatttctcctgccagccagagcctccttaccttcccaccttatttccggccacttcccagcacccattcttactccaggtgggtctaaatcctctctgctcctcacgaggctcttccacgcttatcctggctcagaacatctctcatccccctgactgggcctccaccctccacggggaaccaaatcatgggaaagctggattccacaagccgccctgcaagcccactgaccgcagaaggttgccttctacaacagcttagctcaaaaccttcttttcgctaaataaagttgtattttacttccatgcaaaataaacaaaaactcagtttcctgccttcaatccttctctcttttatttcacagaaggaactttggttctcttaaataaggcttccactctgcatgtctttcccaacagataagatcgtttacgtctacttacagttctcaatgtttgctgttctgcgtcaccctcagagttacagatgactgtgactcacgcctggagaagcagcaaggtggggtgagaaaggccaggtggtgacctttgtccaaccatggctggcaagcgacaaagaaagggggctcaaaacgtggcctctgaagtctcgatcccccgcatttctgctgcgccttgagccccctgtgcttcatggggctgggctctcaaccgcaaagcaggtattttttgaccacagatgaatttctaaaatttggcaaaaggatttaaaaactctagaaatagtgtgtatttagatatctgttccccagataaatttgagtatgactttttttgatcatggtcattagtagataaaaccgtatttgtttacaagtaatattaattctataggatttagttcacgttacaaaacctggttgaccaattaccagcactaacagaactaaatagtaagtttggagaaagaaactgtgaacagaaaggctattcagtaggagatgttgctttttaagtcacaacaaaaaaataataaatattgtcaccgggcgtggtggctcatgcctataatcccagcactttgggagactgaggcgggtggatcacctgaggtcaggagttcgagaccagcctggccaagatggcaaaaccccaactctctttaaaaaaaaaaaaaatacaaaaattagccaggcatggtggcgggtgcctgtaatcacagctattcaggaggctgaggcagaagaatcacttgaacctgggaggtggaggtttcagtgagctgagatcacaccactgcactccagcctgggcaacagagtgagactccatctcaataataataataataataaataaatattgtcacttatttttgccagtgcaaatctagaaaacatgagatgaaggataatgtgtaggacatagccaaaaagagcttgaacgtgaaagtgagaggtaacaacgtgctagcagccctggctcgctctcggcacctcctcaacctggcggcgctcctcgatctggccgcgctcgaggagcccttcagcccgctgctgtgctgtgggggcccatctctggggctggccgaggccggagccggctctctctgctggtggggaggtgtggagggagcggcgcgggcgggagctggggttgcgagtggtgctcactggctggcgcgggttccaggtgagcgcggctcggcaagccccgcactcagcgcggttggccagcgcctgctgggcttgatgggggacgagctccctctgggctgcaggagtacctggactaggtgccgcaaagtccctcggcagtgccagtgagaggtgaagccagctgggcttctgggatgggtggggacttggagaatttttctgtctagctaaaggattgtaaacccaccagtcagcactctgtgtctagctaaaggtttgtaaacgcaccaatcagcactctgtgtctagctaacggtttgtaaacgtgccaatcagcacttgtttagctaaaggtatgtaaacgcaccaatcagcactctgtgtctagctaatctggtggggacttggagaacttttgtgtctaactaaaggattgtaaacacaccaatcagcactctgtgtctagctaaaggttcgtaaacacaccaatcagcactctgtcaaaactgaccaatcagctctctgtaaaacggaccaatcagctctgtaaaatggaccaatcagctctctgtaaaatggaccaatcagcaggatgtgggtggggccagataagggaataaaagcaggccgccccagccaggagacctacctgctctggtccccttccacgttgtggaaggtttgtttttttgctctttgtagtaaatcttgctggtgcccactttttgggtctgtgccgcttttgtgaactgtaacatctccacgaaggtttgcagcttcactcctgaagccagtgacagcacgagcccgccaggagggacgaacaactctggacgtgccaaccttatgaactgtaacactcactgtgaaggtttgcagcttcattcctaaagtcagcgagaccatgaacccaccagaaggaaaaaattctggacatatctgaacatctgaaggaacaagctccagacataccatctttaagaactgtaacactcatcactagggtctgtggcttcattcttgaagtcagggagaccgagaacccaccaattctggacacaaaaggagacttgctgaggccagaggcacagttcaaacttcagtcagatgcagaatcggaaaagtttcagccttgctgcccctctcctcccatttttgactctggaaaggcctgtgagggacctgtttggcgtatcgagtgaggactgctcttttttaacagcagccgcttgtctctcccatatcttctcaccccttctgctctgaatcaggctttgttccctagtgaagcacagaaagcagggaaaattggagaaggtggaaagggcagagaggcagcgccagagcacagatctagccacaacgtgtccaccccactgcgtttagaaaatgcaaggaaggatgtaccaaaactgcaggttacaacactgtatcttagaaattttctgagcttaagaaatagatgccataccccacgacaaaaagaagtgggttgcacaatggacttgtaccatttcctgatacaaatgatgcttatttcccaagaaaaatacgaggcatagccaatggcctaggatgcaaaattataaaccaactcattgctccactggaaaccacgcccttcttctagattccgtcttgacataaggtccaagtttcttatctgcaccctccacacggcatctcctacccctaattcctctctgacacctgcagccacggctgaccagtgtgaccagtgctgatcggtggccccaggaaggctgagctctctccctgcaagttgcaccaggattctgtgccccgaagggaaaactgttcctggtgattcccgtgtcccagttccttccttttgtgattccagctcacaggaccaggcctctccctggatctccccctgcccgcccccccccccgcccccgcccaagatcttgctcttggtggcctgtctcccagagatgaaaagtcctgtcttgacccttgtttgacccttgtggcccagggctggggcctgacacctgcagcaggtgcctagaatgttaatgccaccaacttttcctgtcctctgctgggaatgccttgtccaccagcagctcctgccgagatcccttgatcggctccttctgtgagtctcgacaccacccaccaccgcactgttctcccgcagagatgacagacagcttaggtttaagtcttctgatgcccagcaagaatatacaaagaaaactggcctaaccaatgtattaatagtaaaatctggttcattcgtaagtagagttctgagggttttgagatgctgctgttatgtttaagctacaggcaatttacccaaggaatgtgatgttgaaatatgtttcagaataaacttccgcttgaaaattacaggcaataaaatgtaccagctttctccttttcttcttcattaatgaattgaggaacataaaagctcaattaaaaataaagactcatgcgtcacttagttgtttttagtcctttcaatttaataaaacattggtattgaggtgtcgtaggaaaatggaaagtcactgctccgtgtctggctcagtatccacgtttggcttacatcataaatccagagccatggggagtgtcttttccctacttcatcggagcctagaatgcccacaggtggggtccggtgtgggcagcacaggggaagcatagagagggtgagacagccctggggaaaggcaggggcagggagcaagctccgagggcagggccaacatgtcaggtttactgctgaactccagggtctagaacagagtgagagggaggagggactccataattagctgtcgaataagtggaatcccaagaagaaaactgggtgggagtgtggagataaacactagcaacaacgacacaaagaaagcaaggattgcttcatagccgggacaagctcattcatcggaaaccatgaaatggaacctgtctccccacacccagcaaaataacagccctactgcctgtcctcagagcgccctatgaccaccacctacctcagtaaagagacaacccatgcatttgaccacatcctaagccctttttccccttctctgtttcttctcaaaggccaggtgatcatgtgggttccagctttataaccacattccttagacccaaaccaatgagttgaaggcatgaatgaagtaggtaagtgaaggcatgaatgaagaaatgcaacgagaaactaggggaaggcctaccagctgatggacgtcagatgggtctcgccgcttgccctcggtgaagcccagcctgagaccacagctggcagctgtgcttctgtgggagaagatccaagcgctgctcaggggtcacaacatgcaacatgactctttctacagggcaggggcaagcccttaaccatggaaacacatgcatttccacgacaactcatacctacgtgtgcctctgtgttggagagtattgcatattgcagatgtccaaaagtgcacaaagttttaactttatcaattacatgaagtgatgctctcctaactcagagttacattttggcaagagccagaaatgtaccaatgtatttccaagcaagcagtgagtaaacaggaagcaaagtgtttgctccccatgatcaattataatctacagaccacattccttccactctagagacctagaaatatgtttttaaagtatctcattagtttaaattatgattttaaattactttattagttacttgtgtggccatttaaataagtcagattttactgggaataaatcaatgattcatctaaggacaatgtgtgactcaaatatttccttccattaatcagtaaatgttccttttcccaacgtgcttccccgccaaggaaatcaatgtctctggataactaggtaggcgcaaatatgtcagagcacatcagactgagaacacagaagggaaacacatctggagcttttcgcatccagggcctcactccaccgctgatacgctggtagctgaatctcgtccgaccacatggtgggtgaggctgggacagcctggagatacaggagagagcagctagcgagaggtccttggggtgttcggcagctgtggtccctaaggttccagcccccaggcaggcctacaacagccacggcacctccccttcccttctcaggacccagagctcaccaggcagcagcaaggggctaccgtgcaggagttcatcttggaccctatcccagacacgctcttgtaggaacccaagataactggaggagtctataaggaggtgttgtcatctagatgtagctggggacagagatcagaaaacagggcccaacctccccagtgaggtaggagacgggacttgactctggaggcagggttcagatactggaccaaactgagaccctgctaacacagggacggaggtcaggggatgtacccatcagtgtgccatgtctgtttactattgccatggcaacccccaggcattaccgccccttttcatagcaatgaccccacaacccaaaagttactgcccttttcctagaaatttctgcataaactgccccttaatctacatgtaatttaaagtgcgtataaatatgactgcaggcctgccctgagctgctactttctgcctagcaggtaactctgctctgcaggagcagtcacagagctgtaacactgctgcttcaacacagctgttttcttccaccctaccgtctgcttgctcttgaattctctcctgggtgaagccaagaccctttgaaggctaagccccaatttgaggctcacctgtcctgcatcaccaggaagaccagagaccaaaggtggggtctcaccgggtgcagtcatcctcaagccttcaccctgctctctgccctcctctgctctgccccagaggccccaggaatccggcagatgccgttggatgtatccacagtgcagctccatccccgaaagcctcacctccagcctacatcgcttttacctcccaacttgaacatttatcacccttccccctgaacaacttgatttgttttctaagaaaaattctgaacctactttttaataattaaatgccctttctccttctttccaatttataataagagaatgtcttacaaatctgaaaagcaacaagaaacattgtgccagaggaggagctaaaagaggctatccttacttgagagagcgtggtactgggagccacactgcagggaggcccttgcaggaagagggagatgtcactgcgggatggtagctccagagccctgcaagggccaaccggcttccatggaagcaccccaacctcgaagtccccatccagtgggcggagctcagcactacaaggaagctcagacatgaccctgatggagtatgggtgggtgtgcaggctgcggggacagaggccgaggaaagctcaggcaggaccctgatggagtgtggagtgtgtatgcaggctgggaggacagaggccgaggaaagctcaggcaggaccctgatggagtgtggggtgtgtgtgcaggctggaaggacagaggccgaggaaagctcaggcaggaccctgatggagtgtggggtgtgtgtgcaggctgggaggacagaggctgagaagggcaatggttaaaatgatctgttggccatttctatcactgtccatcccacttgtcctccctcagacactcgggacaagagtccaaggatcccagacctctgactttctttctgccctagtttcatggaggtgaactgatggattcatagccatgcatctttgagagttgttggagtacagtttcattccctaggattagggaagatcttggattcaaatccatagactcttcctgagctcccactgcatcccagcttttgaaagaattcctccccgtgcaccaccactcttcaccctcacgacaattctatgggcatcacgtttcttatggcaaagagccttgtaggactgaggttcaagctgggttcacacagccaggtacttggtgccctttctcccaccacatctcctaccacctccttgctgccttgctccccggctaagctgggtctgtgcctctatctccatggtatctacatcactgcttttaactcctaccatcgagtgatcccgcagacaatgcaccatggtgatggacgatgggcccatgccctaggagggagggggacagagggcgaacgaaggggctgagacgaaggagctgtgaggtctttacattcacagcctcaggtcttagggctaatgagaacgaatgactgggataagccaggtgcctttccagacacctacggaaggatcgagaatcttatttggcagtgacaccagttctaccccacagagatgggaagagatcaggacagcattgacctaagggccatcctatgctcatgtaaggtcggtcctgctgagtcctgccgccaggaacaggagtcagggtgcatatcgggcaccaggcatgaggatttgtcactgggaacaaggatgtgtggagaccgtgcaaagcaacccgacctctcctactgtgggaccctctggcccagggttatctccatgtcacctggtgggctcctgagcaacttttctgcttttttgtatgcagggaggtgaaatgacccagaacaagccctgaaatccaagcaggttggtgtgaacttctgaaacctctgatgccaaaccagcacctcccagatactctggagccagcacacatgctctgcacccaaggccatgtggcttctgctgacaggccccagcccatcagtgcatctgatcctgcagcccatgtggcttagctttccttctctctctgccccgaattctccacccctcactggctcacttctgctcatgcttcagcctcctggcttcctctgggaagctgccttgctccccggctgagctgggtccatgcctgtatctccatggtacctatgtcactgcttttaactgtgctatgttttgaggacctgttcaggagctgtttcctgcaccaagccgagagcactcacagcagcacccatggtaggagctctgtgcatacctggtggattaacatgtgccaattacagtgtggccacaaatccaggacagcaccaccacttccttcacccgaggtttgaaggagaaagaacaggggtgaggggagaataggatcgagtacaagtccggagggactgactgggtgcagggcagagggcagctctgtctgcgcccattctccatgctattgagatagccatatgaagacacaagccaaccaaggcatctgccctgccttcacggacacctgcgactctgcctgggccgtggagatccagacacagacagcaatgccccagcaactgcctccacggtctctgtggggagtagcagcattgtgatcattgcaacagcagccaccgcgggcagagttcctcctgcgtgccaggagccatggcaggtgcgatacctgcctcgcttcgttgaccctgacaaggtcacagggcaggggatcattagacccaaatttcaaatgaggaacacacagctgtagtctgcactggacacgcacatgccttgatagcacaaggcaccattactgagtgtccatggtgctgtgtatatattcactattgaaagaacaacagtggcacctccctgcctgtgagcgtggccttgttgctgttctagtgggggcagggggacaccagtagaggccagcggggtttttcacccagaagctaaagaaaaggaagaggtggtttggagggaaaattgttgactgaagaattcaactattgggagccagctgactccactctatttatttttctattaagatggtttactgaattatttgaattgcaggaatccagtcattttaatttgctcagatgtggcttattgaactttgattttctgtgctgaagagcaaacagaacgttcaaacaaatttaagttgggcacgtttaaatgaagcgcagcattgcgtcggcggctctgtgtggagcgttatcaggatttgctcaatgcgtgtgcacagagatgcaaaattgcctttaccagaatcaatcttgggttatgtgtggtccaaagaatgcttctaagccccctgcggtaggagtgagacctggaagatatgggcaatgagacaaaggcccccagaccaccactggggagggggttctattcacaggacgggggagcctgcttgggaaggagcagggacagagctgggctgctctgcatgacacagcgggacagggattggctgggaggagatggagtgagtattcaaaaggcaggaggagggagacagggccgcagacctcagggtgggaggggtatgtggggttgggaggccctgacgggtctctggaaggcgaaggagctggcagggcttccaggttcactgtggagcagctggggtgctcttttgtctgctctgcctgcctccgaggtctctgggtgtctccctggctcactaaagctcgtgtgtggtggatctttgagggggaacttgaaaaagacacaagctttgccactgggacactgcacagggcccccgccagggtcctcaacctcaatttcccactcgtgtcccacctgcccggccccctctgctcatccccggccttgccaggggcacatttttacctccagtgcagctgcagagggagctggccacgggtggctgggttcacaagtcaggaccaagtgattaagcagggccacgtgtgccccctagcaatgagcagaaccgtggggtaaaacaaaatcactgggtttggaggatgaaagggtaagaagcaggtggctaggagaggggcacacagtgtcaccatgaggaggtgacatgatccccaggtagggggcgggaaggcgagagcgacagcgtcagcgtgaggctggcaacagacagcgttgaaaccgcagttgtgcttaggggctaggacgtgcctaaggttagccaaacaacagaaaccccgcatgggggcagcctgggagccctctttccacaccttcatgtccacatgaacccatgtggggccatctcctgtctcagtttcctcatctgcaaaatgagatcgtaattgtgctcctaaaaaattacaaggactaagtgaattattacatgcaacaaagttagaatgccctcaccatgcacagcctgaatgcagagcaagagatttcagtggagtggaaagaaatccacccttgcttcagggctaactttaatagcatccccgaaaacaaaggaaactccctgagtacaaggggaacctcctgccgaaggccagccctgagcaggtcctccccactcgcccaggtgagcagggctctggccgccctgtgcctggaggctgcgccaaaagcgctcccctaccaaagccctcgctttctcagtgccgagcaccatgtttccatgtggatttacaccacttctttacccctgcagagaagactggtttcctgtcccaaaaacagaactcgtgtctgaattgacaccaagatgaactcaaggccaggagcccgggatgaaggtagcatcccaaggcactcctgcagcgttagcagaactctctgcacacaggcacctgccacggatatgtgtgcgtggcttcccaacgtgatacaaggaaaagagtagacatgaccacagtggaacaaacaataaatatttaattgaatgaaaaaataagtaaggatcccgaggaaagtgttggttaaactgagcatggccagttccgatttttagaacctccaggggatcctggaatctgcttctccccactggattcgtaggtgttgggctctgctggccctgtggtcagaggtgataccccccaggcaggccagggggacctagtgggacaggtgtgggagactgagtgcaggcatctcagacagctgtttgaagcctcgggcattttaataaatgtccccctatttcataggcaaaagtttggtgtccctgaacaaaaccatccaactgtagctgagtgaagacagcactggtggaagcagctctgtgcccatgagggttctgctctgcaaggctctgtgcacacaccgaggacaccaggaccagagaaagccacatgaaagttttaatattcggccctcaggccaagtggcaggaagcaaagctgaggcccacccacctcaccaggaggcctctggtcctgctgctgtggccaaggagtccacactgcgttccctccccaaggaggtggcagagctgcacggtcccgcaatcccaccgcatggctccggtctagggattgggtgaggggctctgggagccctggaggtggcctgtcaggggaaggaccaagctgaggggtggagggaggagggtgaagtgtgaggctgctttgggaccacatcacaacccaccagtctgacgtgagcacccagcattggggtgacggggtcttttctcccacagctttttcacataaatccactgctctgggaggggagtgtcaagctgtccttacatccagagtgagtccttgagggccaccactgagacctgttcattccacaccatcagggctaaactggtctattccttgacagagcatcctagccccagaggcaatacggaaatacagacatgtcagcacagaaaggcaacaggattcccatcaagtgtctatcacaagatcagacagtctgagccacctgcgtggctagaattatgtctcaaggtgccaaacagctttacacagttctcgggattcttcaaagggagaagaactccctctatgagctcgaagacacgcgtcggaactccaggcgtcctctgacacctcgatgcagctccgtgagccttggttttcctctctgtggatgaggacacatccgctccctgggggcaggaggggacgggggctcagctctgcaggtccacagtgagactccctgggttgcactcctcaaagtcccttccgctagataagcctcagtttcctcagctataaaacggacgtacaccatctacttagcaaacactgcccctgcactgtggcaagtcttagaattctcattttttctcaggggaaatctctgaccacggagaccctgaacaggcatgctgtggacaggtgtttacagggcttactctgtggcatgccatcttgattataatgttttataaaggacattaattacatgaaagcattaaataaataattaatgtgatcatcaacagtaaacagcataataatcaacagcacacagtccatataatatattcttgatggttttaaaccataacgaaaatagaaaatgaaaaactgtaggttctagaagattcaagcgttgccaactcatgccgggagacctgcgctctgtcataatgttgcttctccttttatacctgactctgccatctgattgccctgaaaattacggccccgggttctagcctccactaagagtgctgccaggacttgacctcaggagttccttggattctttccttctctgttttcacggcccgcatgccaggttaggccctcctcatcttatgactcactcatgctataacaaccttcaaaacgatttcctgcttttaatctctctccactccagtccagcctgagacctgccaggctattcccaaaataactcttctcgtgtgtcactccctgccccaggcgcccgacaccttccccgccaagctctctgttcccctgctcctggctctctctcctgcacacaagcgcatctcacctcccggttttcagggtactgtgctcagcccgggcctcccctgctgccctgttagaagccctcctccctcagagtccagggagctccgaccctctccgtgatgtgttcttaactttactccacattttgacacgacttacctgcaccccaccattagtaccatgcgtgccatgacatatgtgacattttctaaggcccctatctaaatatttcatcttcaaaaggagtggaggctcctttggtttgaggcaaaagcatgttacaaaagaacaatgctaactagattgcaggcatttatgtaattatctatttatccatcttctatacccttacacggggaaaggaaatgagaaattgaaatgccagcaaaagaaaacaaagaccagaatgagagctcaagaagcacgtgaggccgggaggaagccacacaggccacaggctcctgggcagctattccccgtgtcccaggagcagtcacccatcagctgaaatcctccctccctctggagttagttacaggtcagggcgtcctgtgttgggggaaagaactgcagattcacaagcgtgcattaaaattaaatgacatggaagaggaagaagcagagaagtggacgtgtgggttctccacctcccacaagtgtcccctgtcaagatttgttgtcttgggaagataaaataagggaagaacagaagagtaaaagggataaagtgaggcgatagagagaaaagaaaagtaaggaaagaagtagtcagaaaaaaataaaagaagcaaacagcgcttatcctcctacctctgctcaagctataaactaaaatcgccccctactgaatatatgcccaagaagaagatgctgtgagaaaagtgttctgtcgaacccagggaccagcgtgtgcagagatggacgatggaaacccagccatggcaaactcaaggacaagacagaataacactggacagagagcagacgctctgctgagcaggaaacttttgcaagccaaagtttaaagatacataggaacaaagtagaataaagtagaataaacaaggacagaaaacatgagaaaattggatgctaaaaaaacctactctaagctgcatattaagtaaaatattaagaaataaggaaaaaaaagttacaaatgtcatccgttattatgccaaataataactaactggcctgtttggcttccagagcggatcaggaaccatcttaaaaacaaaaccaaacaacacggcaggctccaaagtgctttttaacaaggtaaacaagggtacttactaacaatatcccatagaacttagagaaggcttggcggaggagagagagcatgtcgcctaagttagaaatgatgacgattttggccagggagccacactgtctttctcttcaagcatggagcatctcactcctccacatttcagagagcaaacctccacgggagtatgtaaacattcaggctaattgtcactcgggatcatccgaaactcaggagagggcaagaggcagttgattgcagcaaggatatgacaatgtcacttttagtaactgactcagtccaacacctcagagtcaagtgcttaatatagggctactctttccgttgggtggcaagtttagcgaaattgaccacctgttcccttgcaagtctgcctgtctccagcctaaatcagaaggagcacctggcaccgcagctcgcaggaggtgctgcagcgattggattttgcctcctatcactgcctgtgaaatccagatgttctgggaccttctccactcctgagaaggctgcagatcaagctgctaaacacgcggaagtgattcttgttgtttttaatatccttagttatgtgtcttttctggagattctatttttgtaagtttaaaactctggtttccttgcacatcagcagggcctctactaaagaaatggaaaaaaggagcgtctcagccgtgcactcagggtcctgcgcctccatcgcaaagccccaggaggactccctgttccatatttgtggactgctccaagtccacttagccaggatctctcgcctggtctgtggccagggagatcgagggtacactcaatttgttcataaaatgtctccagcagttttttagaaagtctgcaccattaatatccccctcccccgcaatttaacatgatgtcgtttgcatccttgtgaatacagtgtgccaccaatttgaaactctagccgtgtccactaggtttttgtcctgggctttcccaaacaacagcttaattggagtcagcaatttgagggagaaaggccacaaaaataaaagtaactcataaaaaacaagttccactcaccaagcttagacacaccccttaggcacaggttactcctgtggtttgctggtgaaggccagaacctcacctcttccttagacatccctctgtcccctacctcaaagaaattcctttctcccttaacgatagttctcgccattctgttaaatgacaaaattgatagaatgtctctattgtgcattgtgtgacattgcagctcatcaggaatttatgagtcatttttgacaagacgatggcgaacctctttatgactggggctcgctgcccttatatctccaaagggctggatggcccacatgctctctgcctcccacacacggaggttctttgccatgtggatacccagagacttgagaaggaatttcacttggcagatcacttgaccaacacaggaaccggctgctttatttcctgttgaagcactcacctgggccacagaggagcgggagttggacggcctggctggcacttctcctcctttaggtgaacttgctgggaacatcccatattgtttagaagactctgtagtctctttctgttcacccatctctccattcacggtcttccaatacaataaagtcactactccagtgattcttgattccttaactaaattgtggagagatttctagtaacgtccaggataaaaaaatgtctgaaactgcgaagaacaaagcctggcccagaagagttcgtctaacactttttgaggctctgaccacctggtaactgggcaggggcactgcattccaaagtcgcaattgcaggatccaggaagctgatgcgaacctctccctacatggtgagaaccctttaccttcccgtagctttaaatatcactcgcattctgctagagtgattctgtgcctctagtcgaatctactgttgttggtgggaaacataccacaaagcataattatctgaatgacctgagcccttactgcatctttccacgttgagagagaaagagagtaattcattcatttaagaaatattgattgagcatgcttgccgtttcatcatctaatgtatttaccattcctcccagctgggttttagataccaatgtgatccatatgctatttgcttacataagtctgcttgtaatatccatttattcaataaatagatattaatcacttaggctatgggatcagctctggaaacacagtggtgaggaagagagatgctatcctggccaccaaggagctaatattccggtggagaaaatgtcactaagcaaataacgacatagacaaatctatgaatacagttgatatggctgctgtgcagtgagttgctatgcgaatggactcaggaagacttgaacccaggttggagagacaggaacatcctctctgagaaaaggtcactaactctgaaactcaaaaggtgggtccagattctctaggcaaagagaagtgtgcagagcagcccgcttgaagaatacccaatggcaaaacaaacacaacacaaacagaacaacccccaggagcaaacccggagccagagaaaagcgcagtgtcattgaggagacccacagagacgtacatggccagaactggccagaaaatggggtaagctcttgttaacatgtttaggttttatcctaagtgcagtgagggtcttgcagggttttaattagaagaatgtatttttctgattatgtctgttagactgggttcccaatcctcaggcctcagactggtacaggtccatggcttgtaggaaccaggccgcacagcaggaggtgagtagcaggcaagcgagtgttacctctctagcctgagctctgcctcctgtcagatcagcaacagaactagattctcctaggagcactggattctcctaggagcactggattctcctaggagcactggattctcacaggagcactggattctcacaggagcactggattctcataggagcactggattctcacaggagcactggattctcataggagcactggattctcacaggagcactggattctcacaggagcactggattctcataggagcactaaattctcataggagcactagattctcacaggagcactagattctcataggagctggaaccctactgtgaactgcgcatgcgggaatccaggttgcacactccttatgagaatccaatggctgatgatctgaggtggaacagcttcatccccaaacattttccctccctgcactcccccctcttccacggaaacattgtcttccacgaaaccggtccctgatgtcaaaaaggttggggacggccgttttaggctgcacagcaactgactctgatatggggaagagccggagtgggattagcagctctccaggaaacagcaggatgtctcctgcacttaggctgtggggagaagcagccccacgtgagatctgggtggtagtctatcagctgggtgcggactgaatcaatacgggggtgatcagaaatgagagatgggagatgctcatcggaaacctgaataggtagatggaaatgcatcatttgtattcagatgatttctccaagtttatctctatcctggacttaccttctgagcttcagactaatatctccactctctggtagaaacctttattctaatattccccaggaaactcagtgaacatatccacagctcaaatcattgcccctgaaccatccattaaaacagttcctcccccatttttccttaaccgagcaaatgtttatcagctgaaacggtccattttctacgtcaacttgacagggctgcacggtgcccagatactggtcagggttattatgaatgtgtccgtgagggtattctgggaggagacgaacatttaaattggtgaatggagtcaagcagatgccctctccaatgtgggtgggtctcacccaatcagtgaaaggacagaacagaaaagccaactcccccacaagtgagagggaccccttcccgcctggccaccttgagctggggcagcaatctttttctgcctttggactcaacctgaaacaccagctcttcctgggttttgagccttccagctctcaaactataccattggctctcctggttttcaggcttttggactcagactagaacttacaccatgggcccttctgggacttcagcctgccaactgcacagatctttggacttgtctgcctccatagttgtacgaaccaattccttacaataaaatctgtgtgtgtatatatatgtgtgtgtgtgtgtgtgtgtgtatttgtatgtgtgtatatgtgtgtgtgtatggatacaaatatagatatagatacatatcctatcggttttgtttctctggtgaaccctaatacaccagctacagaggaaataatattgtctagggagaaggtaaagttaaaaaaaagactcatataagctataggatatccccacattgtaaataaaccatagtgcaacccaagaaatagaaatgaaagcggaagttgaccacaaatcaagtaggctggaactgtggcagaatgtcccctgggcatgcagccacctggctggagatggagactacatttcccagctccattctgtcaagtgtagccatggggctaggttcagatcaatggtatatgagggaatcgatgaactcccaaggaatctccataaagatgaagccactgtcgtagacttcttccttttctgttttctgaaggctgaatatccaatttgaaactgacccagtttaaactctgcaaacaagaaccacaccctaaaagatggtagagcgagaagatggagggaaccttggttgctggatgacctggtggagcagagcttccacaccagcctggactgttcagctgtgggccggatcccagaagggaggctaatatctctcctatttaagtcccaacattctgaaatctctttgctacagggtttgtttggcttgtactgaactgaaacagacatggaaacacacacacccgactaagcaacatggatggatggccgttccctcgactggaacagaaggcatgtctgcctgctctgctcacttctgtagccccagaaaatgaggcaggatctggcacggggaggactcggcggctgtatgtggaatgaatggatattggaagaaatacagactggcagtagaaggatggtgaagaagtggggaaagagtcgatagttaaatctctttacaaggatttgctgtgcagagaagagagtgactgtaaggactggggtccggctgggattcctgtctgtgccgtgcaatgggcatgtgtgtacatgggtgacataggaaatgctggggcatatttccacaaaaatataaaaaatccgacaagagaaaggactgcgacacaaaatagagtgtcataaatttcctggtatgtgtagcaggtgaagtactttcttcatatcaccagaagggaagaagaggatgggtcggtatacagcaaaatctgttgggtcacaggcaggaattttaggatgtatctgagtgatgactcttaaaaaacttctgtctggtgggaagcaaggtcaacctctggagagaatgctggccagtggaagtcaggctgaggtcaatggagaaggttgaaaacagtcattgtggagtgagagcaaagtgagtatagggctatggtcagaataaagggaagttctcaaaggctgatgaggttgggtaccatgcatttttatagtaaccatctgcccagtgtgtgtctttcccagcaactgtcaggtattagacagacatggagaacaggaaacactcgacttcttctggggctgtgattttccccaatgatcaaaattaaaaggctgaagggcaacttccgttgaatattgcaatagagtagttactgcctctctgttggagagggaagaagctgctggcaggaagggctggtggatgaggtggcgaactcgtcagcggacgggaggttctgataggacaggcatctgcactgtggctttttaaccagcctggttggaggacggaaaatggaggcaagagaatgtgctcaatgattttgtcaattagaagtgattaagtttccaggatgacaaagtttagaatgacggctaatttggagtagagataaacatcactggagatgaggaggcgaggaacgaagaggtcaggtggtcagatgtgtttttcaggaggatgtggaagatgccgagtagatagcaggcatggtagtgatgaggaagactggcatggattccagcgacccctatgagtgcaccgtagtaacacaggtggagtagatgacaactaagaggagaggagaggcggcatcatcaggttgcatgagatttaaagaagcaaatgtttgtccagctaatagaaaggctgtggtcagaaaactacctgaagaggaaggatgacctggcactcaggtctcaggggcaaagagagagcaaattgcttccacttgagaggatcacaaaggaagtgggttctcaggagccatcagatcctagttaaggaaagcaagaagaatcttgagagaagagtcaaaggtaaaagggcatttttttggataaaactacaaaaaaaacttgctttctgagaacattaaggaaaacactttaaatcattttcaaaatgtctaattgatatgatcttcagaaaaacattatctagtctgtatagaaattcatcttgaaataagaatgaggcagagtgatctttttaaagggtgatatatacaagtctttagatcagtgtaacatgactgtgatcatcttaccaacaaaactcaaaatcaattcagagagcagcatggccttggagaccacccacacccaacacaattgtacatactgggctttgctgtcaagttaaggagtgagcaaatgagttcggtatcaaaggtcatatgttttcacagtcattcgaattatatcccaaaaacttgtcttgtattctctatcttttgacttttttttccaaagaactgattgcacagtatacagaaatcctgctatattttactactttaggtggagtctaattttttgtttttaatttatcagtgcttaaaaatcttcaaaatagcttagtgaggctcatgacagtgctggccacatggaaatgtagccttttgttgcctttaaacactgtcacaccatctatgactgtcccattggtctgaagtgtactggcaaactaagcatcctgtaagacaagctaaagcttgctttttgccaatcagttgaaagtcctgcatctcttcattgatgcactttctttaggtattgatagtcaaaagcacaaagcatttattatgcattcaatcatgtagctaaacaaaaaactgcagtctcctgaagccatttaaaccagccgttccaaaatcttctgccaccactttgttagtaccatcagaaactttctcaactataaatgaaagaataaatggtagtgctgctctccagatataaggcactgctctgtatctttgaacatttgatttttttaactcataactgtgtcaaaagcctcaaaaaaccctgaaattaattttccagctttactgtcaccagccagaagtaaaattcttaatttgcctattagctgttgctgttaaattttaaatttattttttaaaaaacggttggacttctatcattataaagtatataaaattttcaaaaaaaaaagaacaattttgcttttcattgtattactgaatacccgaggtagttgagtaaaaatgcacgttttatacccctgtcaacaccgttcagcacttcccttaggttactcatgttagtgttaagtaaaaataaaactgagaacagtttttccatgctaatggcttaacatttaagttcctgtaataattattctgctccaattttaacaattggatttaggaacaatctatttgatgaatttagtgaaagcatcattaagccaatttctggcattatgggggaatattaagaataattagaatatctgttatactgtgagactacaacaaagggaagtgcagagctcttctctttcccccctctgccaccctttttttgtgtgtttgttttaaagctgggtgtcatacatttcagagagcataaagtacacattctcacagagacaggagttcaaaagttgcctggtcctcagaaacaagtggctaggtaaaaacttgtgcatgtgattctggatagggggtcagcgcctgtctgtttgttaagcaatctgtctttggtttggcatctgcctccgtggtgggctgtttcctgagccttacttccgtcttgactgaggtggtccactttgcagagccttctgttgttgctgctgctttacctgagtcagaatttcctgaatttttctctgggcaacctggcaagcatagaagtgaccagttattttgacaaccacttggtcattctcatcaggtgtctggtcacaagggacaacaacttctgcacttgacaaattctgaagttcattcaccgttttgcctccttttccagtaactgccagcagcaaaggatggcactctgatatgagcttcaagtttcacctcttctttaggactaacgaagttttcttctttcatttttccataattcttccctgagccttgaaccgagcctctggtgatccagcgatcatcaccatcctcaccttagcatctggtgcttccactggagcaatcttacttgaagctccagcaaagcgagaaagctgcttgatgtgctggccctgcttgctgatgagggctctgactgatagagccgggataaacagatgaacagtctcggattctgattgctcagactgcggggagggaggagtcatggctgaagggggccctgaggtgggaggtggcatccctgaagtgggtgggaacagacccaaggcgttcagatttaatccaggaattaaatgtgcttgaaatcatagaagtgatatcattttcctaacgctccctgattttcttcatgatctcttcctcagctttggcacatgtctcaacattgcctttagctgtaatggtgtgttctggattatactgcatcagttcctgcaatggagatatcgtgattttagtgtctgtgtcttgctcaatttttttaagatttcttccttctttaccaataagacggccaacaaagttattttgagctaaaatcttcaaggggatctcttctgtgaattttacatcttgagtttccttacgcataatctccagaatagacttacaagccgcagaggtgccttcaggagtagagaggatagtaatcgacttctcagcagcccctgcattttctttacggtggacatcgattttagactgggtctgtttggtgatgttccgaatggtggcaccttcttttcctataatggctccaacaaattgggtgggaaccagcaggcacagaggcaaatcacatggtttctgcttggacacggatcctggagacccctgccttgaggagcccctctgcccaagcccccggcgacctcggggctgcagaaaggggttttgctgggtggccatttcatcagggatataggctactttcaaggtgaaattctctaactgaaatccattcagtttgtctagtgcttgtctagcgcttgtctagcttggtccttactggaataggttacatttacaactgcagtttccgagtcagtgttcacttgctgacagctctccaccactccatactggactagtcaactatccagcacctcccactgtaagtgaggagggatatttcgtatctgaagtttccgaatcctttgcctttttgggaccgagtgctcaacttctatgggtttcccgtgcagttctattttacctgaaagcgcctcaatggccttgagggcccagatctcgtctgggcagtccacgaacgcgtagccaatcttcaccaggaagggtcccgacacggggatcttggcgtccttcaagataccttctaggtccaagggggcggcgttctcgctgaggtttctgatatacggtttgttcattgtgaagaatggttgtttaaaaaaaattaatgagaaaaacgaaaattaaaaccacccacggtgatggatggatccagctggttttgttcccctcgtcttctcgcctttaaaatacacaaacacagtaagaaccaagcacaagaacgaggagcaaaaaatcagatccgaggcttgtttttccttgtctagatatgttttaaaagagaaagaaaagaaaaagcctagctacaaccgaaacgcatccaccaggcttgaattgagctaacttttcacagtcattttttaaccataatgctcatctaccaagcaatacaggggcagtcgtgtttatcacctatgttataattttattagctgcggaatgcttattcgtatatggatgtcaatggctacatgtattgattaaaactcccttcccaattatgttactatgggaacagctagaaacatttcaaatgttaattaccttttgttacacctgggtcacattagcagtcactgcatgggaggggtgctcgctttgtttggattggcattctgcctcctacacggggttcaattaacattagctgagactattttttaattcaaagaatatgcatattgtcttcattatgaagcctagaacatgattttctcaggttgccacatcagtcagatagagataccgtgtagtttataatcacagctaaggcagctcagcagcgtgttacatccaagaggctgacatacaggagagatgtcatttccttcttagtctgcatcattaaaaagatctttttttcttctgaagtctttctcttggttgctcaacatttcttcacagaaggaatatgaaggaaataaagtgatacatagcaggcgaaatcacggaagcaggattttgtttagaagaatgcaaggctgcactgactgactacaattcagaagagctgcagctgccaatgtcctttctgcaattcattaaccttatatgtacctttccactttaagggattttttccactcaagaaaaaaacaaaaggagaatggaaaaaattatagaaatatgaaatgggacttacaatgaaatagaataatttgcatatttttctcaggtaacatattttataagacaatttcaattcttccagctgctgtcttcagaagagcttaaatataattctggatattattttcatttaaaagaagatattggctcacacttcttgcagaaagctgaggagccagaacttgacttcgtataacagaggtgagagttatatccggaaaagaacaattctcccctccaaattaggacaagttcaacaatatcctaaatcacagtgattttaaatacttttcatgcttataagagattttaaaatgaaacagcaatctgtgaggtgttgatagcatgcagtatgtagccaaggtgacccaaggtcagtgtctccttctagatgcatctgcaggtagttagcattcgccacccacacacctggcccaacaggaacactgacgaggcatgcgcatactgctgatgaaatgcagcctggtttgctccagagcacatgttttctaaaacacacgtgtaactgatagacttagcgactgactaggtgtgaagataatataaaagttgcattagtcatgagccaatttctctgatgcactcacgttttaagtcaccgtgtaacagcaggtctgtgctataacacaaaggactgtgacacaggtgaacacagcaagacaccaggaacacacttggatgcccatcggccccaggtttcttctgctggtcctgtctggccatgtgtttgggtttgaaagtgtccagattgcctggttctcctggatcttcacgcaaaagaaacgagcacatgatggtgacctggaactctcctcgctggcgtcactgcatttttgcaaagcctgtaactgtcctgtctgcattctgggctccaaggctcagtcctctgatctttcctgacctgtccttcccctaggctgccttcctctttttccttattacagtaaagttctgtatgtactgcagcatattccatttattgggaattgaatatatttcttctatgccaggatttaaaattaggattgttaatattgtggtttgtgctctggttacagaatttctaaggtttgggtgttctatcccagcaccatattttctcaaagccttgctctctgcagtgggtgattttgcacaatgcaaacttctcaggtactttcttctgagctccaggtccccatatccaacatctactcaacatcttattctgagatgttcacctcaaacatgtgagaatcaacatgtcaacatgtcaatacctcttgcaggatttcctaactccacagatggtatccgtccaattgtgcaagccaagagcaaggcgccagctgggacgtttcccatacccaatctatcatcatgtcccattaaattttaccagtagtgtttctcgaatgtgtccgtttctctttgtctctgctgccaccttcatcttacacctgaatcactgcagcagcctcctccctggccacagcagtctatgaaacactaatctgagcagatcaccaccctccgcacaaacccttagggaactagaagaaaagtcgctcaacttggtaaaggctacattacaaaaacaaccagtaaacatcacactcagtggagaaactttaaaatcagaagcaaagatgcccattaacatcacaactgcttagcatggtactaaaggtccttacagacaaaaaagaagaaagaagcaagaaggagagagtcagaaaacaaaataaattagtggtataagatttggaaggaagataaaaaacatccttattggcagatgacacaatcctagacatagacactccaacagaatagagactattaaaactaacgagagttcagtgatgttgatggatttacagtgggcttaaaaattactagcaattatcctcacctattgatacagactgaatgtttgtgtctcccctaactcttatgttgaaatctaatcccaagtgtgatggtatttggaggggggtctgggaggtgattaggtcatgagagcaaagccctcatgaatgggattataaaagagaccttatgaaagagactctagagagggccctcacaccttccaccacgtgaggacttggcaagaaggcactgtctgtgaaccagggagcaagtgtccaccagacactggatctgtgggttcctcgatcttggacttccagcctccagaactgtgagaaacgaatttctgttgtttataagccactccgtttatcgtttttcattacagcatcccaaatggactaacacacctgcaataaccaattacagtttttattaaacttaagtggtgaaattttatcaaatacctctctgtaccaattgagaggaccacatggctcatgttgctatcaacaagaaaagataggcaacccaacccaaaaaacaggccaggaatgaaaacagttcacagcaagagaaatgtaaatgactggcaagtatgtgaagagttcctcaactcagtcaatgtaaccagaagaaataaaatgaggagaagacaattcaagccatcatatttataaaatgtaaaggcgtcatacaaccaagagttggtgagcgtgggaaggaagatctggggcctcctgcaattcttctggaagcgtcccctgccgtgactgcatggagaacacttgagcagtcatgaagatgaagaacgagtatcatctgtgctctttccatcccatgctgcatagcctggagaccccagacccccagccctccacgactggatgggtacccaggcaaggggacagctagttaggcaggctttacgcacagtacccagggggaagtaaagccccgtgccaactgtctgtgcaaaatgaaatatcacacgcacagcctgttactgtgtatcttaaaggatacattcatatctaagaatatagagagggtgggatcgggaggaaaagtaaaatagtattaaacaagaagagtcttattttgacagttgtgctagagttccttgaatagtagtaacaaaactctgcataggaagtttttgaaaaacattaagagtaaatggtcttcagatttattggtggaagggtgacagccattcaaatggataagttcaatttaggagtgaatattactcaaaatagaacaaagtccaacatacctataattagtgtgcaggaagaagaaaagtacccagcaaacttgagagtaaaggctgatcagagaagagagttagcaggcaaaggaagagaaaaccagcatctgctagatgccttccttgtggcagcactggacagataaccctttgtgcaatgccggggttgccgggaagggggcagctctgctctctgtgcagatggacggcagcccggcagccacgcagcccgcagagcagagccgggttagagcacagttccgtctcacccacacggttagggagctccaaccatgtggcagggagactttcaggaataagtgaaggtcggtttccaaagtgcagcatgattcttagtaagcaaatattgttgattcattacaaaggtaaatagaaacagtttcaatggagcagtgaggaacaaaaccaggtgactgggtggtggggaagtggcagaggaatgaaaatgacttataaattaaggatagtgaatatctgggcacgtttaaagttatggatgacagtaatggaaggagtgcagaatcaaggcccagggtcattataaaggaggaggtccagacaggtgcacctggatcagattgggaggtgactaaacaagtgacctaaaatgtataaatatagtaccttaattatggtgatcattattacttatcttcagagagtaatctttctttctttctctctctctctctcttttttttcagggtcttactttgttgcccaggctgaagtacagtggtgcgatcttggctcctaggctggtggccttgacctcccaggctcaagcaatcctcccgcctcagcctccagagtagctggaactacaggtgtgcaccaccgtgcccagataatttttgaatattttacagagacagggtctcactatgttgcctaggccggtcttgaactgctggccttaagtattccacctgcctcagcctcccaaagtgctgagattacaggcatgagccaccacaactggcctgagaataatttcttttgctaatattgtacaaccacagaaaaaaggaaaatattctccggtagaattaaatctatatacttacacttatttattaaaaatatttgtgttttttattggatctagaaaaaaacctgatttaattcaatatatttttgtcactatgtattaattctgttggaaacataataggattgagcttgatgtcaaataacaggatgaaatcttttttttgcataaaggaacataaaactatttattgaccactcttcacaagtatttacaataaagtaaacattatacagttggataacattctgattactgcaaagtggtttttcctggcttttgaaatcacttttaagaatagttaacctggacttgacacagaaaaatctcaactctcaaaaagctaagccacaccaaagaaactgctttatcaggttgttgaaaacatttaggatgttaaaaataatttcagtataaacaaaaatgctttcttccttgcaacttccattcctcctgccttggaaccctggcaaaagctaagaagttagaagacattccaagacgtttcgcaggtcctgagaaggtacttacacacccgctgagagttctcgtcaccaggcagtgcacactgctaaacaggctttaccagtaggcctttactagtactatttacagttacaataaataactttctctaaagttttaccacagtgacttccttctcatacaattgaacttgctcactttcaagtgtaattatatttttgaaatacatacttctgaactgaagtctccaccattaattttcatgggcaatacatgataaaataaatgcattgtaccacaaattgcaatgtattaagttctgtggagtaagtgaagccagtcatgtagacaactgggagagatatgaaatagaagtgacacaccgctccgtgttgatattcaaagtagagaaacaaggaagaggtgtgagccacaagctgtgagcctgcagtggggttccatacacattcccccagccgggtactatcggcttgttttagcacgcctcttatccgggttgtgcctcagtttcctcctccttaaagcagcactgaagttcatctcacctctgcttccctcaccggttgtcataaagatgtaacaagataacggatgtggggtgcttgtcaagctgggcacgcatgtagaaaatcattacttttattaatggaggaataagaacaatagtcccagaagtcagaaataaagacacaacatatcctcaaaatatccttaaaaataaacacatgggctgagtaagttggctcacgcctgtcatcccggcactttgggtggccgaggcaggaggattgctggaacccaggtgctggaggctagcctgtgcaacatagtgacactccatctgtaccaaaataaataaataaataaacacatgaccaaaaagaaaaaactatttgatggcttcgctttatcctaatctcaaatcacattgttattctttacatcatctttctttcttcataaaagtcagaatctcaaaggaagttggtcaagatcctgatgtgcagatgggttaagaggattagtaaatgtcaaataacaaaataaaaagaagaaagggatgaaattaagtcctggcacattcctcagttagttgtatttcctctttctggcccagacatcccctggatttataggtgcgtaagtgtcccttctcgtcaccaggacagctttaactaccatcaagaagtatttttcaaataaacacttcagtctctgtgtctgaagtgtttatttgactgatcacagctgagaacaagttaggggttgacaaggtcctattgtgggcagaacaactgtgattttctaaatggaagcacatctttaaaactgtaagagggtttcagttttcatgtacgccatattctattatcgaaccagaatcttcactctgaagtactattcaaaatcctgatggaataataatcaaattgatgcaacttaggtttaatcctgttcacttcttaaattatcacacaatgtcttttttccctatccttacaaatctcatagtttacctttgtaagtatatgtgtatgtcaatttaaaaaaatacaatgaaatccctgaacatctgaaagattccattcaattttgctgttcttattaaaacttatttcaaatctggagtattcaaagtaacacttgagtcataatctctacagcatgctttagcctttaatcagttatattggacagatcatcctcaaacactgctctcagcaccctgatgtcctcccaccataatgtactttgttctgtactctttgatatatttttttgtaaaatatgtatatatgcatgcacgagtgtgtgtgtgtatgtgtacggtgtttgtggggtatatgtgtatggtatgtgttgtgtgagtgtgtgtgtgtgtgtgtgtgtgtggtgtgtgtgtgttatgtgtggtgtgtatgtgtgtttgcattgtgtgtctgtgtgtgtgtctatgccatcaaatactatctcttttgattacatcctggaggtgcatgtgttatgcatccttcttctcttccaggaagatggactaggcatgtatttccctattcttcccactaagtacagttggaaaccctggacacttcctggaagatgactctgacaggaggagagaagaagtcaggatagctaagggcctcaggacttgaggagcaagctggtggagaattccctgggttttcctttgcctcatgtgtactagacctgaagccaaataaatcagcaacccaggaattccagcaggcacagacaaaataaaatcccaacaaaagcctctagccacaggaccagggaagggggcagaaaactcttagatgataactgctctactttagccaaacaacacagaaaaaccttggccccaccttcacccatgccagtaaaggctgtgtgggtggcctagaattccaccctcattagtctgtaaggaggtgccccaacatccccccaggggtggtgtccactggtggtggtggaggacactgaggactctgaccactgcccaggggtaacaaggccataagtcttcttgggattagtggaggccacagagggagctggagcctccacccccacaaagcaggaatagccccacaacttccttcattgcagtaatgaggtggtgcccccacttcctaggttggagtcacgtgagacccagtctgttaaaacagaaagcttatataagatccagagtctcataacatagtgccccaaaagtctaggttccaatttaaaaaaaaatcactaattacacaaagaaccaggaagatctcaaacagaaaaaaaaaagatgccaaaccaagatgacagaatgttagatatatctgacaaagatttcaaagcagccatgataaaaatgcttcaacaagcaatcacaaaccagcctaaaaccaatggagaaacagagcctcagctaaggaatgggagatataaagaagaaccaaatggaagttttagacatgaaaaatacaaaaccaaaatgaaaagtgcacagactgggcttaatagctgagtcgagggaacaaaggaaagaaacagtgaaatgaaggatgaagcaacagatgttctcacctcaaaacccagagaaataagagcagcataaacccaaagcaagcataagaaagaacataaataaataaaaggaagtgaagaaagaaagagagagagagagagagacagaggagaaatccatgaaactgcaaacaaaaacaacagaaaaaacccatgaaacaatgagctgattaaaaaaaaacaagaccaataaaattgacaaatctcttgcaagactgattgacagagagagagagaggagatacaagttcatatattaccagtatcaggaatgaaacagagaatcattacagatcctgcagacttggcaaggataataagggcacactgtgaacacctctatacacatggatttgataaatcagacagaatgtacgtagggatgcccaccctgctggtgcagcctgctcaggagtggctggacctaggtaagaggtccacatgggtttcaaaaagaggctcagggtcactgggggaggaaattctggcagcccaggtacctggagaatgtttttggagggaagggtgcaaactgtggataggcacatcacctgaccttcaaagactctcatctggtggtgagggcaaggccagcagcaggcagaaggagctctcaaatgctcagcgtcagggcaggggcccctctggtccagctctaaacactgtgctgagtacagatggtttttttcttgacattgccaatgagataacactcgtcaaaacagaggacgactaaggatctggagtcaagagttaacagccttcaggaaggcttagcaggctttgcagctattcctttcattatctaacaagtatctgtgagggttcttgctataactcagtatctgggccaagcatgcagtgtggggttagaaagagacgcacggacgggctgtggcagcctggggagagtgccatgcacctgcagaagtagtgtgagcctctcacgccatgatgaggtcacagttcccctgcactatctcttgatgtgtgatgtcccaccgaggcccacaggtgggctgtgtccctcgatgtctggaacatacattgaggtcacagggttctgccttcccggcgcccccttctagatgttgccacgtggtcaatggataagcagacagcacccgaggagctgctgaaacacagcgtctatcccgagctttctcttccttagtgctacttgctcaacactgcctgtgcctcatgtctcgctctctctcccctgggtgggagcacagggagaccactctgtgaagctctgggttcccgacagcctcattagaaatgaagccaaaaagcacaggcacagatcaggagaacagggttgtgacccctggaaatgacacgtctgtccctggaggtggcgtccttccccatgcttcttcccaaggtcagtttctgatgagcttccatgacctcctctgccaggccacctgtgccttcccactgcagagctcttccccatcccccggaacacaactcactttctctcttttcagggcggaggaaacccagctccagggtgacccacagccacttggatctccgggtatcagaagactggcgccaggcccatagccgggttttcacaccggaggaggtgggaggggttttcattttgttttgttttgttttgttttaataaagtcatgcttgattaaataaaatgagagaaaagtaaatttaaggaattgtgagggagaagaaagagcagattgttgtgaacagttggtgggatatctatgcagatagacagtgcacaaaaattataggacacagctactgattttttctctgttctccttttaaaggaccagtgcgtagatatctgggtcacagccctggggagaaatacaaaaacattcacgcatgatatggagagaaaataaagaatagaaatatccatgactggctgaaaacacatgaagaacaaacacagatgcacgatttatgtgttctggaagcaaaaccattcctgcctaatgcagccatttattcagctttattattctagcaagtaaaaaacacaaaactgcgctttgtgaaatatccggagggaagcagaggaggaaagtgctgcctgtgatgtcctggggtcagcactggccacgttatctgcagagacgactggggtcatggtgtgaagttccgtcgtggaggaagctgacaggcttgttagtgcgcccctcatagtcagcggtcaccacaccctgtcacccacgttaacctatcgctgctgccatcacccagttccaagtcccagtgcttcatacctcagcttccacaatggcctccctgatcccgcctttccctatgggtttatgccaacagcccagttgggttaggcttccccacaccctgttccaaccatgtccatctcctggccagccatcagtgatgaattattccttcctgtgacttcgagcctaatcccagcccacagggtatcaggcagggttacccccagcacgctgtggggatgggaagaggtgcaggccagtgttctttctgtgctactggtttgaaacacagaacacattctcacacagagacaacagcttgaattgtgcttgggttctcatgagaaacacagaaaaggcatttgactcagagctgagccctggtgctcttgtttcgggtcctgggaagagacagctgtgagatggaggcagtaggaggtgaaagaaaatagttatttactggttccttatggttgaattgtataccctcaaaaagatgcgttgatgtcctaacctctggaactgtgaatgtgatgtgacctcatctggaaatagggtatatgccaatattagcaaattaagacaaggtcactggggtgagccctaactgtgcctgactggtgtccctaaaggaggagagacagagacgcacagagggaagacagccacctggagacagaggcagaggcggggcaatgcgtccacaagccaaggagcacccgaaccgcctgaagcaccagaagcaaagagaagggcctggaacaggctgtccctccccgcctcagcaggagcccactctgccacacctccaactcggacttccagcctctggatgggagagaacagagtcccttgcttggccacacagtttgtggaactttgtttaccacagccccaggacaccaataccaggtcccaggcaaatttttgtcagaaatgcaagttggctttggcagcctgtgctgggcccgtattctggtctgttctctctgctgcaggccaggcctcaggctgtactgggcaccctcccttcccgtccggcctgtgctccttcttcagctcaccctgaggaaactccctctccaaacaccaacacatccaaagcagggggctgaggagcaaacctcaccaaagccttctgccttgcagacgtgagaaaggaaaggcagtggagggtgggcaggtggagcactgggaggccccagagactgcagagcacccctccaggcagcccgaggcgggaagcaagcccagcacagcccctcctggtggcttccctccaacttggctgggtcagttagtgactccgctgcagaaggagctgcgtcttcaaatgggaggcatggacggtagctgccaccatagaagccgggccttctccctgcatggggcacttgaattagtctgaccaggcttcctgccagctgcctcttaaaaaggagtaaacttatccaggagacaaaattgtggggatagccaaaaaatgctgggtgagaagaggaatgagagacagcttatcctagcaaatactaaaatacgatattaataatagcacaaaaaggcaaattaatggaacagaaaaatccaacaacagatgcaagcacagccgtgcatcacttaacaacggggatacgttctgagaaaggcgtcattaggtgattttgttgttgtgagaacatgacagagtgccctggcacacaccgaggctatctggtgtagcccatggctcctaggccggagcctgcacacacacggctgcgctgaacactggaggcagctgcagcttcctggtcgtgtatccaaacatagaaaagctgggccaggcatggtggctcacgcctgtaatcccagcactttgggaggccgaggcaggcggatcatctgaggtcaggagttcaagaccagcccgggcaacatggtgaaaccccgtctctactaaaaatacaaaaattagctgggcatggagacgcatgcctgtaatcccagctacttgggaggctgaggcaaaagaatcgcttgagccctggaggtggaggttgcagtgagccgagactgcaccactgcactacagcctggctgacagagtgagactccatcaaaaaaaaaaaaaaaaaaaaaaaaaagaaggaaagaaagaaagaaaagctgtaagtcctcacttcaagtcattgtaaggttttggaaacagacttgaagcaaaatgacatataactaaaccagttttatcacaggttaactgatgtcaacaagagttaaattcctgcagcatatttcaagccacaaaaccgtcaccaagcctctaaataaagaccaaaccgcttctaatattgaacatggaaataaatgtaagctatgcggacatttaagaaaaacagaaaaacaaataggacgatgatttcccaccgactccaggccagggtctcgagttgccggagcctgtcccggcagctcagcctgtcctgcgaggcagcccccatcctggccaggacatcatcccagcgggcatcaattctttttcacatcatcactgtatcgaaatgacattgaatgaaacgacgtcatttgaggacctgctgcacaggtaaaataccgtattatactcttatgggaccaccttcagatgtgcggtctgctggcgaccaaaacgtccctctgcactgcacggctgcatatgtaagaggttaagacatcgtgatttgtgaagtcagaatggaaaaggggggttgtaataacaaattattcatttggaaaaatagttaaatccctcattatatacctcacaacctaaaatgtcagaaaagacaaaagcaaacgtgaaaatttaacacggaagtaccagaataaagtaagggtgatcatttatgccatcttttgatggatacaacttttccaagtgtaaagcatgactaaatttaaaactttcggatgtcaaaacactgtaaccgaaatttaaataaactgcaaaaaaaaggttttgcgacatgcatgcaaagcatcagtgctccacgtacagaactcacacaaatgaggaagagaacaaggaccttgctcatggctgtgtaggaggatccggagccagaaggagcagggagtgaggatggagaatgggctgctgggacacatgtgggagggagatcaggacacaggctgcgagtggaggccacgcgctcacctctgcaacagagggaaggaggtggagtgtgtctgtgggcaactagcaggtaaggaagaggagtctgagttcgtctgaggctcaggttttgcaagggggtggaggcatcgccattgctgggaacaaggagcagagcattgcaaagaggttaccaaaaacagtgaacatctgggatcattgctgtgtattccccgcaacagagagctgcagaatggcccaggtgcgctgtaggagatggaagagaacaggaaccaaagaccagccacagcctggaggaatggttgccaaagaggctggcgctgggcacacactggcaccaggagtctctcccagctctgctctgccaccctgagaatgggaagaaggccagggaattttgcaagtgggagccaggtgaggagagctggggttccaaggaaactgggatgttaacagggaagagctcagcagaccactggcagtgacagatcccgcgggtgaagttggagcagcgtggggttggaagggagtggggtgcacagcacacgttccatccagggcgagttttagattccagtggtagtgcatatctctctaagatccagagtgcaccagaaacacaggtcagcatgctgaaatgacccagaaattttaccaggggtgcctctcacaattaactgtacttgaggcaagcccatttgttatagatttttcgccgatgattgttttattatttgtcatttttcttttttcttcttttctttcttttttttttttagacggagtttttgctcttgttgcccaggctggagtgcaatggcacgatctcagctaactgtaacctccacctcctggttcaggcgattctcctgcgtcagcctcccacgtagctgggattacaggtgcccgctaccacgcccagctaatttttgtatttttagtagagacaggttttgccatgttggccaggctagcctcaaactcctgacctctggtgatccacccacctcggcctcccaaagtgctgggattacaggcgtgaaccactgtgcccggccctatttgtcatttttctatgaaggcaaaagcaactgtgcacatttaccctcacttccccttaagtagctttctgagctccaggcacaaagggaactagggaaggtcttatctagcacagggcaccatgcagactggcagatagcagttatcagaggctggcatggggggaggttagtccccacagtgccgatgtaggaaataatgctcagccttatgtgaggctgtttgagtttccaaggcacccctaaactaatccatcaggaaggcagaaaaggctttggagatcattttccccttaaaaagactaagcattccatgttcgtttgaagaaaagtaatagttgtaaggccatatcaaaatctaaaccaatacatattgacttttttatcatacaataaaatgcaaccgtatctgaaaatacaagacacgagtatttgtacacattctctttaaagtggttaaaataacttggcccccaaacatgaattaatgaggacatgcacccgagaaagtagcacatacttcaatacagacgtatctgtaaatctcacccgctggtgtaagatagctgccccgcacatgtgcacagaggtgacataaacttggcaggactttcagatcggttatgtctcaataactgaccttaacttaatgaaaagtgagatcccaatatttctaaacacaccgaacagctcttttgctttttcatgaacctagagaggggtggaacaggctaattaggttaaaagtctaaccattagattttttcttatttgtgtgtctgtatacaggcatatatgagtaaggattaaaaacattaacatttaaaggttattgactttgacaacaaggccaatatacttggcaccagccggcaaacttttctctacatgtacaggtagcaaacatttttggggccacacaacctctgtcacgcctgctcaaccctgtctttacaggggaaactgccacagacaacacgtaaatgaatgtgcatggctgcgttcttagaatgcgtattggacattgctaccatttagtgagctcctcttatgtgcttggaatgcactatttataaactctcaggttgggaacataatgttaattacattattcatcttccaagctcactacaaagaataggtttccacaaatgcttatttatggacattgagatttgaatttcatacaatttttatgcatcatgaaatcttcttttgacttttttccaactgttaaaatatgtaaaaatcatccctagctcacatagccagaatgtatgcaaggtttgatatcaatgagagctttaaatgaatttaagcttgtttggaaagacaagtaacctgcaatctctccttctctgccattttaactgcctttgaacaacacatgtctgtgacgatgtatctatgaaaatacatctattttgcatggtcttcttaaaccccacaatggatactctgaaactaactcagtgtttgatcatgtattattaaatgtcaaaggaatgattaaatgaatgcatctccaactctactcacttatcattaaaacgttcatcaacggagggatagtcaatctcactagtttcagactgaaagccgactactttcggctcaggaactgcaagggagcatgatcatcagtcttgcattgatcccaacaagcatcatcctagttatgctgattagagtatatctgggagatcttataaagaatgttcatattataatttgcaaatgctatgtgccaactttcaaccacagtttccagaaggaatttcatggcaaatttctgaaagagtggcagctttgagatatgtgggagaaagaagttaactctaaacctttagctggcttaaattcccaattcagaaatcttcaagccccaaaataccctgagtgctatttcttataattactattaataagactttcacttatgtaaggattcctcattgaaataattcaaggcacacttttaaacaacaaaacattgtaaagtgggcatctttgtattaaattcctattcctattttattttaggtaataagtattcaaattttggtgaaccctatacaacaataactaccatttagtgagctcctcttatgtgcttggaatgcactatttataaactcataagttgggaacatcatattaattacattattcatcttctaagctcactacaaagaacaggtttctaatcattataataaatggagaaatatgtcacctaaataaaagaatggatgggtgatattgaacacagaatatctgcaatgcacttcttttccccaaaggaacccaggaacccagatgaaaatccaaggctctctgactgcagaaacggagctgtcagtcaccacctagaaatctctccccaaaaataaaagtgtaagagaaagaaaggcattatcaaagaatctaggaagtccttgtatgagaaactagcactaaataattcactttttgagatagtttgaacatatttctaactctaaataaagggaaatacttggtcataagaaaaatgacctctgtgtattaaatgtctagtttgtgcctcgcattttacattcatatcatatcctcattatggacagagtagcccattccaatcacccttattttactcagaaggaaactccggcacagcgagtttgatttgtgcagagcagcaaggccgtacctgcctagctgccactaaatcacagggagcctagaacctcccacgaagcagggatgagctcctgtgtttaatctcagatagttgaggagaagacgctttgagaagctgcatgtttaacactaaagggtgatttcacagttaaaagtcatcttacatacacttcacaggaaatggaaatgaccccactagtctgtgtacctcttaacacctgagttcacacaagcaagtgctccatcgttactttacaaggtgactaatttcttaacaatttcacgaggatccctacttgaaatctgtcactcagattggtgtgtctaatgaaatggtttaacatcaaaacatctatggataaggacaaataacacaggaaaggtggaaaggcgggggacatcgggggtgcgactgagggtctcctctgcttggatgggtttcctcaaaagactgcagcctccaacaagagagggaaaataccggagaggcaaagttacatctgacaacacttagaattcatctgacggccaggacccgggagcacaggcctagcccagacactgggtcctgacgtggccacagccacagctgaaccccctccattgccacatccctcccttgccagagattttaccagatggtgcctagtaaaagaattttaaaacttctagaagatcaagctttccaaatggctctttcttaacagaaactttctagtttcacgaacaaaatcacagatgaacatgctagagcttcgtaaagctaggcagctttccgggcagtgctgggtgatcgcagtgggtctgcgtctgggcccctccttctaagaccgagtctcggggacgggaaagatgcacagctgcttcaggagcatttcacccagtgggcgggcggcagagttagcagagctggactttaacagaagctcccgccccaccttgcaacctcgctcatcagctcagctgcttcccccaggaggtgccagctcagaggaggagccggtgccagctcagaggaggagccggtgccagcctcggccccggatccagatcctctgactcaaaaatagcctgattcctatcatgcttcctcgccggcagggataccaccatttgtgcaaaatgtttaggtacacatttcacacatatagactcattaaaatagtccactttatttggaatgtcatagtggagtaaatataaatacagtaggaaaatataaccagaaccaaaatataatcagaatataatacaatcagaaaaattagaaatataagcagaataactcagtaggtaaaagcagtttgcattttaggagttggtgaagaaagtggagtgtgactcagaaggtccaatcatccatcctaaattccagccctgtgttccaacccctgcatgattctgccccaattcaaaaccatgctggaacgtgagcttggagactggagatcccacacacagaaggagaagctgaagacgcttagagtggaaaagcgttttgtaaggcgggtcagacactcaacaaagcaggtgaaagtgatggaaaaatggaggagccgcagggggtgggaggcacagagggctccccttatcttattgtattttccctctttcggttgtgaggacagtccatcctggttctaaaatcaccgtggcccacgccacgtggaacccacagggcccacagccacagaggctggggtggcacttccaagactggtggctgcaatgggagtggaatgtccacctggctttgggtccgtgaccctcactagcctatccctggagttctgtaaaaagaagagccaggacacctttctgatggggctgcccgagcttgttgtggatgcggagctgttgaattctccaatcccattctctgaaacgcttgatacacgtgcttctccacgtgaagcaaatgcctccctttttgagattcgtccttcagtctactacttagactttacctccagtgacacttcagtttccatgagcttcaatcgctgcattttcagcccattcctctctgcatttctggagtaatttcggttactctttgcacagctccctctccgagtccacaggactcatcacaactcgcgagacaccaccgcctccaaggtctgtctgtgcctacacttggcgactatgacaaccgttaagcgatgcaaggtttggggcgctgcaaggacttagagaaaaagctctgtggagactacagtaaaagagcccagaatactgttggagtaaggcccaagtaaagttgtcaacaagtcagggcagatgtaccttaaatggacccccgcctggtgggaaggctgggctggggctggcaggcttgggttgcccctgcctcgaacgtttcctagccctgccatcctggctcagtgcccagcctcttgctcaagtccccccttctggaaagtaaagcactaacttttaaggaccagctgaggtgccgcagtgaagaaggtggcctaggccccccagatggtgtgggagcgacagaacatgaatgcactgccttcctcaccccaggggggtcccacacgtgtgcaccgccttccttacccctggggggtcccacacgtgtgcactaccttcttcaccccaggggggtcccacatgtatgcaccgccttcctcagctggtgccaggggacccccagtagtaccaggaaggccgtgccagtacatcaaagtggcagccaggatctaataacaatacgtaaatacaaacagaagcgagggcactgtttctcagttgggtgcactgtgattagaaaataaagtccgaactaactctatagttaggaaatgaccgaatttttccctgagtcataatttcctttttctttttttcttttcttttcttttttttttttttgagatggagtctcattctgtcgcccaggctggagtgcaatggcgcgatcttggctcactactacctctgcctcccggttcaagcgattctcctgcctcagcctcctgagtagctgggattacaggcacgcgccaccacgcccagctaatttttgtatttttagtagagatggggtttctccatgttggccaggctggcctcgaactcctgacctcaggtgatccactcttctcagcctcccacagtgctgagattacaggtgtgagccactgtgcctggcccctgagtcataacttaaagtatgtttttgtaatatgtttcatggacacttaaaaggtaagtataatctattttcagggtgtggatttctctctttctctgcatatatgtcatacacatgcacatgtatggacatatgtatgtatgagtatatcaaatatgctatattaagtgtgtatgtgtgtgtgtatataaatatatttgcctctgatttgtggtatcctaacagcaatgagttaaagtttcctaactttgtaatactttttcttcttgtattttctgcagtttttgcttcataaattttgacgctgttacttgatttatggaggtccacggcagctagctctttgttgtagactgtgcctttatcattattctaagggcccttaacatttctttgttgaatttaaccttgcttgttattcatattgaaaactgatattaaaaaaaaaaacaccaaaatccttttataccagactttttgagttactctttcacagacacattatttaaggtgcatttcttaatccaagtgggtcatttttgcttcttcccgccatctgagaactttgtgaggtgtgctcaccccacttatgctttgtgacacggccacggcctcagctttgtcaccatacgtcaccgcacaggtcctggttttcctgccgcctgtttctaatctgtggccatttggcctggtttcctagtcctatgctgagggtgcaggttcctattcttttaacgtggaccatctgcaactggttttaatttaagagttttatgatcaagacaaacatctatttcttgattcatcagctttacacagactcctgtcatagcctagtctgaaagataaacaagttagctcacgccctcccctcctctccacttgcatttttggtttattagattataatacttagtttttccacccattcaatacctttgtattcgacttctcaagttgaaatgctctctactaactctctgctcagagagttgaggaaatgaaaacagactcttctcacctcatcttccactgttctagcttttgttatgttctcttctgagagcaaaaatgccaaagaataatcccacgttctttggctttagttttatattcaaatagactttttctatttttcatggtttttccatttatcccttggtttcctggactgagtaaaaaaaagtcttttattttttttaaagaaaggcttatgtttttatgtcactccattatctgatttttctcatatttaaaaatgtctcagttttctttctccttgaaaacaaccttagctctgtattaaatcctcacagattatgtcacatggtgtttttctctttaaaaattccatttgggaacaaaatgtaaatattataatgacagagactaggtaggcacatgacagaaggaaactggtctaccaggtgcctctggtcgccacccctcaccctccccttcagcctcctagcccagcccagcctctttctccagcctccgagagcccacagcaggtggacagctccaggcagtcagggggagcatccctgggagccacctctgtgggtgcctcgaagggaggtggaggaggtggggcgcacacacggaaccaaaggagtgtgaaaggacaaggagctgggtgagccagtggggggtggggtgggcccacggggagaccctcactccacctgccttctcttcagatgctggggacgagagtgaagctccgagtttctgcttgcacagcttcctcgggccagcgtggacgttcccgacctgccccacagcacagagactggctccaggtatgccgggcagggaggctcctggcggcgcaggcccagagggaaagcagtgtcagctgaggggtggggaggaggcagagggcgcatcacttgtgattccccagctttgagaggagctcacagaggcagcttttggggaaccgacagatttactaaatagcaccatgctgaatttgaaacagccacgccccagaagctgatcagaaaagattgttttcaggccaagagtaagatgtaagaatgtgctgtgaacctttatgattctgtgaaaacacgtggcttttaggtcctacagaaatgcccttaggctacaatatagaagatttttttttttttttagtttaaaatcttacttcacataactactttgataaatctactatttataagcaaagtcctagccacggccatctgatgtggtagaagaataaactgaaaagcagacagtacctaggacaaggacagaccagaggctgacggcttgcaagtagatgtggaagataaagaagtagcaatcctggggaaagggctaaactccactgggggaaagttccattccacctccgattcctagagctgcaagcagcaagttgacacaacacttagcaaactcttagtcacctcccgagagcccagaccctgtagcagaggcttctgtcaccaatgatcattccccaagtcagagacatggaagggaaatgaaagaaggacatgcatcctgccgcccatgtcagacacacgtcccttgcatgaagaacttaagacgtttctgaagtgactcaccaactgatccaaaatatataaccgtgatcaccttaaatcacataaacatgatcaccttaaacagagaactggatctcgtgtactgatgctgctggcagcattggaaagtgactcttacaacttcagttgcgataccggtttccataagcttctgtgaattcttgtcaaagctttaaaactgaacacggcaacaactctaggtgaggagtgtttggcagatgaaacccctccaccagggaggtgacgggtctcagggagtgtgtctggcgggtggggaggaatcccaggcctggaatctaccgtcctgggtgctgtctcctccaccacgtaagccaaacctgatttccgtgaagaatttcccacttgcactcatgaagacatggccattcccaggtatctaggtgttcctccactgatcagaaacttacacgactttatcagaagcactctgagatggacactgctgtgttcgttcaccaggaccacatatcccaacagttccccataacctgggggtggtttctcctgagggcatttatataattagcagctagcatcctctttttcaggtagctcataaagacctggtccaacaacaaaacacacctcacatgtcgttcaacaggccatggaatcattctgctgatgtgtgaaagaattgaaagtaatgcagtttacatcatattattatatcgcatcttataattatagatcatacttaaacaaacaaacacacacacacacacacacacacacacacagctgtaatgcaatatatgctgtaatgtgttaccagttcctgaggtttggaagatgggtcatgaaggttgtgatgcctggtggcagtgctgctcctaaaacaacaccagggccagcacccagaacatcagcaccctcaggtatcagcaccctaagcaccggcactgtaatgtgccagcaccctaaggtaccagaatcctcagggacggcacccaaagccaccagccccctaaggtacagcaccctaagcaccggcactctaatgtaccagcaccctaaggcaccagcatcctgaacaccctcaggtatcagcgccctaaagcaccagcaccctaagtcaccagcaccctaaaatatcagcaccttaaggcaccagcagcctaaactatcagcaacctaatgtggccccctggcctggtgcagtgctgctagataaaggggtcaggaattgtcaagaggtaaagccacagtttgtaaaaaacagcagcttgcaaagctgaaaatcaaaggccagactacagcttcaggagccgagcaccagtgaccctctgataggggtttgccacccatgaattcaaccaactgaggaccaaaaatatttgggaataaaaccagatggtcatgtccatactaaacagactttttcccttgtcatcattccctaaacaatatggtatagcaactatttccatagcacttaccttgcattgggtattataagtaatctagagataattacagaatacagaaggatgtgcttaggccatgtggaaataccatgccattttataggagggacttgagcagtgcaaattttggtgtcgacagaggtcctggaaccagatgcagaggggtggctgtactggggtgggtgctcatctgtacgaatggggcggactggccagggtgattcagaacaacgttcccaggcccagtcactcatcagatccctgcccctcatggcagagacccaggttccacgtggtgtgggcaattcccatgacctggacgcaggggtcccccggggtctcgtgagcttccagggtaagaaactgctgtcccagggagcgttgcagtggataaaaaagagtcacccatgggtacatgacaagcctattcttctctcttccagtttgggcccctttactctggtctctgagccacgtttctgcagtgcccagggaaagagtggacggcttccttcagctgactcagagaagccctcctccccgtcagccagactcacaccctccagcacacaatccagacaaattgcttgaccagaggaagctggaaattattagtgttgtcttgattttacaatagaatctgtggaatgtaggatcaataccacgtgcttactttctcacttctaaaaaacggtatggtctcgacgcatacagatcagctcttgctttacagctggagagagctgggcatggggactgcctggaggggtcgggcacccgccaggcaggtctcatgtgggtgatgtccacgacattcttggaaacaatcattttagtgtgctaaaactggcatttctcaacctgtgaggtgtagctgcatccctcctttggtttactttacttcagcatttacttggtgtgctgcccttcactagccagacagaccaaaggaggaagtgactgctgcaaaaagtgaccacaggctgacacatggagtgctcccctgcggaagggccaccccacagcaggtgtgccagcatgctcttccctctcatcgctccctctagccctcctgccagggctgctgagtagggggtagcctaggcagagcgtgaaacaagattgacatccatcggccagacaaccccttccagctgtcacctctgctgcccattcacagagcaagcagtcgagggcccttcatggctgcctacaagccctggtgcagggaacgcacactgcctcaggcaaacagagccagccacagggagtgagacatcaaagtcacctgccattgctcaggatgttatttctttctctttctgtgtgtgatggggtctcactctgtcacccagactggagtgcagtggtgcaatcacggctcactgcagcttccacctcctggggctcagatgatcctctcacctcagcctcctgagtagctgagaccacaggtatgcaccactatacccagctaatttttttgcagagatggaattttgccatgttgcccaagctggtcttgaactcctgggctcgagcagtctgcccaccttggcctcccaaactgttgggattacagacataagccaccacactcaccctgaaacatttatcttgaaggtctaagaaagcaatgttttcctctaacgtaacttgattctgttctctcggcttttcttgaaatgtctggatcgttcaatgcaaccaagaaacttcccatgctgttagtaagggccatatatttccctgatcaaagtactagttttcttatttatattcccctgtaacatagtgtgtgataaccctggacacccacttcctgtgtgtgacgaaattcaagggcccttctcatcaggtttgactgccaggttgtctaaatgggcttcccatgaggagaagcaatcccactgcaggagggtttttctccaccttttttcgtaactggtctaaagaaataaagattttatgtttcatcaagataattttctgtgttgcctttattagattttctgattgcttggaaaaactgagctttagaaggattaagattctcacatgcatgtaactttctatattgcttttgaagtctttgatcatcactctggttaactgaataactgttattttacagtgacttgtgattctgtctcgctcaactgttttgaatcttttgatatctttggcacatttctccagaacttttatctggtaaactgtatgggaggcattgtcaaatgataaattatatgggaacttctttagtttggtttatgagttatggacatttatgagtatgttattgatataaatattctaaaagttatataaattcataaaaatatgtcatcagtcataattttgatgttgttaaatgttttataaaattatgtggatgttattgtgaatattctgatgattatatgaaatttgcaaaagtctaatgatcctgacatgacactgtcattcataattctggttgttaccttagaatgctgcgtgtcatagaaccaactaaattttcttgtcaattgaaaattttcatcaaattttaaccatggctagtctaagtttttgtcattcacagcttttattctaaattcttctctataaacatttgaaatcagctctagtccaaaagtgcttttcatgaaaaagactctaataaatataggtacaaaaagagaaaaaaatagtacaattaatcaaagaatacgcaaatttatgttctggttttgttaaatggttatcatgtttattttcccccaatctgggaaactcattttgatgctgttaagtatgtgctgctatgaagaatctgtagtatccgggtagtcatccggttgaggtggtttgttaggtgcaggaaaggcaacattagaaaaaaatctcagatcatgataattaaaaaatagatgtcatccgccgggtgcagtggctcttgcctgtaatcccagcactttgggaggccgaggcgggcggatcacctgaggtcgggcgtttgagaccagcctgaccaacatggtgaaaccccatctctactaaaaatacaaaattagccgggcgtgctggcgcatgcctgtaatcccagctactcgggaggttggggcaggacaattgcttgaacccgggaggtggaggttgcggtgagccgagattgcgccattgcactccagtctgggcaacaagagcaaaactccgtctcaaaaaaaagaaaaaagaaaaaagccatccaaagtgtgttttccaatgaagaggcaagtatgttcgttgggccctacatttattccttgcaactacagctagaagctgccgactgccctagtaaagatccccctagccattagagacaatcagcattggtcttgtaaatgcaaccaagtagctgatttatgattaaaagggggaaggaggggcgtggtgggggcggggcaaggaacttgtgagacaaagtaacaaatgtcggaagccatgtctgtttctttctgcttgccaacagcacttcagaaaacccctgattctgtaatgacctctagctctccagaaagatgctttgaagacaaagcaggacagagcacacagcccccggcatctcctgcttgagtcgctccattcctcaggaggtaaatgaccctggccttgccttttcctacacacaacctctgatgaggttagccgcaatgcttctgtaatctgcgaccagatgtacacttacgcccaaacctggatgtgaatttgcacggactgaagctccaccacctagatagaagtggtgggtggaaaccctgtgtggggcggtcccatggaacctctctaaaggactcccccggggccatcacctcagtctacagtcctcagcaaagctcctgaataaaactaactttaattatttaaaagcctgatttgttctttagtcagcattatttaataaatattctttcaaagtacaaaagtagatggaaaggcctcatagaaattttttattagtggtggctactgaggagacgggaagggatgggattggggagaaataacaaaactggaataccttttccagagaccttaattcctttttcttttcctttttgttttaccaataaataaataaataaccaagaaaaatactttaatacaatgtgccaaaaacagtaacatcaacctggatgctgggaacctggcatctgttaaagtcttcccgcacttctgtatagcttcatgattcccccaaaatagactgataaaaatacaatttagaagtatgtctttccattgggatgaagcattctcagaaatatctcagaaaagtccaccatgaagccagtggcacatggggtctgattattggaggctgttggagagagctgggtcaccaagccgcacagcccaggccttgatatttgcctgtccacctggagggatgtgacttccatcaggctacaaacatcctgggacagtgaaccgggaatcactgaaccttatcacatgggcttgctatgggagttcacatgatttgaaaaacagatgcccactccaagtccattcaacagccatccactgcatccagactgttgaatcttcaaccagcatcaaagaaaggagccgcctttgcagggattgctgtctaggggatggaagcgcaaagaagctcggagctcccacagatgatgttaggtgcagagatgggggtgcacccagggcacagcacaggggcccggtcagagcctcttcctaccagaggtgatgacagggggatgacagggggagctgtgaaggccaccggaggctgagtctggtggaaggaggcagggaacagccaaagtgaaggctgctctggttcaagttggtgttcaaataaaagtaagtcacaacaaaacaaaagacctgaagtgaagcctgctggcttagaggaaatgaggaaccggagcggctggggtgcagggtgggaggcaggggtgcacacttatgcatttgcccagttttgcatcggatttctggaggtttgggaccctctttgcagaagctttcacgagcctaagggtgagatgctctgccccctgtggatcgagcctaccctgtactcagggccatgccaaaccattgcacatcattttgagccttcagaacatgatatcaaattatacttggatgtcacattatcggccagaatgggagtacttttgaaagcctaatagccttaggctgcaagagtcctgtggacggcactgttcccaaagtcacagaccctttatggacatgcaggactgatgccgccactgtcagtaacagcagtggtgttggccgtcttgatcagtttattatgtcttggaactcatccttgaattaattggaatgttcttttgcattgtcgtccaggaaatttagaggccaacgagggcaggatctactcccaaaaagacatagggacccttacagtacgagttttgggtactaaccccatggctgacctttctgatctttcctcattcggatcttatattccttcttctcatctcattttcttcgtctgataatcttaattttatcttgtagcatgtatgtatggaagccagtgccagtctctttaggaaaaaggtttggtaacacggaggtcactagcatccctcgtggacagtttccatggaatgtcccaggcacaggtcacatttcagcgggttccggagctcactctaagtggggaagtggaggctgccctggtaggtgccatccctaaactgtttgggagagaagaggaagagagaagtaaaaggaaggtttctgcgtttttctgtttataaagcggatatgagcaggtttacaggctgaacagagtaaaccaatagaaagagaaatggtaaaatgaaaaactgagatttctaaggaaactgtagggtgtggagtaggatcactgctagggtgtgggaacagaggactgaggggtgttgacctccaaaagcaaaggtgcatgcaagcgaagggacattggtaagagggaggcaggaagttgaggtaagctgatagattgcttcaattttccccaacaataggatatgagatcacctgtttagaggttgggacaggccctgaggggagagaggaaagttaggtatggcccctgaggggcaagggggccgagggctcctggcaggagcttaggattcatggctagcagcaattctcactcttcttactagtttataactcccattagcagaacccgagcactcttgcctcgtatacctgtttctctccttagcaggggtctaagatgttgacatcgaccctttggagtaagggtttatactgacatgaattctcaactcaagattttctccctaagggccacctacccaaacggaagagcaataggtcctcttttccatattcaggtgctaggaaataaacgtaagctatcagcaagccatcaccatcttaccatccaatggtatataattactctgtgctcacaagcagcggctgatattggtgaagtaattaggaggttcccggcaatcatttctttcatgtcccaattaagacactcagccattgttcattaggggtgttaagaaagtcaatgaatttaagcacaggtctgtggggcctgaagcactgcaagagtcactgggggcgtgctgattttccctgtgacaatgtgccttattcaacatgagagggagcgtgtgtggctgaggctggcatacctaagaccatggaactggtgctaagcagtgccctgctttatttataaatcacttcctcctttgggggtacttaaatattttataaatttgtctcataaaatgttaaacatcctcacctttaccatgacagtgttttcacatacagaatgagaaaatatcacagattttgaaagttcctatcctcttgttatggcaatcagtgaaacattattcagtcagaaagaagtctcagtttagaaactgtaaacctttatgtctatagccttgcactgccactgaatttagatccaatttctgaattatatcattcacaaaaagaccatcttggattaagtttccatcaaacttggagaactctgagaaggccctaagcgtgtccatgctggagaagctttggcaggataagaagagctggaaggggcatcctcctgcccagccactccgcttcaggctgtgctgcagagaaacttctgcacccatcaacaaggaaatatgtttatagcaattatttgcaaaagcaaacaacgtgacacaaaacaaaacaaaaaactgaaacaacgtgaacatctatagtaggaattgacaatactctcatggcggactagtctccatttagggcagcagtccccaatctttttggcaccagggactggttttgtggcagataattttccatggatgagggtgggggacagtttcaggatgattcaagcacatgacatttattgtgtactttattcctatccttattacactgtaatatatcatgaaataattatagaactcaccatcatgtagaatcagtgggagtcctaagcttgttttcccgcaactaaacggtctcatgtgggggtgatgggagatggtgacagatcatcgggcattagattctcaggagcatgcaacctagatccctcgtgtgcacagttcacaatagggttcaagttcctatgagaatctaatgctgctgctgacctgataggaggcagagctcaggcgataatgcaactgatgggaagcagctgtcaatacagatgaagcttcgctcactcacctgccactcacctcctgctgtgtggcctagttcctaacaggacatggtctgtggccgaggggttgaggactcctgatttaggaaaacactacaacagacagctctgaaaagcttcgtaagaaagaggcagcacactgggtgatttataggtacaaatatgatccaactgaataatgtactcattgttaaaaataggtgtaggttcccaagtgataaagaccatggtaaaatttctggaacagtcagacccctcgaccaatgcagaacagctgattttctagttatttatcacctaagtaaggctgaacatatacaagtaagttggacataaaatctacttgtgtgatattatctgtttcaacatcagaaaattattggggcttacagagctgaggacatttggactttatgtcttacatgacagagttgaagttatttgtctcaaagtatattcaatccactgggtcattttgttctgctctttcttggatgctacttcaaagcagtgatctccactgagattttctcaagagtcccgtggcatcattctgtacagcaggggcacaccgtaactgtgtgttgcctgaagactattctcaggtgattttcacattaaccctttacttctgccaccttgctatttgccacttagtgtcattaacagattggattccataatgctccccatgtccttttcttcctattccttttgatttctccagtaaaatatatccaaactcaatggaaggtcacaaaatatcaagattccatgtcttagggaaagtgaagatcattccattttttttcctggcaacaaaaaacccactccaaagtgtgcaaaactctaagataccatccacagttcatcctgtccagacagcgggcctgcatccatgaggctggccgagggtcgccacccaccccgccctgaaagctctatggcctgtgtcagtgtatcaggaagtgagctctcctctcagctggaagcaggaagaccagagaggctgactaatgatgggaatttcagagggagcccgagaagcctttctcttccagttgtaaagttcatgaatcaccatccagctgccagtcatgatggcaagaggaaatgaaaacagaatatctcctagcagaattgacaaaatgggaaaatccctgaagacatgtactcccagaaccataaccgatgcagggggtggggagggaggggctgggaggggagaaaagggggcaggaagggaaagagagcggcaaagcgcatggagcctacgcttttttacagacgcaaaaagatagatgcacattctttgtcaactgtcacaaacgaggtccttgattttcaatttcctgcaatcctggctaagagacacaatttttaagacattcctcatcagttgccaaatattgattattctctgtttagtctacaatgaaccagatcacacttgtaatattatttagaagcaaataaatctgcaaggctattggcgtctctccctaataaatcgtgtggctgccatgacccttcaccccagcggcagcctggtgtgataattggtaggtaaccagtttgcttttcactctaaaaagtgcttaattgtctcccttagatttgtaggcatgcatagccagacacctcgagaaatgacgcacgccttactcatttataatcagcatcaagcagacagtgaaaaatctataaattagagataagcatcacactccagaggcattaaagagaattctaaacgtctcctttgcaaattgttcaattaaaaacagaatgagctttttcacaggaaactactactgactccttttaagcttctaagacattcactgaggggcccctcccagctttccaggctaacgtccggataatccccccaggtacctgggccatggatctaactcctgtgatgctataaaggactctggtgacggttctgaacttgacaaatgccgtacccaaaatagtatattccctgtttagacgaactctaaattaaactcaaatccctttggttatttttaaatctgtattagttattttctcataaacagaaataactttgattatgaaacgaagctatttctcattgtgaaagaaataaaacatacagaaaagtatacaaagtaaaataaaaatgtcatgccatcgctcagagagaatccttttaatattgtttacatcctcctagaatttatatgcattcataccatattgtattcatttttaaattaaagtactatttttgctatattactgtcccatgacctgccttttgcatttagtacatgtggatatttcttccctatcaatgaacatattgaatgctagtattttattgttaaatattccaatcctgtatgaatgtacacataggttatctccagttcattattattattttaaataaaatgacagaaagagtaattataactcaaacagtcctgaaagccactgttttggaggaagtcctccaacatttggaaacccatccagtgaattccccagttggttacccagtggtctggaaggcagcagggaggtggctgggaagtggggctttgaaggaaggcctcggggggatggtccagggagaagaaaagggtctaaggccaagagcagagaccctacagcaggaaggccaaggtggaccctcaaaacagaggaattcatcacaaggacaaggaccgagaatcaggcaggcagccccagctgacactcacaaggagattgcacagtaccttggaggcaggcactgcctttcaagcccggcgtgtgtaactgtcttactaggttgactcatttaactgtccccatggccctggacatgttaccagtattgttcccattttacatgggaagaaagagaatatggctttaaataaaaacgacgtcactggataccatgacgtctgccaggaagacagcaaactttcacatagaactggaaagatatcaatccacggagttgcaaaagaaaagtattaatagagaaatgcttgagtccagcaatggaatctgccactaagaaaatttccagagacattagaggccatccatcatttcctgccaatggctcttgggaaacattcccaagctttacacagcaaatatgtagttacagcctagatatccaggtgtgcatgtctgcaagatgagtgctcctgaaaacacctataggtttccaaatgtgaacaactgaatacaaatgctagcaatattgcttcactggaaactgtaggaaaaatcaagagtaattcttaaagccacagggagggtggagaaaaacaccctaacatcagaaataaaatttacaagaattagcaaatatttataaaattcatgacaagctaagtatctgcagtgagtcactcagatttaacttgtctaaactcatggctttgacaattttaacatttcctcttttctttgatatttctcatggtgctattccatatgtaaatagttttaaatctgcacagtgctaacgctggaatgcaaaaacactttaagcagataaacttagaaatatgaactctaggaaaccctctaggtaaggatccctaactaaattacttgagcacagctgttaagtgaaagcacaaccctagacattgtggaaacccttaagcctcccactaagggaattcccattagagctcgtctctaaaatccgggccctggcgtttctactgtgagctcacagagcaggctgggagtctgttggcttcactgggagcttttgctcagtgtctaagtcaggcaaccgaatgagagagcgggtacggaaaagacaggaaaagagggtgtcgtgtgattcaggaatatcaggttaaggggaccccacggtcattgagaccaatcacactctgcaaatccctctgtctgtgccaatgcagcctccgcctaaaagactccggtgatgggagagacatctccacgtaggagccactggatcttccaaagttctggatttgaaagagctaagtgtgcacggggcttggctccgtgcagcttccactcgtggtcccgtggtatcaggagggcagtcgggacaagcccaacccctttccgtaacacagccaagtgttggaaagcctgccttcttactgtgttcttcctctcatgtggatgacaccagcaccttcattgtttcctacagggcctgctttaagtattcattaaatatttatgggacacctaccagggctaggcctgtgctatgcacacacaccagtgcccagggccctgatgtcccagtgggtgaggagctggtccctgagcattctctatgaacatgctcttcgtggcttcttgcccttagaagacaggatgtggactggacacagtgactagggtgtggtctgaccaccagagacacctaccttgtggtagcttctgctgcaccctgagaaaccatctggattaagtccagcactgttaaaaattatgattcaaaatgaacaagctgccctactgcttattttgaaaataatgttcaacctattatctgtttactttactggtgactggggggctctcagtacccaaaacacagttaaaatctatcaaagtagcagagaggaaaacagactcctcaaagatcagctgtgcaattaatccatggagagcctttctatcagaaaaatgaaattagattcctatattattccatatacaaaatcaaactgagtataacaatttaacaataaggaagaacaacccagtctttatgttcttaagtgggaatagcttctttaaaaaattcaaaataaaagcacaaaaatattgaaagttaaaaactttcttcttacaaaagaactcacacatagacaaagttaaagatagaaaactctttgaagatgtttgcagcatttgtgacaaaggactgatttccagaatttataaagaccatcaacaaaaagacagtaacccagtggaaatataaacaaagggtatgagctggcaattcgcaaatgggaaaaccaaaatgtccaagtaaatatttgaacagatacccagcctcaccagtaacaggaaaatgcagatgaaaatattccatgcattgcgtgggcaaaacgtttgaaatgtctgaaagcatcaaggagtgccccctctgttaacagaactcacaacagagggtaattggcagtaccaactggaaatgcgcgtatgtcacgacacggctccatgcctacatgcacaactgccagacacatgcagcaacgttcaacagcccagatgaggaggtaatgcaggcgctcatccaaaggggtacagataagcaaaatcagtgacacctgaaggagaaaagatggcttgcagaaaaacatgtacagtataattccattgatgagacttaaacacacaaagccattctatgcaccgtttatacacattgtttatgcatacattgcttatatgtaaagacgtggataagaaggtttgcacacggaattcaagccagtggatggcgttggtgggaaaggaaggggtggtgggtgccactgagagctctacaaagggaacgtcagctttatcttaacatgatctgaggcacatggtctaaatgtgattctggctcgccagggactcaaatgttatatctaagttttgagtgttgaatgtcaaatcattctctgcactttcctatatttaatttcctgccacatcgaaaaacggaaagcacaaaaattaaataaatattaaaccggcactcaagtggataatttaacagcctctaattacagaccaacggattgaattaggatcattagagccccggtgtcctttagtactgtgctgagggatcacccactgcttatgtgtaccctaagtatgcaagccacgagcagtcatacccaatgggtggctcttcaccagccctccagggccccgccttcaagggccaagagtgaggttaacggaagggacagaaaccccagaaaattgctctcctgggagttccatctgggtagccccgtttccagcattcttctgctctcaccgtaccagccctgacagctgcctcaagaaaggccaggccgggcgcagtggctcgcacctgtaatcccagcactttaagaggccgaggaaggcggatcacctgaggtcgggagttcaagaccaccccggccaacatagtgaaacccccgtctctactaaaaatacaaaaattagcatggcatggtggcgggcgcctgtaatcccagctactcagaaggctgaggcaggagaatcgcttgaatttgagaggcggctgttgcagtgagccaagctgagatcacaccactgcactccagcctgggtaacagagcgagactccatctcaaaaacaaaaaacaaaacaaaaaaagacaggccaacagccctgggctgagtaccattaacactgaaataaatagggccccatcactaatgctctgcacagattgtgtgcacagggcttttcaaatgtctgtccacgcacaggagtgaacaaaggcagctcaagaagaaatctcttcaagaagaaatgttgaattctctgatttctcacgaaaacatttattgctgagggaacccttggtgtggtatcctctccggtgtgggtctcagagttgtgtcataagagagacacagacctatgattctagttaaaggagaaaatgcatttgcgtggcaaaatgcaaaaagtaatgctaacctgcaaccaaatccatgaggatttcccttctgcctcctcctgacacaaacacgaggagctgtggcagctctccctgcggtggccacgggaggggaggacggctctaagctgtactgcatcctaggtccttcatccgcctctcattcctgcagcatccttcccagcaacaccttcctcttctgtgcttctctccactgcacccaccaacatgccacactgcatactttttattactcataatgtctgctcaatgcatcatttcattaactcttagttccaagctagcagggatttttcattattttgttaacaggtgaatggagcactctgtgtcccgtccgtgcctgcaaaacactgagaagccagacacacaaacagaccccatagaacgggagcgttcccattatggaggcacaagttgctctgactaatggcgctgaaataacgcaaaatcatccacctaccagagagcagaattcttcccaagacatttgtcacagagctagaatactggtatgaaagcagctagcgcacttccccaaagacactctggtaacaaaagaggacaagaatggcctgctgcaacacatacacaaactagcacttatgtacttgatttctgcatatctctctagcaactggcccaagaccctggagccgaggccagctccgtggcccccaccagccagcattaaacttgcaaactgtcaccaaaacacggttcacaaaggaaacttcacagctcactctccttttgaggatgggctatgaaaactcacactgcgggacttcaaactcatggtgcccagcacaggccaggaccctggtgccattcccccaggaagggctggagaacactgccctcgtgaacatgcccacagaacgcccagcaaccaggccgaagaacaatcccaaacccaagcacacttccaatttcagcgactttagccacatcacggcttttaatgagtgtggaacatgaaagacacagttgggcaggtgcttgaggccacacacacttacacatcagcagaaagtgctggtccttggttgctataacaacagtgccacctaatctacaaagagcttggaggcctctccacaccccggggagctaccgccgtctcttgtaaccctttggtatattgagacatgcacacactgacacgggcattttaggacatttttatgcccctggcggcgccatgcatcctgcgagagggattctctgccttctctttaacttttcacccgtagaacgttaacaaaccaggcccacggcagacagggctttggctggtggtcagtgcacagcagacagggctttggctggtggtcagtgcacggcagacagggctttggctggtggtcagtgcacggcagacagggctttggcggtggtcagtgcacggcaccatctcccttagcagcagaaacacagagtgagacaatgagaggtctgaatattttcccttttaatccagcttctggcactttccgaagatctgtctttcctgtcaaccaccgagtgcagtgctggggccctgagccatcccacccgtgtctcaaattcataccctgagcacctgagtatcccctaggaagttctgtctcccatagacaggggtaaacacccacccacgctagtgtggtcactcccttccattccacacagcactctgcattcatgaaattccatccaccgacctggattttcctttttaaaaagtctctgaggacagccagccctgtggatgcagtggcctctgggggctggtggcagggtccctggctctccaactgggaggcaaaggcaccggcctcggccagcgtgtgcaggggttccccgtgcctctgggccatgctggcctcgccgcagacctgagacgcggccccgggcccggggagtcggaggggaatgggagcgttgctgcccgctgaggcctctgggggtaggctgggtcccgggggcctgcactcctttcaaaacacaggctctatggcgacagacttaagaaaaaacggtgctgggcctcagcccccagggactgcctcagaggagactgcgctgcagcagggcccaggctggagagccgcgcacccgtgcagcagggcccaccctgtgggccaggcccagacacccccgagggtcctcccgcgctgccccttcagacctctgcaacatctgcttgagggcaggccccaggagaggaggagatgacacctgggggcatgcaggcctgggcttggctctggatttaaagcggcactccacgtccctggcggcggtggggtcgcgagcctgcacctgactccagttgaagacactagagggagcaccctcagtactgggccctcccttcctaaagcttagggggcctgggccttccccggctctgggaatggagtctacctctgcctgcctttcctcatgggtgcactgggctgtatgagtcagctcaggctgcgtaacaaataacagaggctcgtggttggaacagcagacattcacttctcacggttctggaggctggaagtagagatgaggatgttggcagggttggcttctagggggaccttgctctttggctttggagacagtgtccttccccctgtcctcatgtggccctttctctgtgtgtgtctgtgtcctaatcggccttttttttttttttttttttgagagagagttttgcccttgttgcccaggctggagtgcagtggcgccatctcggctcactgcaacctctgcctcctgggttcaagcgattcccctgcctcagcctcctgagtagctgggatttcaggtgtgtgccaccatgcctggctaatttttgtatttttagtagaaatggggttttaccatgttggtcaagctggtctcgaactcctgacctcaggtgatccacctgccttggcctcccaaagtgttgggattccaggtgtgagccactgcacccggccctaatctcctcttatcataaagacaccagtcagattggacaagggcccaccttcaagaccattttaccttcatcacctctctaaggaccctccctcccaatacagtcccattctggggtcctgggcttagagttccaacatacatttgcgagggcacagttcagcctataataacaacagaaccccaaagcctgggtttccacccaatattcactcagagaacgagagggggtgacaacagtgcctgggcgctgcggcaaaaatgctgagagctggcagctccacgtgcagcactgttctatctacctcgggtgtgtgaggctgaggagactctcaggcctgccacaactccctagtgtgtcatggtttaaaaattatctaccgaaatgtggaggttagaatccatcgtctctacaactggtgactcaaaaaatagagactaatttggaaaagagctgtcaggcccaacagaatattaatgttgctgctgtggttgcccagtgaggacatgaggaacgaaacacagaacatcactcgctcacatctgagccagcggtgctgctgtgagtctctaagaagtatccgtgttgcagctactgagacacgctttttcctgcccgggtcaccttccgcctctacagatttctttagatggtcctttcagcaaagaagccagtggacagctgagtggccagtgccttgggacgcacacacccagctggagtatgcaggctctccccagagcaggcaaggccatgtgataagaacaacaccgagctttcctctgagctcctgcacccctgcacctaccagtcatgtgactggatccaaactcacctgttgaggctaatttcccatttcagtatctgggataaggacacaggaaaactcagcgtgtgttttcctgttctcacacagtcaacccaacactctgacaccatatgttggagacctatcaaagtgtttatcctactctgtactctcaggcaataccacatttcacctgcagtctccacagtgcctggggatttcttcccagcagcaaccgatcagttctgcacagacaccagcaagatgtcctttaattcaattcgaattctgacactaccgacctggagatagcctcagattccacaagttgagggctcagtcccagaaggctacccctcacttcagatgccagtcgtaagccccaggctgtagcctgtgcttttaaccaactggctataaataggggttcctattgtcttcaactaatttgcttcaagttccctccttgtcttccactaatttcaactaaataggggttcctattgaaggggttccttcaactaaataggggttcctattgtcttcaactaatttgcctcaagttccctccttgtcttcaactaatttgctagagcagctcatagaacccagagaaccacattattaaggtttgctggtttgctgtaaaggatattacaggacacagatgggcagccaaatggagatggacatggggtgaagcatggggaagggtgtggagcttccgtgccctctgggcagcacgaccctgcggaatcctccggctgttcagtaatccgaagctccccagccccagtccttttgaattgttatggaggctccattacatagacgggctttatcaaatcattggccattggtgataagcttgaccgtcagcccctctcctcttcctgggggttgggggtggggatgaaagtctcaaccctctaatcctgcctgtggtctctggggtgaccagcccccatcctgaagctactcaggggccctcagccaccagtcctcccattcgtgtacaaaggacactcatcacttcaccgattccaaggggttcaggaaatgggaagaaagagcacatatatgtattttggtatcgcagatactgcctgcctcaaggattgtcaggagcactcaaccataatggaagaatggcccagttggaagacaccttagaggctatttcaaacttttgcacaccgacaatgttctacaacatccttcacaaatgcacatcgcatgtcttagtgacacaagcccgactcacagatttccagctttgtgcagctatgtgtggccgctcctcctcctcctcccaaagcttccttccccctttccaccacacagactaaggcatgaggctgggcagggggaagggggatactgagtgaggaaaacagagagggcggtggaggtggccacacagcatagctggtgtgctctttacagcaaggcttcagagcagcgctggtgtgtgcgtggatgctgaggatgaactcaggtccaagctgcctgactgtactcccatgggtacgcctagctggggtgcttcctttccaatgcaaacgacctctgcaggagacaggatggcacaggggcctcctcctgaagctcttacagcagattctcgacctctgcagctgtgagaaggcagcggctgtgtacggacacagagcagacacaggcactgtgcagaggggtgtgtgcttgacattctgccctgagttgcccatgccagtgaatgtgccaacggtccctgtagatctgcaggagcctggaaatgtctcatttgtcccgagggcaaatgctggacagggggtggtgaccagggtgaacgagacttatcctgtcacttttgtatagactctgtaactttagaaccatgcgaagagattacttctgaaaaatggaaattagcagcaaccgtagaggaagctggtcagaggagtgtggcacgtgctgtcttcaggagggcgggatgagggcagcccgggagggagtgcgggccaggcttccggctccatgctcccactgccagcgccaccacctccccaggcaggagaaacagctaaatcctgaaaactaacaagtaatgggtgtttctgcggtgtcttccaccggcagaaactccaccgagtgcctcagcgaaatgactccatctgatcctggccacaggctagtgagggggaactgcgccgggaaagatgccggtgcggggctggaggatgctgggcagagggggcagatcagcctccatgggggccccacctcctcgggccccccatccccttgggcccccacctcctcaggcccccacctcctcgggcccccatttcctcaggcccccatttccctgggcccccacctcctcaggcccccatccccttgggcccccacctcctcaggcccccatctcctcggtcccccatttcctcaggcccccacctcctcaggcccccatctcctcaggcccccatctcctcaggcccccatctcctcgggcccccatccccttgggcccccatttcctcaggcccccatctctcaggcccccatctcctcggtcccccatttcctcaggcccccacctcctcaggcccccatctcctcgggcccccatccccttgggcccccatttcctcaggcccccatctcctcaggcccccatctcctcggtcccccatttcctcaggcccccacctcctcaggcccccatctcctcgggcccccatccccttgggcccccatttcctcaggcccccacctcctcaggcccccatctcctcggtcccccatttcctcaggcccccacctcctcaggcccccacctcctcaggcccccatctcctcaggcccccacctcctcaggcccccatcttctcgggcccccatcttctcgggcccccatttcctcaggcccccatctcctcggtcccccatttcctcaggcccccacctcctcaggcccccacctcctcaggcccccatttcctcaggcccccatctcctcaggcccccacctcctcaggcccccatctcctcaggcccccatctcctcaggcccccatcttctcgggcccccatcttctcgggcccccatttcctcaggcccccatcttctcgggcccccatttcctcaggcccccacctcctcaggcccccacctcctcaggcccccatctcctcaggcccccacctcctcaggcccccatcttctcgggcccccatcttctcgggcccccatttcctcaggcccccatcttctcgggcccccatttcctcaggcccccatctcctcgggcccccatttcctcaggcccccacctcctcaggcccccatctcctcgggcccccatttcctcagacccccacctcctcaggcccccatccccttgagcccccacctcctcaggcccccatctcctcggtcccccatttcctcaggcccccacctcctcaggccccccatccccttgggcccctcttcctcaggcccccatctcctcaggcccccatttcctcaggtccccatctccatcctccttaatgtctgcactgcctggctgggagctgcagcgggagcctggcctctcctcctcctcctcctcccaaagcttccttccccctttccaccacacagactaaggcaggaggctgggcaaggggaagggggatactgagtgaggaaaacagagagggcggtggaggtggccacacagtcagcatcggaagcagagctggcatgtcccttctgagtccagcccggcttgagtcagcggggaggggcagggaggagggggccttcctgggagaaggcaggggccgcaccaagtgcccctgaggtgcccatgccggagagaagttggcttcctggagccccactctgtgctactgtgaagggcggttccatccgcctaggttttgttagttctgtgagccatacaggattagcgtgccctgcagtgctgcagagacatcgggcgtgctcccctcctgtgtcctcagcttctcccctgggggggtgctcaccagcccagggccccaccccaaccctagaggtccctgggattccctgagttctcaccagccttggaggccccgagtcaccccacgcagtgcacgcacatctgtgacacactcctcccacacagtctccctcagcccctcttgaccctcctcctcctcagacacacgcctttccggggcctgtacttgtcaatccccagacatccctggctgcttcctacatgcccaggctctgcgcttgctggcccaggaactgccctccgtgcctcttctgactctgtcacaacgggggtttctgcatctgtgctgtcttcccttctactgtggctgaggaccgcaggtgccacccgagcccgagctccttgagcatcccttgtgcctagaacatgccaggcacgcagcacagatgggtgtcattggtctgggacattgccacggaagtctccagccctcatgcaccagaaagagaagagtgacaaggatcatactgaggaggtcaggaactctagctgagaattggtctaaagcaatggaaatgggaaattctgtaaatccaagctctgctccttggaatcatttagaaactggccaagggctaagacatccctcttgctgcgtagactgtgatcatattcaggaggaaaagcacaactctctgaggggacaaattctatttgcctaaacagaggtgaggctgctgacactctagaaagtgtgaagtgtgcttttgtgaccgaagctggcctctgcatcccctaactcagcacctcacaaagtttataaccctcacgcagtgcccccgagctgcaggtgacggcaggcctccaggttcagcggtgaaatagcggagcagtaagatcttacagcattacttccccaagtcagccggaagttttgccagccccgtgctcctccctgaaacctcaaaaagcctgcttccaagccgcctgcttgttcttcccaaggtggaggcaagaccagcgccctctggccaggtgcgttcaggaaggggcagagattacacaggaattcagatgagttccagggacggcagctgccagggtcccgtcaaacgcacagtcacaggagggcttcccctgagttggccctgagtcagccagctgggctgtggtctgctctgcagcaggaggcagctgagcagagcctgtaacccctcaggggaggcaaagctgcaccgcagggcgtggaggaggtgcaggccggccagcccaaggcagataacagatggcgacaggggcttgaggcttggcttctctgctggcctaggtgtctggaacggctgggccgccactggagccgtggaaagaggggtctaagtgtctgagcttggaatcaaggtattcccaaattttctgctcgaagccccacaagtttccattttccaccacagccagttggatcaaactttgcaccattcgcatcctagtgaagtccaatagtcagccgatttggggattctatgcaaagccaaacagtggcacagactctaggaaatctacagaatgagcagaacatgtcttcatgacgattcaaggtcaggccctgtggaccaaggacagcatggagcacagaggccagactccgtggagcacagaagccagacgctgtggaacacagaggccagactccatggagcacagaggccagactccgtggagcacagaagccagactccttggagaaaggggccccagaagacaaaggggccagcacaggccagccaaggagtacctgagacctcaaaggcgacaccaggtccatttgtacctgggtattcaatgtctcatgtgcatttgttagaaattagataaaatcaatgcttattattttaaataaagacatcgtttctaactattttagtcattaataacctgtgatcttccagatgggccggcctagccaatgggcggtatagccacaacccaggtcctctgtgagtatgatgaagacatcacacagagtgaacagcctctgaaacgtagggctgtgaagcgcgtccacagtcaccgcagagcaagaccagagtacacatcctttaccaacctcagcttcacattcaacagcgagcggacacactgaagtctagagaggcaatttagaatgaatggaaagagaaaccttaagagacagaaaggcagagagagatttttcaaaatcttattttataattagtaaaaatataggaatacagtcacttcaaaagctgacattagctaagaacattaatgggttattaaatatttaatttaattcagagatgatagacccataatgatgattaaggttattatagaaaaggatgattcttggtgttagagatcatttactcaaacccttgtattttaaaagaaagaaagactgagactaacagagttaattgatttctcccaaggaaaagcacggatcacaacctggttctcccacctgcggtccccacaccattttatgtggttgttagcctctccccctgactctccccatagttttgtgcttgttgttgctggtttcttggtaaaatctgcatcaagtagatggatactcttggggtaatggtggcccactccctaaccactgtgttaagccttgtatactctgctgagtaggtaaatatttttgtcccctaactctgcacctggatttatttgctgtgaaacgcagggcccattcctaccgactataagcaatttattctgtgggtttagtcactgcagagggcagaaacaagataccactccctttatggggcattaaaaacaaactcctctttgctggtgaccctgtttctgtaggaagtgtgtggtttacctagagcaaaggggctggctgtcctgccagacttaagccagatgtagggctccatctatcttgttcatggtttcaccccagtccccagctggtataaccggagcacccagtaaagaagaatctacgcaagggaagaacagtccccctcaggctgaacaaggagacgccacctctgcttatacagcagcactcaactgactttctctgtccattcttcactaaactccttaaaaataaaattttagttataacttcagaaaattaacctctgtaaagaatcaataatatactttaaaacatgtgtaatgctgttggaatttttttcttgtcttatgaacacaaaatgtcctatatttatataaaaatcactgtgttgacctttctacatgttcttccacagctatctattaatactatgacatcatattgcaaaaacaaacacacacagcaactcggatgtgtttgataataaaatcacacagcagtttaaaaattcatccacagggacataaagttaactgttgttattatgaaagtttgtcacctccctacaaacacatcttgactgttatttagattgtgttaatgtgtggtgttattataataaagcccttattaccacacttattgtggttgttaaacagtcattagcaaccatgaaactgggaaaatacactgagctgcgttgcccatgagctatcacggttaataatgaagaaaacagatcaagagctctgggatcctctacaagaagatgcccactttcccgaaatttcaagagagacgactgtcagaaacgtactaacccaacacaagcatgatgaggaacccaaattctggaaagtgcctttggccatgcttgaacttgatctgtaatgctctcctgtgccgtccgtcttcccgtgagaatccagccccgagccccagccacacaagacctcagtctccctgaggcccgaggtgcatgcagtgatgactgcctaggaccgcctcagtgcctggaacggtttctcaggcacaattctcacctatttttgcatttcccacatcatgtatgttggaagaatcttgaatacacaaaagctaccagttttaaaaacaactgacagtgttttaaaacttaggctctattattattcaggtgtggcagggcaacaggtcaggagacaactgtcagcgaaaagagagtttgttactcacagatcccaagagagggggccaagccctggggaccactcagggatgcactgagcctgtctggaggcagaggggtgcaggaacgtgtgggcaggggcctttcacgtggcttccagggaaggaacaggtgagccagggtgagcctgcatgggactggttggtaagggcagttcccgtgggccctgctgcacagggggttgccctcgctggctggtactgggccctgggaggattagggcaggaggatgtggcccagagcgtgagagtccataaaggaggtggtgggggtgggctctggtttgcatttgaaaagtgcactcctgggtgagttgcctgctgtgtctgggaattagaaaccctgggggagcagcctctccagggccagcaagcctccccctgctccccaccaatgtcaaagcatcagatgcggaaaatgacaaggcctggttagtgtagacaggtagaggtccctttcccagtcctcaggctggtgtgctgcaccctcccaatgccatgtttgaccattgtggtctcagggaagggctctgagatgggtgcccagggcggcgggttcaggccctgccctgtcgctcactcgtcacagggtgaacttgggtcaggaatctcaactctcggcctcagcctcctcatgtgtgcaatgaaggggttgggctctgtgatttcaatgaccccttccagcttccagattccacgagcccctcctcgtaacctggaacacagaaaatctataatcctgtgcttgtcaaggagcccagacccagggccactgaattccaacaaatgtatgattcctcagccaaagccgtgaagggtggcttggaggtttgcatccacgcatacttctaggtggcctcagatggcccctggggtaaaggcagatcttccaagggcagcttgctggtctctgcagtgtggattcccagtaggagtgctttctctgctttccgttttagccttaccgccccagcctacaaccccgggcatggcaaaaaccttatgaagagatgcattgggcctcctagatgcattctgttcagggtgttcactcctttatacggtgaactctccaggagaaccagcaggagatgtttcttacagggctcggaacagaaagagatgtgtttacctacacaactggggtttatttatttatttatttattttgcttgttttgtttttatgtttccagtctgccctgctgcgctccactccttgagaatccagcaatctcagaatcacacccaggcccaccttccgcagggctgggggtcctttcgacacgcaccatggctgctgcgctccggcccagcttcctacctcctcctttccttcacctaaacaaacgcacttatggattagcttagccttgtatggaatataggtaagtttactgacatctttcggacgtaagacggggtgtcggtaaggaaatacccccactgatgtgactttatttaaatcagagcaaacaactgcatgagaagctgatgtcaagatgtaacggactcagggctgagctgggtaaggagctggaattcacacttagagacctgtctgtgcttgtcacgtgtggataagccacttgttttctttatgctcagttttcttaattccaaaagttgaagtaaacaactttcattcacattatataattatttaaaataatattatttcaggagtaatttcaaaataaaatataaatattccttaaaattatattctgtggccgaggcgggtggatcatgaggtcaggagatggagaccatcctggctaacacggtgaaaccctgtctctactaaaaatacaaaaaattagccaggcgtggtggcaggagcctgtagtcccagctactcgggagggtgaggcaggagaatggcgtgaacccaggaggcagagcttgcagtgagccgagatcgcaccactgcactccagcctgggcaacagagcgagactccgtctcaaaaaaaaaccaaaaacaaaatgtgcacacagttggaaagtcacagattttctttcaaaataatgtcatacccatgggtctgtcagtgatttctagaacactgtatttcatattttttctttttaaaaagaattacatgagttacacttaacagcaatttctcaacagattgtaggagcaattagcatgacctggtttggatcctaatctgatgcactctgattacatatgattataaacacgtttgggttaactcacttaaaaatgggcaatctcggctgggtgtggcggctcacacctgtaatcccacctctttgggaggccaaggtgggtggatcacctgaggtcaggagttcgagaccaacctgaccaacatggagaaaccccatctctactaaaatacaaaattagccaggcatggtggcgcatgcctgtaatcccagctacttagggggctgaggcaggagaactgcttgaacccgggaggcggaggttgtggtgagccgagatggcgccattgcactccagcctaggcaacaacagcgaaactccgtctcaaaaaataaaataaaataaaaataaatagtaaaataaaatgggcaacctcaagggtgggaggaatgaggagtgtttaatgggaacagagcttcagtttgggatgatgaaaacgtcgcggagatggcggtggtggtggctgcccaatgtgaatatacttaatgccgctgaactgtgcacttaaaaatggttaaaactgaaaaatcttacgcacatttcaccatcacataaaaaaaagcagaaacaattttttaaagggcaaactgctagctcttgaagagttggttctcttcacccaaaactttaccttttagtaacagtaaaaataaacgtcagctttgtcatattttctcccctttgcttctgcacttgcagaaaaattacggacacccttcccctcagttgtgaaaatacacttgggaacagaaacattaagttttcttgggctcaaacacaccctcaaacacaagataaattaaaaacaaggcaaacttcagccagacatgaggacctgctcttggcaccgctccgagacctgtgttcatgatctgtgagattccactccgcccagaaaacagcttgcccctggccgcccaagctctgtcacacccgtgatttcccagcagtaaataaaaactgccaagctccctgggacccccatttcctgcgagccctcccttacctttctgaggaacagtctctgcagcttcttgtgtggcagcctgatcatcatgatgcactccccaggtcccgggggccgggctccccttgccgtccagccattctgccagggcagccgccactccttttatcaccttgtgggctgctgcgcccgtcctcgtcaccaggcagccaccccgcacacctcctcttccctcccctcacccctctccaggcagccacagattcccaagccgggagtcctgcccctcacaggcaccagctgtgagttgaaaaaactctggctgcagacaaaacccccgctttgcaaactcagaagcaaaggagagaagctgagaaaacctcagccccgaggctggccttctcctctgatgagaatgcgaagttactcatgctgctccgaatcccagcaggctggaacacaacatctggcagaagccggcaaagcagaagcgtcacttagaggcaatcaaatgtcagaaaccatcaaagacactctgaggggcaggcctgaggtcctcctcaacgcacacctgcccccacttgcccacagccaggctggcaacgtgccttagcagtgcatgaaaagacacttcggtccttctctgtgtcatttaaactgaaaggaggaggcaggcgtaggaggaaggtgaatgaaaatggttgcttatttctttaggtggcgctgggtcagtgaatgcacaccaagggtgcgaggatgtcatcaccctgtattacccctccagatgatgcctccgccccagagacacaggcacgtgcacatgcatgcacgttctctctacaagcttttcccgggctaactcggaatatgtcctctctggctaacataaacatttgctttgttttcctgatcaaaactgaattcccatgtttccagaacatcagcccctttcttgctttcacttgccatggagccctgccttggttctgccagaagcgtccagggctccgtgtgattggcagctgctgagtacaggcggcaggttcagagtcagacccaggacactggcggagtttcctttgtttactggtatagcttcttgttaatacataaatagctttctcctctgaaaacctacagatgcaacagaagagacctaccaactgacaatcgccttcgaggtgacagacaatagaggccacggctaaggatgcaggtgtggaaataaacagatataaaaacacaggacttgaaaagaaggaagcaaaggcaaagaggaaatttaagactgaaatggacagaaatgaccttgatttagggtagtgcattgctaaaagacggggccctgtccatcccttccttactccaagacattgagataaagaatatttccttcccaatcagacagaaatagttgaagtgcaatcgtcctttctccagtggttgctatttcaggaaatgggttctaccaaaacaacttttcacccatttcgtggcttccagagcacacatggcgtatgttctttcccttgaatgcagagctgattaaaactcatttatccaggtcaatgttgcattcgtgtgtgtgtgtgtgtgcacatgtgtgtgcctgtgtgtgcaggtctgcgtctacacagatacatacatacttcaggtaaataacaactgaaaggagctttggtcagtccttcagagggactttctaagggatcatttttattaaccctactttccactatgggaactttattaagaacctataatgtaacatttttagaaacacatgccatacatctgccattatatacacatttttttctattctggagccgttggcaaatattacttctaagcagaacggtcacacttctgagctgttactttgagaatagagcacggtttgttcacaggccaagttatggcaacagaagaaaatgcctctgtcttccaaaatttctcaattaccttttgctacttttgctggcccaaaataataacacggggagattaatagaaaataaggctctttctagtctcacgaaatttcgtctctgtgattttatgtgagtctcagcactgctggtgtgtttcagccttgacttctctctgtgaaatcatcaggagctttaaaacaatcccagttctatttcttttctccaaaatgaatccacatccacatttcacctctttgaaaatgctggatcttaaaatatatgtgcagcctttcacagaaataggcactcctgcttcctggaaacacactgctggcgtcttctcataccgtctaccgctggctgcagcctcagctcctgcggaagacacagccgcagccgagtccgtatcctcgcccagcggtcaacgcagcgccgttcccaccattgtacagagaggtttgtgcttggtgaagccctactgcaggggatttctgagtgtcgaaggaggacaatataaaatattttcctgaaaacttaactctgtggtccttcacaaatactttgttttaattttaaaatatgtagtattcaggcttgattgagatttagaaatttttactaaatttttgtttgagggtgtggtgttggggccctggtattgtttcaaatacacaggaataaaaacggaaggtttcttttggctatctgtaacctattcattcggttggcaaagatgcgtagctcatgtagggcaatgttcccagcttaggcaaatcaggggcacctggggaatggcgatttggagagaggaaggtgggctcattctggtgaacaaatatttccttaggtaattttgcacacagagtaaaagtgaaaggcttcttaagaaattgtgtttacaattgtataaacatcttctttcgaggatatattgagctggtctaatctccaaaggaaaaatacccaagtcaagcaaagcaattgaactacatcgaagatgaactcaccaaagcgatctactgaatgtcaaagtgataagatcatcgcacagagtatgtgggcaccgcccccacccccatcgcggtctggtttgagactgtgaggactccaggttgattctatcgctcctggcaacaggaaactagcataggttagatcagtgcaagccacggaaagcttgaaaatggctcggccaaaaatgctcatctttcctgcaccacatattttgctggaatcgcttgaaatagcctgctcactggcaatccctcttcccatttccaacctgatggcaacgtgcatggatactgagttggggaaagaagaatcggatgggggaaatggaggcacaaagggtccgaataatcctcacctacagtcatttgggttttggtatctgtatttacagttatcctaaatacaattcaatccaaacttccataagaattaaaaggaaattttccaggacttggtacttttgaaagtgcattagcaaaataaatcaggcctttggtctctggctaaatggtggtcatgtgagagctagtgggtttgcaatggaaacccttcattcttaatggcatttaattgcaggtggatgtgagtttgcgaactgaatgttgtcgtggtgatgatggcaagaaattgccttttattcatttctgagaccgagtcttgctctgttgcccaggctggagtgcagtggtgcgatctcggctcactgcaacctccgcctcccgggttcaagcaattgttgtattttagcctcttaagtagccaccgcacccggctaaattttgtattttttgtagagacaggatttcaccatgttgcccgggctggtctcgaactcctgacctcaagtgatctgcccgcctcagcctcccaaagtgctgggattacaggcatgagccaccacacctggctgccttttattttatgccatggggaaatcatcataacaatcttggcttactcatctaccaaatacatttttaaagacattattttgaaaacatctctggctaattggtgaaaagcagctattactgtgtattggctatggctttaaaagcattgctattgttgacaggtgagcatccaccttccagcagcagaaccaaaacgctcacacaattcagcccaaagaataaacaaccacgacacagcggaaagcatctgtttcgtgtttccattagaccatcagcgtctcagcctggaagcaatattttgtgtcttcctctgaaaaacctagtagttcacttccatatctttggacccatagagaatcagacggatgattttagcctgtgttgaagacatcactgggagtgagttgtacctttccccttcctaggccccggggagataggaaggtgggaccgcacggctgtgtcctccccattgggaatggagtggaagggaagtgtctcctcgcatttgaggcagcgttgaaggcgcaagttatcccctgcaccccagtctcatggcgagaacaaagagcccagggagggtaaagctccagatggggcagcctcgtctcccagccccctggacctcccagaaagtggccgaggataaccctgcctgtgacctcatggaaaagaagccttgcagacaggagtgagaagcaggctctatcacgtggaggccctggtgtcaccacagaggtacatggtctgtcccacctggaccaagacaagtggcagaaaccttaggtactggtttcaccaaaaggaaactgaggcccaaagaggccacacatcccaggcactaggacagtggtgtccctgcgtcctcccctccctcagtctccccacattttaccacattctccctcagacgcaaaaccgaatcatggcctctctttaccgctcagccatgtcagctcaaccttagcaccgttcaaagcaattggtatgcatgtgtgtgttcatgcagtgtgcgtgtgtgtgtttgtatgtctatgcgcatatgtgtgtgtgtgtgcatgttaaacggaggacggaatatgaagttcaaattcccccacggcacctggcgtagtccctggcacatggagtgtgtaaagtcatgttcttaagtgaaagtatcttgggaaactggcctcattttcccttacgcagctgatctcgaatcacacaggatctcgcactgggctgtaagccggcaccagggttacaacctgctgtgcaccacggtccctgagagactcagcctcacatgaaagtcctgtttgctcccagttcacaggtaaataaatcaacagctccacggagaaagaatagcaccttcccatcctgtccactcccaggaaacgaccttcacttctgccccgacttctgggagccaacaaggaaagcggagcaagccatgaccctgagccttgcaccacgagatttgaggcctgtgggcaccgaggctactgcagagcacaggtggaaacacaggtacataggtgactctccgtaggtcaaagaaacggtttcacatgcttctgtgataacagctgcaagcatgaataaagttcagtttcctttggaaggcattgatggtttcagcagctctcctcaatgcgtggatagcaaaaatatagctactacaaggtggggtctgtgatttattgttattacatttccaacagagtcttaagctaaaaatatttgggacccagtaactgagaagtcctagcagtagtatcaggatcacagaaggaaccacatttcctgccttacaggtttggtttccagacttagctgaagcctgttagatggcattcgcttagcatggaaaaagcaaagccaagaataattttaaattcttttggagtcattaaagggttacattaagaaaatggaaaaatattatttccacaaaataaactgcaagagtaaattatctttgatttcagcaaatgtctgcatcatagaatcacagttaagaccctaaagccacatggctcggttcaaatccatgactcccctacttggctgtgtcacctggtacaacttaattgcctccatgctcttatctgtaaaatgggagagagcggcaatgagagtgactacttcatctggttgttgagggtcaaatgagttcacattgcaaggtgcttagaacatactgagtattctataacgatttaccaaagaaaagcaaagcaaaaacaggagcaaggaagggaaccttggatttccttgggggaacaaccttggaaaccaaaagttaattaagaaagagctgtcaatttctttacctcctccctgtacagataagagcattgagaaaaggcgtttcgtaagtagtgaggcaccacacggatgaacggcgacgaccttgttagttcgctgttacagatcaagtcccaagggccccatgataataaccaactgcaaacgatcccagcaaaaccagagctgtgcctgtccgtgtacctcgagaaagaggggtgcacccagcagtcctttaaagattgttttcagatccatgacggcacggccggccttgtctatgtccgtcaccaaatgctgaattgtgtggcagacacaacactgtccatgacctgctgtaaagcagcttctgttagggttcttgttgttcggctagaaagaatgcgaagtgtttggggagttgtgagcgtgaggaattgccatgtgcggggcttctgagtgccctgtgccttgcatcgctgccggctctgaggaccacgcggtgctgggactccactcccactggggagggcgtgagtgagagggtgagagaaatgaggctgagccccagctcagagctgggaagacccctgggatcgcccggcacagtgtggtcagggtcatttaaggccagcgacattttagtgatgggcagagggaaggacaccagggggcgcgtgaaaaggaagactgtgaggcgggaggaagagtgggaggctctgcccagggtggccgaggagcagggtgcttcctaaaggaaggtgtcgagaacggcaagctctgaggaggtgctggaacgcggggatcaggtctaacaacacggggcccgcgcttccctcctcacaaggcagctcaatgaagctgaaggagtgaaatccagccacagtgagaaggcgggcaggggtggttgctggaggaggccatgccgcaggcctagatggggaagcagagtggggcaaggagcagggggttgggaaggggtcagggtccctgtcactgaccacattgagtgtggctgcacttccccaggcacagccgggtgccctcactctgtgaaaaacaaaccacaaggagcctgcagccatgagcccgcaacccctgacaacgggaggaagacgcgccacagggactgggacagcggccaccgcggtgacacctacagccacgcaagcacctgcgtaaacacgtgctacagtcacatgttacgtatttcacacatttacacactacacaacgtgtgtgtgttcacacacatgtgtatcaacacacatatgcaggaacgacaaagcactttggcagccttgacgttatctctaccgagttctgtcctctcatcatatgtccacggaggtggcatgaccttcccaacaccaaacggccaatggggtgaccccgcctgggtctctcagctccagcctggggctttctcctccctgccagctccagggcaggtggcaggaggaacagccaccacgctgaacaaggaaaggacccagaagttaggccacatgaagagagccacagtcctggagtgagcctccacgtggccagccagcatgggtagtgtgtgcagcatctctggactcataaacagtgctcctgacgctggactccacaaagccaagtgccatgagaagctcccagatgtttccagggctgcaggtcagcaggtgcgtccagcacaccggccctcaagtagaggatgctccgggacgcgtggtgacgacccacggccacgagcacagccagccctccttagccatggcccccgcacctgctcccacctccaagatccctgctgcccgcttagtgtggggtgacataggttccttattgcatccgcagctcagggacgggcgcagtgtgctccaagacatagaggctcaataaatcctgcagtaataacaagaaaacgactttgtttaacttttcgtagattataaaggataaccatcattccctatagctcttattttctgagacctcgatgtagaaagtgctggcttaaagtggtgtagaaggtgtaagatgtggagctggcatttaaagaagagaattcaaagagcatcttacttttttgaaaggcgtggggctaagcatcacattttacatgcacagctgagcaatcgacttaaggtgttttaggcttcatctcctcatctgtaagatggcaatactcacagtaatataaagaaacagtgattatgaagaattggctggggcaatggcaggcactcagcgactaccagcttttctgaacaggggaagggaggttgagtatacactcccttcacgctgacacagtcctccagcctgttaggaacaaaacacttcccgctttctagttcactgaaggtcaatatcataatggctgtgattacgatatgagaaattctcagggtgaattacaaattccaaacaaaacattccctttgggtagcctgaggtgtgtaattatcatgatgacgtctttggggttgcattggtaagtggcagtgacttgtttgattaatggattgaatatttcttttcatgtcactgaatagaggataccttcaattggtgaaattgcctgagagacaacacttatccatgttactaaacccaagatatattgaataacttaaatctgtatcatatcatcacccagtgagtatagtgctatttaaaaattttttaggataagctgagccttaactttaggcctataacttcaattatatttaattttcaaatataattattgtaccagtaatatagatttctttggaaattattttaaaaatgaagaaaagaaaaaatacatataattgtacaacttaatgaaaagccttggtaatttttggatttgtgtgtatgtgtgttttcctttcaagctttttctaaaaatcttgcctgtttctgtgggagttaggaggtgggctatagctgaatatgataaaactttgatgtactgttttttcccctaaaattaatgatttttctccagctatcccaaaaagacatttataagtatggcctcaatcaaaggatttttctagctcaaattctaattctgactacagcactattttctgctgaagtgcaatgcacagattttgaaagcccacccagtgactcaagtaactacaggaatgaaacagaatttgtctcttcagcggttgtttggggctggaacgcagaagcacagaggttgcgaggtgctcctttttagctgctggtatttccttttgctgccacccctgttctggaagcttcccttggcaccctactcgccccacagtgtctggacccagctgcgtggccctgtgggcctaacgtgcctctcctccctcgcctttgtttacaagtccaaagaatgtgcctccccacccccgaaccctgctgcacccagaagtctgcaccaactcaccgccacgagagtgaatgaaggtcccttccttacctgggggctgccctagcaaagaggaagggctcagctacctgtgggaaaagccagctccaccatggaatttttgtctctgaaaacagactgaagaaccagacttttgtattttatcccctagactctgcccagtttttaatgtcgcctatcacctccccatgagcaacgccatcaaaaagcaaaatacaactgcgactaccgtctcacacgcttcagcttgcaaggcagaggcacggaacgatttgatgaaaaagacagaggaaaacagaaaaatcactcctctaaccaagaccacaaaggccgcgcggatcaatgtgctccagatcaatgcggtccagaggtgaaagcgtggttagaggaagacaaaaaggacagagaagccagctcgcgctcccttcaggatcctacttggaaaattaattttgtgactcagctgagggctgctgctgtcacccaggagcccttcagactgcgctccacttgccagcaagcctcaaagggacccaggaagggtgaacattcggccagaatgtgttgagcgtccacaatgttccaggcttagcccccgcactgcagctccctaagttgctttgcaaaggactgagtttgggtcacctcattattttatttgcatatcaggttacctgacaaaagaacatattgtttcccaaattattaagaactaaagacaatacctcctcaaacacacacacacacacacacacacacacacacacacacacaccctggtgtcaggcagccggccaccacagagtgtgtgcggggattgctaaccatggcagagcctgctctcactgtttgggtgcaaaccttgggggttttatttttccacgactgtggagtctgcctctgtgtccccacatgtaaaatcgctaccttggccaccactgcaccataacaagagtgctcacatttctgtccttccaataccaggaaatctgagaaacaattactttttctttgttcaagtcccacccaatcgacagatgatggatcaatgcagctctataaaacagggcatgtgtgttcacttcaaagccataagaaaagggaagaaagaggaggaaacccagagagggcctcagcgggcagcagtggccctggacaagctccccccgttctggttgaggttgggtatggacaaaagaaaacatcctccccttggaactggaacctcctttgtgtcttttctaaaagtgatttttttataaaggcaaataaataaagagtgaaatcatgatggagaaagaggacatacaattagctgtgaaactagaggcaccttgcaggacttattaggcaaaatccatgaaagacgctgaccgctgtgttagtgccacccacgcttctgggaccatcctggtgagcggcccaatgttccttagccaagcggcaggggcagctgcctctgcttcagaggctgagtctgtgttaggagtttcagcaggagactggtataacaatctgttgaacatcaacttttgtagagtcttttaaaaaatatgtacagagagaggtgagtagggagggagagagagaggaaaacaaaacaaaacaaaaccagaatgatcagcagagggagagttaaagccttcacttggcaatcactgctgccttcctaccttttcagacttctgggctgctcccgggtgacgctgtgtgagatctgatttgcttttttcatcctgaacctacggggttcccgcctatcaaattcaaggtgaatctggaaacactgccaggagtttaacctactccgggcctaaaggcagtggaggggattttgctggccctcagcccacagagaccctgtggccacatggctccgggggttctcccatgctttgaccctaggatgtgactggacacagggtcctggcagaaacagccgctttcctgggaacactttccagttccaactatggcaacttacggttaatgcctgtgccggcctggctgttgatttaggaaggaacgactctccaagggcacccacaccctaccctggccctgaactctgtgcagcacccaccagaccaatggctgtgccattggcccaatgttcactgctatgaccaagagaggagaaacacccagtattggaacgcatcatctttatttggagtgcccaggctaggtgtggattgggatgatacagataataataaaactttttcatttgccaagaaacacagttcatcacacatttggataaagccacgtcaagtttcgctaagaatcaccaattacagcttgactctttttttcttggacagattatggaacagactgacaagagattatgagaaaggaatagaagacggtgttcctccaactccagcagaccttgtttgctgagttgatttaagttaggatgtaatccaaactgggattcaggcatttgcttaaccccttaactgaaatagtcagaaccagcttgagattctgtgtgcccacccctcacctttgcatggcctccatcaaccatacagttcaaaacacaagttccacgtccaataaggaaacttaattcatgcaaaatgcgttcagacccagatagtagtaccacaagtatggaaaaagtaaaacagtggaattcaaatgtcaagcattgtgggcaatggaatgcagtagggacctctcttccaggatttgggaccacctaaaaccaggtgggactcagcctctcccatcagggacttgcaggccccagcgacggggctgagaaaaggcggccgcatccttgtgcagtgccctccctgggcagctccgagggccacccactgcccagcaagacccctgtggcagagctcatgctgttctcataagacctttttaaccttattatatttttgctttttagcttcaggaaagctgccagaaaatcaggagtatttttgtttcaaatgaactacagcgcagtttaacgtatcaatgtagatgaacataagctcaaccagaaaccaacttccaatgacccgtttggcacctacaaggagcaggcccatctagcctgctgtgaccgctgcagaggcgcggccccaaggatgatcaatcccatggtgtcacaaccacatgtggcgtgactaccgacttactacatttcacctgagtgttgcagcccaaagcattgaaaacagctattaaactatctttaaaaatgtcttattaataaaggtattaaaaccagatagatgcttgaaataggagaaatctacctccatctaaaattatctattttagtcctaattcctagaaaagctgttgctgagccacacgcactagagtctggaggctggtcggccaccagcctgcaaacctcgagggcagacacagccccaggcagcttcagcacccccacgtttgcctcgctgccatggctcccttctgccgctggtaatttcagcttattttgaaggcacgtcgtagttttaaaaggaatattggacataaagtgatgcagagattcagaatcaaactcaaatcataatgcatggcaagatgacatcctcagtttagcacgcaaggcagcccctgctgtacaaggacattactgcacaaagcactcggattccccacaggatgccaaaaaattcacattttcctgtggagtggtccagccttctaaaagctcttcgcaccttgccttgctggactccgggcaccgtgaaacaactcaataaattgaaaaagacttcatgtttaacttaaaaaaaaaatgtaactcacataagcatggaaaaaaacaaacccacaggaacgcttcttacctctacggatccagctacctttgtcttgcaggcagctgagtcacttttgccctgtgaaaatggaaacgaagaaagaattcctttaagtcacaggacgtatttacagtcagcaacttcattagcaagggcattactaccatactcaccaggcctgtgagctttttgtttctaaacattaatctccacataattttaagtaattggaggagtttctttcgcgttcaggaagccctttagtgaaagcctacagaagaaaggaacttgcgacttttgtgcaacttttaaaatttagccaaaggaagtgatggtgtcccatcaccaacctcaaagctcaacggaaagaaagtctctttcaagctccatatgcacagcatttatcttccaagccacgcatcagtgacgagcaggcaaatgctttcaggtgactctaaactctagtctatggaagaggctcattccagctattttaatctgtagatttcatcttcatctgtaatacgctcgcatacacctagttaaaattccaatcgtgcttggtccagggcttaaacccggaagcgcgtgtgtctaggaggcctttcttcttcccaagcctctttttggccagcatggtttggaggtgacctgaagattttactcagcaacgtggttttaggactgctgagagcagagacaacggctacccttactgcggcacgttcagtgatgcaggggccacatttccatttcctactttctcctttagccttttcctgccacatttctcttctgttctctgttccttggctcatacccactgaaatataagagatgaaggaagaagccagaattcaaatgaaatctcctttgcccctactgatgactgcggttcaagtgtcagaagacagagcgttggaatcaccatctaaatgaaatgaggctaacaggagatgccagcggcctctgctgcctcacatggccctcggttgtcacgagtgagcacagctttggggctggcttctcccgagtgtgccatgaggaaaggggtccagcgattcttccctgagagaaacccctgcactgcgggtgcccattctcgcctcagcctacacctcctctgtcctccaacacagctgatgagcggccggtttatcgaggtgagaatcatagctctgtttgttttatgttcccaactggacggtaattaataactggcaagaatacagttgctaatgctgactttaccacttgtttttgccatttatgtacctgtttgtattgtactgggcatgtatggtgagcctatgtggggtttctacccagcagcccttctcccctcctggcaagcactccctttctttctatgggacactagttccatggagtccaggtgggaatgaccccaccccccagcccccccaccactgggagaaaggccctagcagggctccctcagagctgtcagcccccttgtcctgggatggccagcctggcagatgacctaagtctggggtttgtgcttgctctgccttggaaatgtgcctgcctgagaatggagtcgagcaaggaggaagagaaattcagtgtcctgccgacagcttcggacgctgggattcagacccaccagaaaccatctctttcaatggtgtgagccaacaaattgccaattttaagaaggtttgattctgtttctataacttgaaaaagatggtgagacccggtggaacataaatgacgcttttacagaaaaatacctaatagcatgaaaatcccaaatgtgccgcaatgttgtgccttcgcctatcacctcattccactccatgacctactctcagggcaaccagcttttcaaaggaagtgccccacagatggcgctactaagcccggctgtcgggacacacctgagactgtgcatccagggtatgcggtgcttggggtccctcataaaaagacacattactaaatttttcatattgtcttgtttagaatcactgactgtctttcccttctcacttcctggactctcttctttgcaaacaacattaagaatgttgttaactcccctgaattaaacaggggaatctggaatgacttggacattaaatgaggattctccagccactctgcagccacgctatccctcccacctccaccccttctcttcctccaaactggcccccacacccatcctctctacaccatggtcagcctgctgtgcgggctccacgtctgggtcaaccctgtgtgggcagagaacaggggcagcttccagctccagaaggaaatcccagctcctctactactcctttccgatccaggacacgagaggagaggactccccttacggatcccatctcctcccctgaagcatctgtgactgtgcaggttggagaaggaggcagggaagggggtgaggagagggggaagaggggtcacaggaaagcccagtgtgccctaatgaggggctttccatcacaggggagtcagagcccccacaggaaatcctgactcctgaagcaatccacttttcttttctttcttttcgtttttttttgttttgttttgttttgttgtttttgaggtggagtctcgctgtgtcacccagggtggagtacagtagtgcagtcttggctcactgcaacctctgccccccaggttccagtgattctcctgcctcagcctcgtgagtagctgggattacaggcgcccaccaccacacccagctaatttttgtgtttttagcggagacagggtttcaccattggccaggctggtctggaactcctgacctcaggtgatctgcctgctttggcctcccgaaacactgggattacaggcgtgagccactgcacctggctgcaatctgctactgtccccttcctcgtctgtccatcctgttacatacctgtgaccacattatcgtcaaaatacgtttaacatgaatttattatcatcatggctagctccaccaggaagaaaaaaaaactaccgttgagatgacataaaacgctttgtgcaaatgatcgtcctccaggggtattccgtgaagaggacacttgtcatatagccaagcatgcttgcagaaaataaatggacgtggtcagacaaatatttttgtgtgtttcattgatttgaaataaactatcagaaatttctaaacaaatactcgccaaccttttggaaaaaaatatggattgaatctttttttttaagtctagaaagtgacccagtgttgtgggagaaatgtgaaaggcaggcaccatcgctttcacggcacttggggtcatagtctggatgaccaagattcatttgatcctcaggggtcttttatgattggactgcaagtaaagctgccagccaaattttataacacaaaaggtgttccgtgtgctcacagcacccctgcttaccagatgacagaatgtcttgaagattgtgcacgttcctcaaaagacacatttagacagtcatggtcaggcagttgatagactcgatatcagctatgaatttctcagtgaaattagtgcatgggattctagaaaattggacactttcaagtggtgctgtggctggagtggtgcagccgtctttacccagcgagcgtcccggcgttggttattctgggtctttgagaatgctgtgactgtccctgctgctgctgcacccatcccagcaccacgtggctaagctctcccaagatgctacggaccatggtagggagctcagcctcccaagcagccagccagggtttatttcctggcaccagaacttaggcaagtcattggactcctcagccccaatttccctgtttgtacaattgaggaagacagtcccttacacaggggtggtgggagaaagaaatgagctggcccatattgggctcccagcagacagcagccatcagtgaacatcagcatgatgacgatgtggggaaaattaaggcgttcccagattacagcagcataaaggaccccaaaacatctcgcccttctttgagaacgctggcatgtgtgcttcttgtctgtgacctctgaggagtcggatccccaggtgcttcaatagctctgagctgtcctttattttggatgagccccgtcttccagcttttagggttgggagggcagaggagaaacggcaggtggcactgcggatatttttacacaggataatgtgacctgcccagcctgcacctgcgctcagcatcatcagagttccgtttcttatacttaattaggctacacaaccaattttacgattttaccattttgaaatcacgtgggagttaccaaaatggttaatttaaaacggttttacccagactttggggggcagtcttgattcttaaatggctttgatggctttgataaacaccctgggcccttcctccaaaaaatacacactcattgaaagccccccccacccccggccccttcgcactatgcacagccctcaggagctccacctttggttttgggggagtctctaagtgcccaaaagtttccctcgcaaatttgcacgtctaccactagatggcagcagaggacacagcaagtgagaacactccgaggcgcgtgcagccaatgaaatcctggaaacttgttacattttgttataacaaacaaaatataggccttggttttctttaatcttactgatgtgctcctggaagaagaaaaatgctaatttacacagggtccacgttgtaggaaggctgaatttggtttccatgacccccgactctccctccgctggtgctcagctctccccacacctgccagctttatttggatttctgtcagttctgaagtatcagctacctgaggctgcagcatcagccaagaaaccgtctctttcagacgcttgctggcttcagggctgcagcccggggatcttctctagataaagcgcggtggaaacacacacagacacatgacgatgctgtcgacccacatgcctgagctctgggattccacggctggagctcggaactgcgaaggggcagagactgagcgcaggcaaaggcgcacagagaggactacacaacacaaaggataatgtcctcgcgatggaggaaccactgtggacagtcaggaagacagacacgcgtggagggccagaactggaagtgagggcgggcattgctggctttatctgatcactgggaagggtggttgtgaaagccactgagggtgtgtgcctctccccagccacagcggtgctggagaggaggctggggcgctcaccactctttcctctaccatccggctctgggggccaggtccatgcaaaaatacgtggagaaagtacagcttagaggacttctacttccagcaagacgccaggcagaaatgacagagaatgatctcgctacacccactagaagtggtggataaaacacaacaaaaaaggaggttcaacgaaaagctgagttgtaagaaggaaggattaacccacaggctccagaaatgaggaggactggaagagagagaatggagtccccgcactgactttgagaccgtcctgggggcattttccgtttctgtaatcttccaggttagatttcttgtttttgtgttttaattttttttatatcgaggtgaatttcacacaacaaaattgatcgttttaacatgaatgatgaggtggcgtttagtgcattcacactgacgtgtcaccaggtaattcccaacatctgcctcttccacgcccatgaagcagttgctccccactctgccctcccagtccctggcaaccagcaatccgtgccgtctctgtgggttcacctgctctgggcatttggtatagacagaaccgcacagcgtggggtcttctgggtctggcttcttttgctctgcatgatgtgctcgaggttcgtccatgttgcagggtgtgtcaacgcttccttccctttagtggctacataacatgccattgtttgtttacaccacagtttgtgcgtccattcatccattgatggacatgtgggctgtctcttatcttttggcgactgtgagttgtgctgctataaacaagtgtgtgcgtatttttgtttcagtacctgttttcaacaatcttgggtacatacctaggagggggtcagccgcagcctttcatgtgcttctccgccatttgtagttctcttttggagaaatgtctacttaagcccatcacccattttttcattgggctggtggtctttttgttgttcaagcttgggttttaatatgctggagatacagggaaggaggatggggcggctgtgaggtgaagagctggacctgaggttgctgcgggaggcctgagcagggagcgcaaagcctggacgaaagccccgaccagctgagaagaggacgggagacatcgaacttgtcctgggctcaggttaacaatacatggattttacgtcttctctgataattaaaaatgccaggcctgtgccttccatgagtttgggtgtgaattcataatgacaagggtggctcagggtgaagtttaatgtgacagctggtctggtgccaggaacatgcctaagtcacaaacccagaactccgctgaagggaccacctgaaactgagccacggggaaagcacagagagaggaagtggcctccgagtgcacgcacagccaggagccccagaacccaggcagcgccactctgcacgatgggcagaggacacacaaaaaggcaaaaatggagccaagaattccagagaacagatgaacaatattcaggagtattaaagaagtattgttaaaagttataaaatcataaagaacatagtaaaagaaataaatgtaaacaagttggaaagaataaattaaaactgctacggttcacagatagtataaatctctacagaatccaagagaatctacagagaatttattaatttgaataagagggtatggaaaggttatggatggaaaagtaatattcaaaagcagttttggcaatacagcagaaaataattttaaatgatagcatttgcaattgtgagagagagagaaaagagaagaaaaaaccttataagctataaaagagacatctaaaaaaatgtgtaatgtctttacagaaaagatgagtaactttattgaaagatataaaagaagactaaagtaaatcttaatacagtaaatatagcaatttttccaaagtcaatctgtaaatttaatttaataaaatcataatccaaaaaggacgattttttctgaatttaaaacaaagtgattttgaaggctgaaggacagccaacaccattttaaagacacagaagcaaagacaagccctggcagggagatatcggtgcttacgttagccttagaagaactcagagggtgccacgggcgcagcagagcctggagacctgcctgcctctgtgtggggctcacgaaagggcaaagctgttagagaacagcagggtgagatggcctctgcaacgactggcgccggccaactgactgatcaacctcataccatatatatcaatacattcaagatgcgttaaaggccagaatgtgaaaaaaccaaaccacaatgttcaaaaggatatccaggagatgatatggttgttttaacttgagctactaaagaattctttaaacaactcagaacgccatacattgttttacaaattgttttttaggctgggcatggtggctcacacctgtaatctcagcactttcggaggccgagatgggtggatcacctgaggtcaggagttcaagaccagcctggccaacacggcgaaaccccgtctctactaaaaatataaaaattagacggttgtggtggcacgcgcctatagtcccagctactcgggaggctgaggcaggagaatctcttgaacccaggaggcagaggttgcagtgagccaagatcatgccattgcactccagcccgggtgacaagagtgaaactctatcaaaaaaacaacaagattaacccattaactcatgtgttaataagatgcgtccactcctgtcagagagtgagctcctggctcctacaaacagcaccgtaagcgccacgctgcgtctggtgagagttggagaagcaaaaactctggcccgttgctattgactacactgatgctctgatacacccagcattcagctgctttggagagcagtttgtcgatagcagattaacttgaaaatgcgcaaatcttgtggcctgccgatttcacattgacgtgtctagacagggagtgtaactctggcgcacactgatggggagacaggtgcgagctttctcactggcactgcttcaaagatcaaaacattgaacgtaatctaacggttccttggtgggagagtggaaaagtaaactatggcatttttcctaccgtgatgttctctacggccctcaggatggtgcaacagagctctgtcatcagcaggggtcaatcccaaaatatcctaaggagttgtttttaaagtaagcttcaaaagcaaagagactgccttccgtccagtaaagatttaaagcacacctgtaatttatagatgctgagtctcatggactgaattgtatcctcaaaattcctgtgttgaagcccggcccgcacatgtggagggtgtgagtctggaaatgctcagggacccccgggcttcacaagatgactgagacattggaggaggggcctgggagcctgtgcttgtgaccccaacccttggctggtggaataggggagagcccagggctaagggagagaaagaaccagtaacccatgtgccggagccgctccggggcctcagtctagtcaggatccagatcacacagccgtgatcgcccacatcccgtccacagagcacttgctctgtgtccttaggtgagcggccagggtgtttcctttccatgagcagattcggctcaactcatcctcctctcaccccagactctcaccaggcagaagaggaactggatggctgactgcagaagggacccatgaagtgagggcggccaagagaaataacggcaaggctggggctagcgttgccgacggctgctggaaaaggactcaccaagtccctcagctcgctagagacaaccaatgctctcagtggcaaacactggggtggcagactgggaaggagatagtttttttgaactcatcccaaggataccaccatattttaaaaagtgccaagatgacagtgctcccccttttctatgggagatagggaaaggcctcctctgcttttcttcatggtgggaggccttgctaatttctcaggcaaggggatggctcaaagcaggagaagtgttccttggcaagcaatgagtagcgtcactgtgaccaatagcagcatagttctgggctgcatcgcgtaccccaaaatccatgccttgaagtccagccccagtgcctgggaatgtgtcctgatttgggaaagggccattgcagctgggcttagctgagaggcagtcacctcggagtatgtgggcctagtccaatatgatggtgtcctcagaggcacagaaacaggtgcatgggggacaatggccacctggccatggggagagagatgggggaaggaccaccagcaaccatgaagccagagagaggcccgagcacagcctccctcacagccccagcgggagccaggcctgcggcacctggacctggggcttctggcctcgggactgtgagacgaccaacctctattgtttaagtcgcccagtctcggtgccttgttacggcagctctggcaaatgcgtataccacagaagccagaggttcccttcatgggcccacccagaggagctggagaaccaggagaaaacatcattcagtgtttaaccaaggggaggggtcagacttgaaatatgagccaatcccagatgtcgaaggtctcctggtggtcttttatgggcatttaatatgctatttatagttttcatctgcacctgtagaaaatacataattgtctcaaactaagactcagggcaaaaaagtgtgtctgcaacattgcaagtcagcctggttggattacacagatgtggacaagaccttttaaaaaatatcttgtaacaccccaggctgagcaaccaacactccccagtggactaatgcagagccacgctgcaatcaagttcatcacaatcatgactactccgatattcggacacttcgctagcagaaagagactattttactgactcctactagaagctccagttcctctcccagcctttaaggactagaaatctctctaaagaaacagtattgctgggttgtaaataagacatcactcctctaacagaaatacaaaacatgatggaccttttttctctgcttaaatttatgaaggtcatagctttagaaagaccaatcaacacatcaggttcttattaagtgtatttaagacgaaggtaggtcattatcaactattttcacaaaggaactaggaaccgcatttcactcttaattatacataagttgactgtgcattttggggattgttcaagatgacttcttaacgtcagtggcttctccctgtcacttggacgctgtcctcacaccccctggcgtgctcccagggaagactagccaacttgaccccctgctgaagcaacacaattggggtcacagctcccagcagaggcaggacttcgctctctttgggtgagaggcacctggaggggctgccacagaactacatgcacccacccaagtcaggcaggttcacctggtggggctgacccaggactgcatgcatgcacctaagttgggcagatgtacctggaggggctgctcatgtcccgtatgcactcaccccggtcaggcaggtgcttggtaaacaggcccagctgcaaatgacagaggaggccaagcaaactgggaaccttcctgaggacagatgatggagctaggagacggcatctctgagatgcagcagagacttgcaccaggagccaggagccaggcagatggagaagcaggcatggtttagagtccagaaggcaaagcttctccctcagagccgactatgggcagagtgtcccaaccaccagtgtcgacattctgagtggatgactctgtcgtggggcctgtcctgtgcatgctaggatgttcagcagtatatctggccttgacccactagtggccagtagcatgtcccccctggacagcccaagttatgacaaccaaaaatgtctctagaggccgggcatggtgactcacacctgtaatcccagcactttgggaggccaaggttggcggatcatcttgaggtcaggagtttgagaccagcctggctaacatggtgaaaccctgtttctactaaaaatacaaaaaattagccaggtgtagtggtgagcgcctgtaacccccgctactcaggagactgaggcacgagaattgcttgagcctgggaggaggaggttgcagtgagctgagattgctccactacactccagcctgagcaacagagcaagactgtctcaaaaaacaacaaccacaacaaaatgtctctagacgttgccaaatgatgtccctgagttgggtgatgcaaaattacccctggttcagaagcaattgagtctttagaagcacaagtccagcctatctggggtcccggcaggttttgaagatggagactcgggtataggaggagacacacccatgcaccagactcttaaacaaagtcctagctgtgctctcaggaccgatcagaagccagcactgaagcagcagcacgaggttagagccaccagaaggaagcgtgactcgatcccgaggcccggattgctgagttgggcctcctcaagtcctcccttggcaccagcagaattactcaaaagcctgtgtctgcatcttagaggcagatggctacagcctgctctgggagggagcggatggccaggagagagccggggccctacctgacgtcagaactgtcctcccagccccagctcagcccggatgcaacagaagccagaagtgcacccaaggtgcaggcaagcagggattgttcagcacaaatgcactcgtcagttctaacttattcttaagctgactcagcagagtgcttcttcctctgctctgggtgatcatggaggccaccccaggcttgtctaatctctctcagccaatcacaggcctctggccccaggatagctaatttgtgtccacttggctgtgctgtggtgcccagttgtttggtcaaacaccagtctaaacttgctgcagggtatcttttaggtattattattattattattattattattattattattattattattattattgtttttgagacagggcctctctgtgtcacccaggctggagtgcagtggaggcttcacagctcactgcagcctcgacctcctggaatcaagcaatcctcccgcctcagccttccaggagctggaactacaagcaggagccacgtgattaacattgaaatcagcagatttgagtaaagtagattaccttcgtaatgtgagtgggcctcgtcgaatcagttgaaggccttaagggaaaagactgagctaccctgaagaggaaggaactctgtcttcagacagccttgagactagaacatctactcccactagaattcccagcctgctggtctgccctgtgaacttgtgacttgcctgccagccccacaattgtgtgagccaattccttaacaaaagcaaattgctgtctctctctagatagacagatatagatacaaatgacatagatatatgcatacatacatatctaaaatttcatatatacacatgcacacatatctaaaactacatatatatgtacacatatctataactgcatatatacatgtgcacacctatgcatagctatgtatacacatgtgcacacctatctgtaactacatatatatgtgaacacttatttgtaatcacatacacgcgtggacacctatctaaaaccacatatacacatgtgcacatctatctataactacatatatacacgtgcacagttacctgtaaccacatatgcacacgtgcacacctatctataccacatatgcacacgtgcacacctacgcatcaccacatatgcacacgtgcacacctacgcatcaccacatatgcacacgtgcacacctacgcatcaccacatatgcacacgtgcacacctacgcatcaccacatatgcacacgtgcacacctacgcatcaccacatatgcacacgtgcacacctacgcatcaccacatatgcacacgtgcacacctacgcatcaccacatatgcacacgtgcacacctacgcatcaccacatatgcacacgtgcacacctacgcatcaccacatatgcacacgtgcacacctacgcatcaccacatatgcacacgtgcacacctacgcataaccacatatgcacacgtgcacacctacgcataaccacatatgcacacgtgcacacctacgcataaccacatatgcacacgtgcacacctacgcataaccacatatgcacacgtgcacacctacgcataaccacatatgcacacgtgcacacctatctataccacatatgcacacgtgcacacctatgcataaccacatatgcacacgtgcacacctatgcagaaccacatatgcacacgtgcacacctatgcagaaccacatatgcacacgtgcacacctatgcagaaccacatatgcacacgtgcacacctatgcagaaccacatatgcacacgtgcacacctatgcagaaccacatatgcacacgtgcacacctatgcagaaccacatatgcacacgtgcacacctatgcagaaccacatatacacacgtgcacacctatgcagaaccacatatacacatgtgcacacctatctataccacatatatacacgtgcacacctatgcataaccacatatgcacacgtgcacacctatctataaccacatatatacctatgtatgcatgtctatacatgagaccagagaagtcccgcagtggtctccatgtctcatccaggacagaggaagcattctaccgagtaaatttatgaataagtttggcttgatgagtgcatttgtgatgaataatccctgtttgcctcactttgcatgtgcttcctggcttctgttgtacacgggctgagctggggctgggaggatggttctgatgtcaggaaaatccccagcttgccctggctgtcaggtccttcttagagcaggttgtagctattggtcactctctgtatacacgtgtctgtatatgtgtaaatctttctgtgtttgcgtctacctatctgtctgcatctttttagatctgtttctttggagagcactgactagtacaatcccatttgcttgtaaaggcagtctcattctgaaataagacaatcttccgaattcttgatgtaagcctctgcctgtctgggacattccccggaaagcaggggagggacttggcgcttcttctcttcacccctcatgtgccaccccccactaggctgccaaggcaggtcacccagttctgccggcctcagtctcctccctaggtcgctggctccaggtttgaaaagatgtgtatagggcagggattattggctctttcagtttatgggagctgttgctcctttcttctacttacttgagggtttattattttttaagtaattactttccatagacaatggaccagaaaacacctgaaagatagcgactaagttcaaggttgctccacgccaggcatggtgctcctggttcgagagctccactcacgtggtccttacgagaatctgagcaacatgaacaccgtttttcagctgttgaacctaagactgaacaaggttaaataatttatccaaagtcacaagctagtagttgcagagccagcatttgaagtcagacttagctgagtccaagcccgtattcttaagcaccacaatttgcttccaggcatcttgtttctataaagcactcaatgattttactacaacgatcttatttatatgagacttaagtcattcaaatatgtttttaggacatgttagtataaagacaaggtattgccaaaaagattttttacctttcttcctttttgttctagaaggtcaataatgaaatctaacaaaataataataaaaatagcagataataatcaattaaataacatttggttttattttctttttaaaaatctaagaaaaaaggggttctgacaaatgtgaccagaaaaccatacaattcagatatcctttttcaacaatcatttatgggtgtttcttgttatttgagaaaattgagttaggaacagtgactcctccaatccacttacagtatggaaagctgatatcacagtacattttaagtccttctgtggtgaacagtctccttttattttgctaatcatcatggagcagaactaaatatgaacacaggagtggcagcctggctcagccagcccagaaaaatgtctttaaaaatgaacttgtctaataaaccttaattccaaatacagaacataaggaaggagaatttacaaatcatggtattagcagtaagaaaagcaaaccagttaaaaggagttaatagagaataatgattgttaatatggccatgaaaatgggagaaaatggtgacaaaactgattatcaaagtagaaaaggtaacaaaataattcatgaatgatatcacggatgcaaaaaaaaaaattctgattgcatcaacaaagatttgtagacggttgggagtagtatggaaggaagaatgtaaaagtattcttttttgtaatttacttcaaacattgctaggttaatagatattgccattttatagtagtataaacaaaaatgctacaattatacttttaaaagatgcataccttccacatcacaggaggaaaaaaatgcttaaaaaaatcatcatagcaaaagtgaagaaaactgaattatgtcatgataaatttttagtaattgtgtaatttagtgctcaaaaatagtttagttcaggtgttttatgcttaattttggttactttcatcagtagagtaatatatataattccagttccacatttttgatcctcatgaccactagagggcagaagagaaaagtacaagaggcccgagataggtcaaatgagcctgatgccattttgcaatgtgggttttaaatggccttcccaaccaggaattctgattcgtggtagacacagctatgtcggtgtgccaatatgtgtatagaaaactcaatccagaatttaaatatttttcctaaattaggccttaaaatattattttgcataaaataagatgtaaaataagcatgtttatataaaaatattcaaattatttgacccaataacttctaggagtttatccaaagataaagactgatgtatgtggatgtttatcatagtgttttttttatcatgatgtataattgaaaatttacctaagtaatcaacaataggggattgtactaataaattatggtacagctatatgatggaaaactctagctgcttttaaaaatatttaagtgttttggggaaaagttatgaaatgttaagagaatattataaaaagtatgatttgatatttatgaattatataaactgtgttgatttaaatatagaaacatatctagatactgatgataaaaatataagtctggctgtgggagtacagatatagaagtagaaatgttccaaaaaaaaaggtcacagttgaaaaaaatataccccctgttaaaagttactgtctcttctttattacatttaaatttattttaagcatttatacccttcactgggaaaactgactagccataagcagaaaactgaaactggaccccttccttacaccttatatgaaaattaactcaagatggagtaaagacttagatgtaaaacccaaagccataaaaactctagaagaaaacctaggcaacaccattcaggacatgggcatgcgcaaaaacttcatgactaaaacaccaaaagcaatggcaacaaaagccaaaattgacaaatgggatctaatcaaactaaagagcttctgcgcagcaaaagaaactagcatcagactgaacaggcaacctaaggaatgggagaacatatttgcaatctactcatctgacaaagggctaatatccagaatctacaaagaagttaaacaaatttacaaaaaaaaaaaaaaaaaaccaacccatcaaaaagtcggcaaaggatatgaaccgacacttctcaaaaaaagacatttatgcagccaacagacatatgaaaaaaagctcatcatcactgatcattaggtattatgattaggcaaatcaaaaccacaatgagataccatctcacactagtcagaatggcaatcattaaaaagtcaggaaaaaatagatgctggtgaggctgtggagaaatgggaatgcttttatgctgttggtgggagtgtaactcggttcaaccattgtggaggacagtgtggcgattcctcaaggatctagaacaagaaatatcatttgacccagcaatcccattactgggtatagacccaaaggattataaatcattttactataaagacacatgcacacctatgtttattgcagcactatttacaatagcaaagacatggaaccaacccaaatgcccatcaatgatagactggataaagaaaatgtggtacatatacaccatggaatactatgcagctataaaaaagaatgagatcatgttctttgcagggacatggatgaagctggaagccatcatcctcaacaaactaacacagaaacagaaaaccaaatactgcatgttctcattcataagtgggagctgaacaatgagaccacttggactcagggaggggaacatcacacaccggggcctgtccggggtgaggggcaaggggagggagagcatcaggacaaatacctaatgcatgtggggcttaaaacctagatgacaggttgataggtacagcaaatcatcatgacacatgtatgtatatgtaccaaacctgcacattctgcacatgtatcctggaacttaaagtaaaataaaaaataaaaataaaataggtgggtggagccaagatggctgaataggaacagctccagtctacagctcccagggtgagtgacgcagaagacaggtgatttctgcatttccatctgaggtaccaggttcatctcactagggagtgccagacagcgggcacaggacagcgggtgcagcataccgtgcgcgagctgaagcagggcgaggcattacctcactcgggaagtgcaaggggtcagggagttccctttcctagtcaaagaaaggggtgacacacggcacctggaaaatcgggtcactcccaccctaatactgcacttttcccacggccttaaaaaacagcgcaccaggagattatatcccacacctggctcggagggtcctacgcccacggagtctcgctgattgctagcacagcagtctaagatcaaactgcaaggctgcatcgaggctgggggaggggcgcccgccattgcccaggtttgattaggtaaacaaagcagctgggaagctcgaactgggtggagtccaccacagctcaaggaggccggcctgcctgcctctgtaggctccgcctctgggggcagggcacagacaaacaaaaagacagcagtaacctctgcagacttaaatgtccctgtctgacagctttgaagagagtagtggttctcccagcatgcagctggagatctgagaacaggcagactgcctcctcaagtgggtccctgacccccgagcagcttaactgggagacaccccccagtaggggcagactgacacctcacacggccgggtactcctctgagacaaaacttccagaggaacgatcaggcagcagcatttgtgggtcaccaatatccgctgttctgcagccaccactcctgatacccaggcaaacagggtctggagtggacctctagcaaagtccaacagaccttcaactgagggtcctgtctgttagaaggaaaactaacaaacagaaaggacatccacaccaaaaacccatctgtacatcaccatcatcaaagaccaaaagtagataaaaccacaaagatggggaaaaaacagagcagaaaactggaaactctaaaaagcagagcgcctctcctcctccaaaggaatgcagctcctcaccagcaatggaacaaagctggacggagaatgactttgacgagttgagagaagaaggctttggacgatcaaactactctgagctacagaaggaaattcacaccaatggcaaagaagttaaaaactttgaaaaaaaaattagacgaatggataactagaataaccaatgcagagaagtccttaaaggagctgatggagctgaaagtcaagggtcgagaattacgtgaagaatgcagaagcctcaggagccgatgcgatcaactggaagaaagggtatctgtgatggaagacgaaatgaatgaaatgaagtgagaaaggaagtttagagaaaaaagtataaaaagaaatgaacaaagcttccaagaaatatgggactacgtgaaaagaccaaatctacatcagataggtgtacctgaaagtgatggggagaatggaaccaagttggaaaacactctgcaggatattatccaggagaacttccccaatctagcaaggcaggccaacattcagattcaggaaatacagagaatgccacaaagatactcctcgagaagagcaactccaagacacataattgtcagattcaccaaagttgaaatgaaggaaaaaatgttaagggcagccagagagaaagctcgggttacccacaaagggaagcccatcatactaacagcggatctctcggcagaaactctacaagccagaggagagtgggggccaatattcaacattcttaaagaaaagaattttcaatgcagaatttcatgtccagccaaactaagcttcataagtgaaagagaaataaaatcctttacagacaaacaaatgctgagagattttgtcaccaccaggcctgccctaaaagagctcctgaaggaagcactaaacatggaaaggaacaaccggtaccagccactgcaaaaacatgccaaaatgtaaagaccatcaaggctaggaagaaactacatcaactaacgagcaaaataaccagctaacatcataatgacaggaccaaattcacacataacaatattaactttaaatgtaaatgggctaaatgctccaattaaaagacacagactggcaaattcgataaagagtcaagacccatcagtgtgctgtattcaggagaaccatctcatgtgcagagacacacataggctcaaaataaagggatggaggaagatctaccaagcaaatggaaaacaaaaaaaaagcaagggtcgcaatcctagtctctgataaaacagactttaaaccagcaaagatcaaaagagacaatgaaggccattacataatggtaaagggatcaattcaacaagaagagctaactatcctaaatatatatgcacccaatacaggagcacccagattcataaagcaagtcctgagtgacctacaaagagacttagactcccacacaataataatgggagactttaacaccccactgttaacattagacaagtcaacgagacagaaatttaacaaggatatccaggaattgaactcagctctgcaccaagcggacctaatagacatctacagaactctccaccccaaatcaacagaatgtacattcttctcagcaccacatcacacttattccaaaattgaccacatagttggaagtaaagcactcctcagcaaatgtaaaagaacagaaattacaacaaactgtctctcagaccacagtgcaatcaaactagaactcaggattaaaaaactcactcaaaaccactcaactacatggaaattgaacaacgtgctcttgaatgaccactgggtacataacgaaatgaaggcagaaataaagatgttctctgaaaccaacgagaacaaagacacaacataccagaatctctgggacacattcaaagcagtgtgtagagggaaatttatagtactaaatgcccacaagagaaagcaagaaagatctaaaattgacaccctaacatcacaattaaagaactagagaagcaagagcaaacacattcaaaagctagcagaaggcaagaaataactaagatcagaacagaactgaaggagatcgagacacaaaaaaaaaactcttcaaaaaatcaatgaatctgggagctggtttcttgaaaagatcaacaaaattcattgaccactagcaagactaataaagaagaaaagagatgcaataaaaagtgataaaggcgatatcatcaccaatcccacagaaatacaaactaccatcagagaatattataaacacctctacgcaaataaactagaaaatctagaagaaatggataaattcctggacacatacaccgacccaagactaaaccaggaagaagttgagtccctgaatagaccaataacaggctctgaaattgaggcaataattaatagcctaccaaccaaaaaaagtccaggaccagatggattcacagccgaattctaccagaggtacaaagaggagctcgtatcattccttctgaaactattccaatgaatagaaaaagagggaatcctccctaactcattttatgaggccagcatcatagtgataccaaagcctggcagagacacaacaaaaaaagagaattttagaccaatatccctgatgaacatcgatgcaaaaatcctcaataaaatactggcaaaccaaatccagcagcacatcaaaactcttatccatcatgatcaagttggcttcatccctaggatgcaaggctggttcaatatatgcaaatcaataaacataatccatcatataaacagaaccaatgacaaaaaccacatgattatctcaatagatgcagaaaaggcctttgacaaaattaaacagcccttcatgctaaaaactctcaataaactaggtattgatgggctgtatctcaaaataataaaagctatttgtgacacacccacagccaatatcatactgaatgggcaaaaactggaagcattccctttgaaaactggcacaagacagggatgacctctctcaccactcctagtcaacatagtgttggaagttctggccagggcaattaggcaggagaaggaaataaagggtattcaattaggaaaagaggaagtcaaattgtccctgtttgcagatgacatgattgtatatctagaaaaccccactgtctcagcccaaaatctccttaagctgataaccaacttcagcagtctcaggatacaaaatcaatgtacaaaaatcacaagcagtcttatacaccaataacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggatacaaacaaatggaagaacattccatgctcatgggtaggaagaatcaatatcgtgaaaatggccatactgcccaaggtgatttatagattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcacgttacctgacttcaaactatactacaaggctacagtaaccaaaacagcatggtactggtaccaaaacagagatacagaacaatggaacagaacagagccctcagaaatagtgccacatatctacaaccatctgatctttaacaaacctgacaaaaacaagaaatggggaaaggattccctatttaataaatgctgctgggaaaactggctagccatatgtagaaagctgaaactggatcccttccttacaccttacacaaaaattaattcaagacggattaaagacttaaatgctacacctaaaaccataaaaaccctagaagaaaacctaggcaataccattcaggacataggcatgggcaaggacttcatgtccaaaacaccaaaagcaatggcaacaaaagacaaaattgacaaatgggatctaattaaactaaagagcttctgcacagcaaaagaaactaccatcagagtgaacaagcaacctacaaaatgggagaaaatttttgcaacctactcatctgacaaagggctaatatccagaatctacaatgaactcaaacaaatttacaagaaaaaaacaaacaaccccatcaaaaagtgggtgaaggatatgaacagacacttctcaaaagaagacatttatgcagccaaaaaacacatgaaaaaatgctcatcatcactggccatcagagaaatgcaaatcaaaaccacaatgagataccatctcataccagttagaatggcgatcattaaaaagtgaggaaacaacaggtgctggagaggatgtggagaaataggaacacttttgcactgttggtgagactgtaaactagttcaaccattgtggaagtcagtgtggcgattcctcagggatctagaactaggaataccgtttgacctagccatcccattactgggtatatacccaaaggattataaatcatgctgctataaagacacatgcacatgtatgtttattgtggcactattcacaatagcaaagacttggaaccaacccaaatgtccaacaacgatagactggattaagaaaatgtggcacatatacaccatggaatactatgtagccataaaaaatgatgagttcatgtcctttgtagggacatggatgaagctggaaaccatcattctcagcaaactattgcaagagcaaaaaaccaaacaccacatgttgtcactcataggtaggaattgaacaatgagaacacatggacacaggaaggggaacatcacactccggggactgttgtggggtggggggagggatagcattaggagatatacctaatgctaaatgatgagttaatgggtgcagcaacaccaacatggcacatgtatacatatgtaacaaacctgcacattgtgcacatgtaccctaaaacttaaagtataataacaataaaataaaaataaataaataaaaaataaaaataaaataaaaattcatccattctaaaagaaatgtttatacttttgtatatttttctcattttctacattgtaatatactgtattccttttaaattcagggaaaaaagaaatacacattatgtggtattaataaagcaaaacctggaccctctttggtctttcagtgtcttaaaatcataaagccagacccatttgtgatatatggaggctgatagttgaaaagaatgtacaaatctcaactgtatttcattttgctgttctattaaagctatcttatcattataatagaaaaaagaaaaacacagtctttaaattaaaggaacagaacacatacaaacacaactgctttcactcaaaaaactgacaagacactgaaactggtcccagtggtcaggtgaacattgaccatgtggcattaaagagccagtgcccagcaagagtgactttcttcttgaacctgacagccgatcgcagctctgcatcagacaaaaccagatccttcattctctaagctcttctgaatttttcaggatttcactttccttgtaaagggcaggtaatcatcgtggttggaggttgtcaggggtcccctgcaccaagctaagtaatgaggactgcggggtgagaaagacggactctccctgaagggtcccagtgatcacagctgggctccaggctgtgggctgctgccccagcaggctcaggtgcagtgtgtgggcaccgtggtgggatgctcggaccacaggaatcaggaataattttccataaaaggtgggacttgagcctggactgcagatgggagcagaaaggtgtccctggcagagaaaggagaacaggaagcatccaggcagtgggctgagttgtgtcctctggaccaatagtcaaggataagggaatggcttctagatgctgtggggacccacttggaaccccaggcactataaagattattttaatctgaagacatttgagactcaacagatacagaaagaagccttctcagagcttttcttatctgaccagcaacttctcagagcttttcttatctgatggaaaacagcaactttcaagaaatgaggactgctattaattccctcctcggggagacttctattcctagcggggagactaaaagtaagcctacgataaatccccactctgagggagttgtagagccctgaaaaagacaaaaagaccactcatgtccatatggacaaacattatcacaaactttcttatctctcatatggccccctaaaaatctggcttgtcggctgggtgcgatggctcacacctgtaatcccagcactttgggaggccgaggcgggcggatcacgaggtcaagagatagagaccatcctggccaacatgataaaaccctgtctctattaaaaacacaaaaattagctgggtgtggtggcacgcacctgtaatcccagctatttgggaggctgaggcaggagaatggcttgaacctgggaggtggaggttgcagtgagcagcgatggtgccactgcactccagtctggcaacagagactctgtcttaaaaagaaaaacaacaacaacaacaaactcatttgtctttcctgaagaaatctattgctcttcccattggagcctctctcctctccctttccctgctaagttggttctacagacccatattcaaaccactcctttcagttgctcaaaactacgcagtcctgagtgcgactgcacagtcctgagtgcacgcacgtggcacactcacacgagtcactcacaactgcacagtcctgagtgcacgcacgtggcacagtcacacgagtcactcgcaactgcacagtcctgagtgcacccatgtggcacacttacacaactcttttctcccgctaatctggcttttgtccatttaacttggaggctcccaggtaccgaacctgagaaggcaaagcttttcctctctacactgcgtttcattctccagggcatttgagagcagttcatgaagagtggctctcacgcccgagcaaagcagtcacagcactggcttgtcggtctgagcacagctgaggatgatgtggagacaatccctgggttggaaaaactccgtttctccaatcccaggctctgctgccgcatctctgtgtctccttcatcaggcactctgcgtcccagggagggaggcaccccacatccgtgctggggacattgtgcaggatggcaggggcaaggcacacctcacaaaagagatggatgccactgaaggagatgaaattatttccagaaatgttttttttttttagaatcagtggcatgacatatagttgatccttgaacagtgcaagagttagggacacccagctccctgcagagtcaaaaatccatgtctatctctggacccccaaagcttaactactaacagcctactgtggactggaagccttactgataacataaacagcctattcacacatatgtcatatgtatcatatactgtattctcacaatagggtaactagagaaaagaaaatgatattaagaaagttataaggaagagaagatgtatgtaccatccattaagtggaaatggatcctcatacaggtcttcatccttgttgtccaggcagggggtgctgacgagagggaggaggaaggctttgtgttgctgtctcggggtggcagaggtgggagaaaatctgcatataatcggacacgtgcagttcaaacctgtgttgttcaaggttcaatggcaattagtttttattagaaaaaatatatcaatgtggagaagcccttgaaggaatttaagcacagaggtgattgataggtgtaaccgccgggtccagacaggccagaacttgaactcaagttgtgctggtcaagggaggtaaaagaatcaaaccttgatgaccagaagacactggagtaaaaggcaagagtgaaaaaaaccttgatttgttacacggtgaaaagcagcagaagaaaaatggcacccgaatcatcgatgtcactaccgttggttggtcaggtaggccatgagaaccaaccagagatcaaacagagcaaaatcgaatatgcgataatttgttcatttccattccaccattcgccctcagtgtttatcccatggtaattaaaaccaactgtagctattgaacaatggaatttgctggtcaagctcttcagagcccaatgtcatcagccttggggtggcccctgcaagtccttgctgtgtccattctgttctcactgaatgcagaaggtgcagcccagctcagggatgagttacagctggcctcaaaagtgccaatgccacggcctaagcatctgggacagacactgaggaatgtttgatgagcccttaactaccaaaggtggacaactctgctattgatattaatatttagcacccaaaaggagcatcctggtgctgaaagagggcattagggagcttccccagggagccccaaacagcgtctctgcagatctgagcgctccctgttccggctgcaggaggctgtgttcagcctgctgggtgctggccctgcagctggggagcggccctctccaccacagtggtcttcagactggggtcagtgtacatgcaaagaccatctatggggcacatggcataagtatttttaaagtaattacttatcatttccagctcgtcagctctttcccaaaagtgatctgtctaggaacttctctggccaatccctttcccagacccctttacaatctcctgcccccttctccacagacaggtgcatcttggacctcgcacccatcccaaacccctctccagggtgtgttcctggtggtggcgccctccctagagcacagcaccagagagagcgcccctgtgaatatcagcagccaattgtacccagtgactaaggaaaccagccttcagcaaatgcggcagtttcctattctttgctttccacaaaattgaaagagagcccctattcaagttgtcagctgagagagctttaaaaacaatcttgtataacaagcacaacgtgctttttggcatacaacttgaaaggagctcaaaaaccagtgacatagcaaatctttttccatttccatctttcattcccatttatgtgaacaagtttgctttagctcataaaaatgaaactagagaaaatctcagtgccgagcctgttttaggagcaccccaagggtctgtgaacccgggcaggggcccatccccagcatcgctgatattgaatttctgagattttaattttataagagtcaattttttaaaaactatttaaattttaatcaattgtatactactaataattataaggataattcaaagaaacaacatttagagtctgtggttacagaaaattacatttaaaaaatacattcaatttatatacagattttttactgtaagaatgtaaaggtgatgaataaagacttttaagccaaaaagtatacctatcacactggcataatatcctaaaggagtagttagaatggaaatttgagcttatagagaaaaaggagtcacaaaaaaaattgcatgctcagaaggaaagcattttcatgttttttttttttttaaaaggatgagagtggtgtgaaatcactacggtaattggattccagcggaaacacttaagagttgtgcgagagttttattttggaatatcaatgttttgaaaggccagaagatatacctttttcaactaataaaccttacttttagctgagtatttttttttattttaatagttttgggggaacaggcggtgtttggttccatggataagttcttcagtggtgatttctgcgatctgggtgcccctgtctccggagtagtgtacacagcagctgatgtgtagtccttcatccctcaccctctcccacccttctgccaagtccccagtaacaggtcatggctgcgatctctcaggagatgcgctaagcacaggccccaggcctgcctggtggggatttgctcagaagcttttcgtggagaccgtgggttccttttaaacaccaggtattttttttgtttctggcagtctccagcctaatacactcatttgaatcctggaaaatagatcactctgtttcaattaggccaactcctcaggagttctagaaaaatattttaagccagtgactcattgaagtcccagatgacagtaccctctggggcaattaggccaacgtaccaggaggccggcaaagaggcttccagtggctctgacacgttgccactgtgtctgccctcagcccctagagcacggggaggacatgggggagcagcccagctcccggacagttctgcggcacagtctagggctctgcattctggcctcctgccacatccagggcgctgaatgccatggtgtgtgtccttccacagcgcatacactggaacacaaacgtcagcatgacagcattaagaagtgactaagtcatgagggccccatccttatgaatgggactagtggaccttacaaaaggcccttccacctcctgtcatgtgaggacacagcacttagcccctctggaggacgcagcaacagggttctgtcttggaagcagaaatgggtcctcaccagacaccgaacctacagtgcctcgatcttggacttccggcctccagaactgtgagaaagaaatttctgttatttgtaagtcacctggtctagggtattttgttacagcaacctgaacaaagacagttggccttcctttacctgagatcattttaaacaccattatcctcaactcaatcgtttccttaactcaaggaagatacctgatttcatggcaggcactggaaatatatgcctttggttttccctgtaattgcaaagaaaatttatatgtaaaataactgaaacaggactcctcatttcagcatttaaagcaaaaatctttaaagttaataaaacttctactctacaataagaattgtataaatgccaaagttttggatgtaacagaaatgagagtgatactgagaaattctctaggcggtcatggaaataagaagacaaagaaaaaaatttaaaccatggtatgtgcacttttgtaaatggttttgctgcaagtgcagtgaggagttttgtggtgatttaattgtgtctacttttataaaaatttaaagcattcaaaagaatctgatatgctaaactcgtgaaaagtttaattgataaagcttgcaatcaaaacataaaacataaagatagtatccagggagaaaagaaacacagctaagtaaaagcggaggaggtggggagaggaaaagaatctaaaggaaagggaggtttattttattttattttattttatttattttgagatgaggactcgatctggtacccaggctggaatggagcagtgcaatcatagctcactgcagcctccaactcataggctaaagtgatcatcctgcttcagcttcccaaatagctgggactacaggtgcatgccaccatgcccagctaattaaaaaaataatgtttcgtgaagataaagccttgctgtgttgcccaggctggtctccaactcctggccccaaatgttcctcctgcctcagcctcccaaagtgcagggattacaggcataagccaccacacacctggcttgatgtttaatgagtctaattttattcattttgctatattcaagttttaaaagttaaaaatattttacctttatttaaaatgttctgcataaatatattcatgcacataattttcaaacaatgagtatatttgactgcaaaacttcatattttgagaaatcaaatgagttaaatttgtaagttctttgccttttagttgtgtgaatggtttataattgactagagaaaaacaattgagaaggaaagtctttaacagtgtttaagataatgtaaattcaaaaatctgagaggaaaattaaaaaaaaaaaatttttaaatccctccctaggccgggcgtggtggctcacacctgtaatcccagcactttgggaggctgaggcaggcggatcatgaggtcaggagatcgagaccatcctggctaacacggtgaaaccccatctctactaaaaatacacacacacacacaaacaaattagccaggcgtggtggtgggcgcctgtagtcccagctactcaggaggctgaggcaggagaatggcatgaacctgggaggtggagattgcagtgagctgacatcacgccactgcactccagcctgggcaacagagtgagactccgtctcaaaataaaaaaaaaaaaaatcaatccctccctagacattaggaaagagtaaagaaggaaattacttttagttcatcgtagtggccctttatttttacttattcattcaaggaaaaaaactctagaaaaatagactacacaaaacataagatttaaaaataagaccagatctcggattttggaaggtcttatgtgctcagaatgagttaaaattcagacaaaaagagatagaagctctcacataacagtgaggctgcctttgctgcacgaccgtctgccagacactaacgggaatgttttctgggctgactcatttggtctttagaggggaagactctctgaagagcatccctctgaggggactgtgatgggctcccccagtttgcagctggagaaactgagacatgaaaaccagttgatctgtccaggtgcactcaggtggccatgactcagccaattcctcggacgaaactacatcagaataaagtttagccagtggttgaacgcttgtcactcattaagaaatagagaaaattagacaagccatcttactaataaagacaaaagaatttacttgaatgtaaccataatgttaaattaaatgtttaaatgataatcttcatgaacaagtgataaaccatagattatatataatgtatgtatatgtgtgtgtgtgtatatatatatatatatataaaatgattaaatgagaccaattagactaatttttaaagtttacattgtattcttttaaccaataatccttaaatgttgggtactaaatctatttattttgaagcaagttggccctgaaactttgtgcaaactaattggaatctaagaaaaaaggacattccaaaacagagacttagaaattattctgcactttgaccaaatacccttcaaatagaaaatcaaaagtatttgacaattaaaacttccactggtaaagtgtgcaagaagcgatctttttagaagtttgctctttgttacctgaacaggtttgtaattgcatcaaatgtatgcaaaaattgacgactgtaagtttcattgttacccatagttcctaaacctttcaccaaaacaggttgctgagctgatacgctaataactatttcagaagtagttttgttttggtaaacaaaagcccagcacaggctggaatacagttgttggccctcatgcccggctcacaaggtaaagtcagcaacccacatgttatgaggcccaaaccaagagttaatctaaaagctttagagccccggaaatcccgtgtcaggagtctaaacggcaggcagcgagagttaaactactggcctctgccaggactggccaggatgccaaatgcttagctgactaattcggatttcagcaaaaccatattccacacgtgagactctcagtggatctgtcaagcaggaaaccccacagagactgattttgtgcctgtgttattcacacagtcgccatggagcgaaagactgggaagcacgagatgttttaatttacatacaatttagaaaattgcctcttagatattccatagctatgtttctaagccatttttttcattctaaaatggaaatccccttggggataagcaaaactggctgaaaattgcttttaaaatgttagaaaatgtaatgttgttatgaaatgcaactgaaatgtgctaatgtctttttcagtctgttctagtgtaaccctaataatattgcaaaaatacgagcctgtaaaacattcttcacctgaaatttctgtgaggtttctgaagtctgatgattctggttattgatttgattgtatttgctaatttccttaattcataattctataattttaaaagtcaagcaatacagtgtgagataataattataactggaataatatatgtaaattagtaaaaaaaaaatacttaactagtaaagccagagttaacattaaagctttctgtcacagataaataacagcccacaggcccataaaaataaagttcaatgagaggtgtaggcattatatagagcattatatatttatctgtatatgttaggtatcatatatttatgtgttttatatctcctattgttttgtccattaattttttaatacaatcaaagatattaaatactcagtggattcacattctctggtatctcactgcggggaaattaaaatttattctctttttgaacaaacgatctgtgcaactagactaacaagacatatgatctggattgacaaaatttttaaaaagcattccaaattaaagctttctgttatagataaataacagcccacaaacccataaaaataaagttcaatgagaggtctaggcattacatagagtattatatatttatctatatacgttaggtatcatatatttatgtgttttatatctcttattgttttgtccattaataattttttaatacaatcaaatatattaaatactcagtgcattcacattctctggcatctcactgtggggaaattaaaatttattctctttttgaacacaaatgatctgtgtaaatagactaacaagacatatgatctggattgacaaaatcttttaaaagcattccaaaatacttagatttgaattaaagaaaaaggaattaatagaggcatctcaaaagaaaatatactgacagattaagtagtcaaggcagcaggattacactttttctctctttcctcttgagacattattattaaaaagaaatacaggaaagcttctggaaatgaaagagcaaatgcatatgaatccatctctacttagacaacaattgcaatagagtaattattttggaactctggggtctattgaaggcttgcatctcacaggggatgtctcgaatgataaattatggttacatttggtcaattttacctcttggcgtagtaacagttgcctgctctccacccccagccctctatcaggcagctgggcagttgttcctttcgcaacctgcaggtagcttaatgggcaaagagaataccgtcctccaatgacaagggatctgtgctctgatcacagagttgcagacagagaggcttgctatcattgttgtcgcacctcccctcattgttgcaaggccctgtccttcctgctgaagtgacttccaggagatttaaagaatcggcacattttttccactttatttttcttaccccctcccccaacttgggggccagatgttgaagaccagcatattaagaagcaactgcatatgcagggaaaattacacagcaaccatgcatgcccagggaaaggcacagactcagaaaacacctgcaaatacctaaagtctacatctcagtctgatccttgacacagagacagcctacaacaattttttaaatgttagcaaatcctgaggaaggagaatctgaccttcagagctaccacattattagattccaatgtccagtttcaacaaaaaatcataagacataccaaaaaacaggaaaataaggctcattcaaaggaaaaaaataaaccaaaaactgtccctgaaaaagacctgatggtagatctactagacagactttaaaacaacagtcttaaagatgcttgaagaactaaaggaagacatggaagagcttctgtgtgaacaaaatgaaaatattaataaagagatagaaaatccaaaagaagccaaaaataaaacctggacctgaaaagtacaatacgttaaattttaaaaatcactaaaggggttcaaaggcagatttaagcaggcagaaaaaagaatccacatatttaaggatcggaaaatggaaattagtcattctgaggaacagaaagaaaaaggattgaagaaaaattgaacagagtctaaggtacctgtggaacacccttaagtgaatcaacatatgcattataggagtcacagaatggggaaagagagaaagggatagagagagaatatttaaagaaataatggctgaaaatttccaaaatttgacttaaaagacatgaatattagcatccaagaaattcaacaaactacaagtatgatgaactcagagactcacactaagacacattataatcaaactgttgaacaacaaaggcaaagagaattttgaaagcagcaaaagagaagtgactcatcacatacagagggatcctcaaaaaatattagcagatttctcatcaaaaactttggtggccagaaggcagcgagttaatatattcaaagtgctaaaaaattaaattaaaaacccatcaaccaagaattctatattcagcaaaactgtactttaaaactgaagaagaaattaagacattcccagataaacaaatgcagggggagtttgttatcatgagacctgaccttcaagaaatgttaaagggagtcctgaagattgaaatgaaagaacactagacaataactaaaagcaacatcaaggaataaagatctcagtgatggtaattatatgacaattataaaaattagcataattccaacaatgacatgtaactccactgtttgttttctacaagagattactgcattaaaaaaaaaattagtttatgtttttggacacaaaatacataaagatgtgattttgtgagttcaacaactgaaagaggtggtaaaggggctgctgaagaagcaaaattgttgtatgctattaatgtcatgatggtacaaattcaaatcacaatgttacaattttataatgttaaatttagtctctgtgttaaccacaaagaaaattgctaaataatatacacatataaatttaaatgttttactataaaaatcaactaaacacaaaagaaaacagcaatgcagaaaatgagagacaaaacgctataatatagaaaacaaatagcaaaatgacagaagtaagtccctccataccaataatcactttaaatgtaaatggattaaactctccaatcaaaaggcaaatattgggagaatggataaaaaagacatttagacatgtggctaaatttaatcatccatcctcagttctcatctttcctgacactcgtgatcatttcctccgttttgaatcctcttcttacctagcctttggtatcaatccctcagaaaatcctgttgactctgccttccaaatatacccacacatgtgttcttttttccacttccctagtgacctacctctggtccaagcagccaccacctctggcgtggagggttgcaggtctccccgcttctgccctgctccctctccatctcttcctaacgcacagccagggcaatccagtgagggcagaggacggctcccactcagaccccaggggctctccatcttagtctgagtagcagccccattcctacagaggccaggaggtgctacaccacctggcctggtgacctctgcggcctctcccctgctgttctcccccaacttgctctgcaggtcacgctggcctcccacagtctcccaccgtctgcacacagcccagtgtgctcccgtctctgcctggagtgtcctgagctcaggtggctgcagggctcacttcctgggcttcctcagtcttcattcgtaaggccttccctcaacacctgtttaaaatgacagctgctccacccccagcttcccagtcccccttatcctgccgcactgatttctgccatggcactcatctccttctaaggttccatataatttaactaatgaggcagccctgggagtgcagagctcccaccgctgcaggggagcacgatggacccatggctccactgatgcacctcgggatgcatgaggcagccctgggagtgcagagctcccacccctgcagggcagcacgatggacccatggctccactgatgcacctcgggatgcaacaccatgttcacaacaaggccaagctccccgtggtgctccctggaccgggctgggacaggtccatcacagggacacacaccactcctcagggagcaacttttcacccaggacgccctgttggcctggacagacctttcttgaagctgagactctcctacccctaccttttcttgccttttctccttctcacagatgttggacctgcagcgtggtctgaagtctctctttactccctctccaagaaatctccagcatgtccaactctacctggtttctactcctcagtgagtgtgagctgtacaattgattattattactgttattgctttgttcatggtctgtctcaccccactagagcatgaacccgccagggcagagggctttggttttttcctgtgctttcctggtgcctggagcagggcctggctcatagcagagatgcagtaaatctgtgctgaataaatgtcttacgtattgaatcagatgatgcattttaaaagcatgccacctagtcttgcacaaaagaaccacgtgttcagtattgaccatatttacactaaaaaaaagtcagtttccattaaagaaagttaaagtatttaagtaaataaaaacatagactgtgttcttggggtaggagcacactttagcagtatcaagtatagtcatataaaatgtaaatgtcagtatccccaaattgtctacaaattaaatgcaattccaatcaaaattctagctggatgttgagacattcataaattcatgctaaaatttgcttggatgaataaaggtccagaagtagcctaattaactgtgaaaaaacagggtacagaggcgagacttgacctagtaaatatagactgcaagacactaatagtgatggtaatagtaatctttacaagtatggtactggtgcaaaaacagacaatagatcaattagccagagtagaaagctcagagagagaccacatatacacagaagctcagcatcacaagtcaatgggggaaaggatgaattttatatcggtggtttcaggaaaactggattactacatgaagaagatgagggcacattctttgtagcactatgtgtagcaggggagtcctggaaggctaaaggcctgcaagtagaaatttaaactctaaagctcagagaagataatggaggagtatacttctgtgacttgagaatagagaaagatgtttaaacgaaaatatctccctacaaaataatggatttgacaatatcaaaatctaggggttttattcactgaaaaacaaaatggacaaagttaacacatggcagataggttgggaggtgatatttacaattttgaaaaccatcaagggactgatattaagaaaaacagggaaagtctgtgaatccaaagaaaagacagaaagaaatcaaacagaaaagttgcatagggtgtggacaggtgagtctcagaagagaaaacccaatggctaacatgtatgtaaagagatggttaaagtcatgtcagataaatgcaaattagaacatcagtgagacaccacttcacacaagtgtcagactgacaaattaggatgctgggtggtaccagggactaaggcaggcacaggagcacaggattccatgagctgcaggtgggtgcaggtggcacagccatggtggaaggcatcctggcgatgtttattcagattaagaacaggcagccaatgactcagaacttcattcctgagaacgtgttcaacgcaggcccatggatgcatgtgaggacgctcatgcagccttactcgtggccatgtgatgctgggggaatgaacaggcatgatgtattagtctgttctcacactgctatgaagaaatacctgagactgggtaatttataaaggaaagaagcttaagtgactcacagttacgcataactggagaggactcaggaaacttacaatcatggcagaagacaaaggagaagcaggcacctgaagacaaggtggcaggatggagcgagtgcacgcaggggagatgccagatgcttctgaaaaccatcggatctcgtgataactcactcactgtcacagcatgagggaaagcactcctgtgatccaatcacctccacctagtcccgccctcaacatgtggggattatggggattacaattcaagatgagattttgggtggggacacaaccagaccatatcagatgatgtgtgggtgcgtggaatgctctggaatgtgtcacagcccctggctataagcaacagactcgggagtgcaaagtaacatggaaagatctgagcccacgaggatatttgcctctttgtgacgggaaagtgagggcaaaaaggaggcaaacagatacatagagagatgcattaaagacgagatgtgccttgaactgagattgtgactaactcaatcctatgcacttgaggctaaaaaaaaagtatcttaaatagctgagaatcaccggtaatcaatggcatcacctcctatgatcaggctttgtaagttgcctttgtgggtcgaggctgtcttcttgtccaccccacgcaggcctgttaccggggttaacccgagtctaggtccggataaaagcctatatatggaaaacttcatgggatctccttggaatccattcttagcaactcacaaggtcacaaagtaccatggatgagaagtttggacacatgtcaatttcctgcctaagcccaggctcagggaataagctgcctctttctgatcctcaaaacataacaaggaccaaatgcagtgtaccaacacagagcaccaagtgtctccacacaagatcacaaccacatgagacagtgacaacttcatacaactccaggagggtccatcttccctcgagaagccaggactggacagagaaagtacccggaggcccgcacagctggcaaatagttgatgtattttcagacagcacagtttcttaaggaccaagaatacgatgacatcacactaagaagagaaaataaaatcttgaaaaatgacttaaagtataggtcaaatatacatgccatgcgggtgctccaagagatggacaaattgatcttattgatcatatttttatacctttaattacatttgcttatctcagcacccactcgctctagagcccctcaggtgccctcagccaagtgggactggactgaccgccaacagccctggttccctgttggcctcagacagagcttgcccagaatgttattttcttggctgtgttttcaaattgttgtcatgtttatcctaaggtcataattttattctgcctcataattttccacctgaaggggctgcccaaaacctaactacatgcctgggcaacatagcaagactccatctctacaaaaaactataaatatgagccaggtgtggttgtgtgcctgtagtcctagctgctccagaggctgaggtgggaggatcacttgagcccaggagttcaaggccacagtgaactataatcatgctactgcactccagcctgggccacagggcaagacctagcctcagaaaaaacaaaataaaaataaaagtgttttatatgtacaaaaattcttcttaatcttttgatccaaggaaagcatcccctaaccttttaaaataagttcaaaacagtatttttgcaaatctgagtgcagtccgatttctactagagttccaaagtcttggtgaaccacccattcttcttaatcaagttatcatatacataattactagaataacagctctcaaaaattaaaattcacttaacaagaaaattatattgaacacaatacattctttctccagtgactccagagccatccgaggatatttcagtgcctcgtcaagatgttaattacgaagctgaacaatagttgctgagtgcactgtagattttaaatgagtccggggaacttcttgtgaaacctggctgtcatcatctcatcctggaaaacgagtggatgaaagcaagcgggtcggttgtggtggctcaagcctgtaatcccagaactttgggaggccaagacgggaggatcaacctgaggtcaggagttcgagaccagcctggccaacatggtgaaaccctgtctctactaaaaataaaaaaattagccgggaatggtggtgggcacctgtaataccagctactcaggaggctgaggcagaagaattgcttgaacttgggagacagaggctgcagtgagccaagatcgtgctgctgcaccctggcctgggcgacagagtgagactccatctcaaaaaaaagaaataaagcgtctgggctcccagatgttggcagctccctcccagccctgccctcctcccacagcccccttgcctctctctcaactctcagcttaaatgtcacctcccaagagaggccttcccaggggctgagtgtggggagatgtcccttttaggctttctctcaaagccctgcagggccctgtacttatttagtgcaatggaaatcctccacatggggtctgtgttgggcgcgtggcctcccatacccgtggccacgtggcctcaagctcccgctctcgtgtggaacctgaccctcttccctgcaacttcacatctcactccaggaataattttatgccaaaaacttaaaatatttttaagaacctacttatttgcatgttttctagtgacctcatgagaagatcaatttagcagcttctcacatttttcatctttgagattcacagccacatcactgagaaatatgttaaggaatatttaacaggttataaactacagcaatcccactcaagactaaatagcaccaagacagttttctatagaaatcgggaaactctccagctctcactgaaaataatgctaagacaattcagagtcaaaaaggcctcatggggttttttctccagataactcaattaacccaaactaaatcctgagacactcacgcacctccatgtctcttgattttgtttgtggcttgaggggttgagaggcactgcttctcaccgtgacccagaccaccgctccctggagaacggatccagactttccccacatcttttatagtacctccatatcacacatgggggaggtaggtccacaggcctgcatttaacaagcggaagccagcacacgtgcaggtgtggagcagaaggtcccacagcagcagccagggctccgattccctggaagagccgcccactgcttctgaccaaacctcacattgttgcttccatgtggagctccctggaagcagccaaacctataaaggattggttacaactgtagatttgattatgtctaactttaatgagattaaaaggaattcattctacattttatgatttgttttccgagttcattggtaatacattgcattagtttccaagggctgccctaaccaaatacacaaactgggtggcttaagacaacagaagtggattgtcttgcattctggatgctagaaccctaaaatcaatgtgtctgcagggctgtgctccctctgaaacctgcaggagaaccctttcttgtcctttccagcatctggtgttgctgggaatccccagggacccttggtgtatagatgcgtcactccagtctctgtgtccaccgtcacgaggctttctccctgtgagtccgtatctgtgtctcttctaaggatgccagtcatgtcattgagttttcatgactgaaaactcttggaacattattcttttttcaaaaggaaataggtcaaaattgtaactggatataaaatacataatggggtgatgatattggagatagactagatttttgctctacctttcttcagcacatttatgtttgatatttaagtagaactgtcttgcacttcaatgtttaatgatggccggtgtctggtattctatctggcacatggcaaacactaaataaatacttatcaattgttgattattattgatcaaccccatattgttggtacgcatacattttgcaattataaacatgaaatatacataatgtttttcaaagatacgtatggttttatgcctaaatttttattgcattaggatgatctcattaggataccacatggatgatagtatgtttcaaaaaaattgtctgttaaaacaaattataattaaaaccattttctaagtgttggctatattaaccagtaaataacaaagacaaaatattttaaaaatctaatttaaaaatcatatgagttctttggttttaaggcatagtaaagcaatgattcacatctttcctttaaattggtcattcttattcactgaagttaaaggaaaacatcttggtaatatgtgcaaatactttcttacgaattatttaaagcaagagttcccaacccctgggccataaaccagtaccagcccgtggcctgttaggaaccgggccacacagcaggaggtgagtggccagtgagcaaagcttcatctgtatttacagcccctctcaatcgctcacattactgcctgggctccgccacctgtcaggtcagtggcagcattagatttcatctgtatttacagcccctctcaatcgctcacattactgcctgagcttcgccacctgtcaggtcagtggcagcattagattctcataggaacatgaaccctgttgtgaattgtgtataggagggttctaggttgcccactccttatgagaattaaatgcctggtgatctgtcactgtctcccatcacccccagatgggaccgtctagttgcaggaaaacaagctcagggctcacattgattctacgtgatgatgagttgtatcattatttcattatattttacagtgtaataataatggaaataaagtgcatataaatgtaatgcacttgaatcatcctgaaaccacccctcttccaccacacctggtcagtggaaaaactgtcatccacaaaatttgtccctggtgccaaaaaggttggggaccactgctttcaaggtagcaaagttttaccctagcacttgaaaaatggtattctgtggtacaacaaagaaaacgagagatactctaagggaagttctgtgtcttctaaatgaccgattaaagaaactaatgaaaagtcactttttgtggccatgaaacatgaatttaagaactattctgaagttggcatccacatagtctagaaaatttttcatctctttcatttcccacattctttacaaagttgtataacagcaaggccttcgagggtcactgaggcacagggcactactagacctctgatccctgtgcggatgctgcctgccacatgcttcactggatgtgaggtgaggaaagaatgaatatttttttcatcaaactgctgagctttttagcccactgtgatttatagtcactaaaataaaacaattcctttatcattcaaatactactgacatctaaattcagactaatacactctaccaaaatcatatcatctggcctgtaacttaagacctacagacatcagttaatttaggaaataatctgatgtgcaaaggaaaaattccatggagagatgacatcctcctctcttctccccagtatgcagggccattcagctaatggggtaagcatttcaggaaataatgtggccctgatatatgtcagtggcaatggaattaaagaggaagagacaataaaaggaaaaatttcaaaagaattgccggttgaagatggatagaatgaacacaaaagttttgagccctggagaggagagtttcagtaccgcggacagaggtttttgccgttgcctacttttccttaggcctccatctatgataattcattctacaaaaataaaaggagtgaattgaaactaaagtgtagctcataaagagtagtagctgtgctacttatttctacagagcatcaaacctaatgctgttgatgttgatacctcttctgaagatgacaaaaataagtaagtccaaaaaatacaccctagtttttaaaacatgaatgtggctgacagatgattaaaacactttcatcaagattctaaaaagcaggtaagattaggttttgcttttacagcattatataagcaaaatcctgcttcgttctccacaacagtgccttcctaaccatgtacatcatatgccaaggtcttcaaagggcccatgctttcttagcatgcccagcatatttaattaaagaattattgaactatggtcaggtgtggcggcttacacctgtaatcctagcactttgggaggccaaggagggtggatcacctgatgtcaggaattcaagaccagcctggtcaacatggtgaaaccccgtctctactaaaaatacaaaaaaaaaaaaaaatagctgggtgtggtggcacacacctgtgatcccagctacttgggaggctgaggcaaaagaatcacttgaacccaggaggtggaggttgtggtgagccgagatcacgccactgcactccagcctgggtgacagagcaagactccatctcaaaaaaaaaaaaaaaagaattattgaatgaaactgaattggaagatgttagtaacgccttccccaattaatggatctttgaaaaaacatataagtagatacagaatgactcagttgttacaggacattttaaacagtgcttcttatatgtgttactccacaggaagtattcaaaaattagagtcaaactcactctcaggaggttgttgtcaactggtcaggttggaaacaagcaaatgtttacatttcctacacactcatatgcttccctcctaagacaggggaattgttcaaaagaacaacaggtagtgctccacagagcaccactgactgctccacagagcaccaacccaaatgcttgggttgaaacatggaaaaaatcaccaaggcctctcactccgagtccacgccccaaacacaaacacacatttctggaggctttctcagatgatgctgtggtcacctcaaaccatgattcaaataaggcagattttgagtttgtgcataaatgagattaaatgtgtgtgcctttcagagtaaatggtgaaaaggaatagagaaaatatatatttctttgtaatgttctctaatacaagtcagaaatcagacctgaaggccaaaaagtgacattatttcttcccctgctgctccccccttagcaccatgattaaagctctaaatttgaaaatgttaccaggggacagtgatattccccagcctcaaaactcaagactcatcatggtggcttagtctggcaattatgtgtattatgcatagatcaccactgtaaggttagatggggaacacagatccatataactcaacaaagaaacacacacacgcatgtaaacacacacacacacacaccctaaaccataaaacagtagagcagaaacacacagagatatctccatgtaaattttaaaacctgtctgctagatactatgactcctttaatatctgctgagattctacatgcaagtcaccttttcctccagtgttttattttaaacaggtaaaaatccacagaaaggttgaaagaatcgcacaaggagcacccacatgatcttcactctggttccccagttgttacaattgtgcattattttttatctttctgtatgcaattcaataccacctttttggccaaaccatcttttttctttttttcttttttttttttgtttgagatggagtctcgctctgtcacccaggctggagtgcagtggtgcgatcttggctcactgcaacctctgcctcccgggttcaagtgattcttccgtttcagcctcccgagtagctgggattacaggcacacaccaccacacccagctagttttttgtattttagtagagatgggttttcaccatgttgcccaagctggtcttgaactcctgagctcaggcaatccacccacctcggcctcccaaagtgataacattataggtgtgagccactgcgcccggcccggccaaaccttttgaaagtaacttgcagatatattgacatttcatctatcactatttcagtgtgtttctctttagaaatgggatattctccatgacaataatattgttgtgctcaaaaatattaaaattaatataatgatattattaaatgtacagtttatattgaaattatctccaaaaatgtctttgtagtttttttaaaatccaggatcaaatcatagattgatcacgctgcatttcgttgtgatgtctctgtagtccctgatgtaggacttccttcctcccttttatctctgaagagtccaggctaattgcattgtaaattttccacaacctgaattttttctgtctcctcatgttagaatcagattaaagccttttgacaagaaagctgcatcgctgttgccaagcagtcttctttgcagcacgttagctggcaggtccatccctcatgaagctgtgtttcatcaactgattaaggtggtgtctgccagacctttccattgcaaaggtccctttctatttctcaggaataagtgatttgggatgtgatgctttcgggctgcacagtcaccccttccccagttttgtcgtccattcagagaccgttgcctgtgcttgttattaaagtggaggttgaaaacagtgattttataattccgtcgtgcctttgtcacaataaatccatcaattattttttagtcgagatgttataatccaatgccatcattattcttccgagtatgccgtttttaaaaatttggtcataggagcctctttgaaccaacgactgtgtcctctctacgtgttcccgctgataactggacatgcccttatttcctggaccaacaaaataccccaggctcatcttgtatgtcgcctgctccagacctggagccagctactgctccaaggatgctccctggctcccttcatcggggagtgtggcttacacaccaagctcaggatgcatgttttcttatgactatgggggtgtcagcctttgaaaccctttcagtggacagagctgggaatttctggggtttagcacatggacacgccactcagaagcccacaacatcatttgaaggtgccttctgaggagtcttcatgccaaccttagctttcgcaccccattgctactcattcttcttccctataagaggggtttctgttctcttccgaggaattccatctatgtgttggttttttgtttgtttattttgttttgtttttacaaggtaagcaaatatataaatatttatttttacttgccctcacttcttacatgaaaggtagcattacacataaatatatccacatgtatacagttgtacctcagggtctgttggggattggttccaagacatgtccctctgcaaccccatatacccatatctgcaactactcaagtcccaagccccacagtcgctcctgtaggacctgtgaatgcagaaagtcagccctataggtgggttttgcatcccgcaagtaccgtgttttccatctgcattgataagtggactcacacagttcaaatgtatgctgtttaaggtcaactgtgtgtagatagggcacagtatgagtatactatacttcatttatagtcttttggtaaaaatctttaaagtaaatcctggaaattacctgaatttcatggagattgtgctcattctttctagggctctgcagtgccccatgcatagatatcctgtagtttattcaactggtctcctatgggtagcacttaggttgttttcaataactggctgtatgaataatgctgcaaggaataatcttgtatttactgtatttatgaaggtaggtcttcagggtaaattactagaaaggggagctctgggttaaagggtaaatgcatctataattttcctataaggccaattttcctcctcaagagtttttccacttttctaccccaagggcactatatgagagtgtgtgttttgtcaacaaagcctggaatcaagctttggaactcctgcaaatctgaggtgaagggaagtagctggagcagttttcagtgcatttttctgtccatgactgtttaaggtgcttgccatgggctatctgtatgtatctttgtccttttatccaggggacatgtacatatagttggacaaagccccttcttcaacttttcccttaagctctgagcccactactagatgtcttcatatgctgttacctgtgcaggtaaaactgccccacccaccgaccagcctcccatgtctgtccaactcctaaccatccacagaaccccacttgaatgcccttttctcattaaaggtttccagatttccttcctctatctcaatctcagattaagtgcctctcacctgggtctcaaattatctgattcaatcttggttaaaattatgtttagatgagtgggctgtctcactgggatttaatgagaagccttgtgtgaaggtagttgtcttgggaatataaaggctttggtgggtggaaaaaatagaagaataggttagaaaacatttacattcctgataccatgcaatttaaagcaaatgttctattctgttaccacaaagttgagttactgtgcagatctttccactgtaaagaacaaagagctttcttataatattgaaaggtttattcccataattccaataaaagctgacttgtaattttgatttatatatatatgaatataacacacatttttccatacttattatagagaattgtgctcattacattttaaactgcatttgttataagacagtaaattgcctccttaacaaaaagtaattaacccacttataatgacctcaattattttgttcaattataattaaccaattactacgttcacacacacactagtttaggaacattatgtaaaagcactcctccttgcctaagttcgctgcaagtaaaaattaacaagtatctctcacagatgaatttttaaacatagcacaaaatagcattttatcacagggagccaagggcagggacaagcaggtgtcttggaatgatgggtccagggctatagggatttggatattgaattaggttaccatattttgtatcacacgctaggcacagagtgagcacataggaattataagtattaattaggataaaattgtataaatgtaaaacacatctagcaaatttgaagtgttatttcgaattgcttagtggctttatttttaaaatatagaggtgatcgggtaacaccgagacaaggatttctctttctttccagcaggcgcaccccaggagtgacaaatcagccttcaattccctctggggaggggcctggttgtcctctttgggtggcttagcagctcaggccctgtgggtgcgcttcacatgcgtggggctgtaggatggaggggtggagaggcaggcaggcagaaacacaggaggcctcactatgtcttcttccagaaatcccggcttctcctgtaaacgctgcagtcagtctccatccttagcctggcacgggtctgccctgtccatgtgcatcctccgtgtgggtgcggtgggccatccctcctcccaccgtaaccacctacgctcccctgggtttcctccccctcacttattccctttcactattgctgtgccccagatttccactcggagccctcatcccttcataatctgtagcctcttccaagacaaacttcccttcactttaaaaaccatgtttgctgaggatgcccagtagtaaggccctgacccttctgtgacctccctcctaaggccgcctacttgccctctccacctgtctattcacaggcatactgaagttaacgttgttgtgttggattccccactcagacacgctcttctctccttcttccccttctcagttaacggcacactcagatgttcaggttcaacactgggcaccatcctgaatccctctccctcagcctcccatcaaatgcgttggcaagtctgacagccccaagcccagcacgcacccagatcctggccctccacctctgtcaccatggacgctgctcgcgccaccaccatccctcctggagctggcctcctgctcctcccccctgccctgtcagtcttgtccttgcagaacagctgcagtggattttaaagaaaatctgactctagcaattccatgcttgacattggtaagggctttacgggctggatatgtccctgcaaacttcctgcattgaagtcccgactcccagcgcctcagaatgtgcctgtgtctgaagacaaggccttctaagaggtaaatcagctaagatgaggccacaaggggaaccctaagccaatctgactggtatcctcatgaaaagagattagggcacagggagacaccctggctttgcttgcgcagagagacaaccaggtgaggacgcagcaagagggtgccccggcaagccaaagagaggtggggtgggaacccaccctgtggacaccttgacttttgatttccagcctccggagctacaaggaagtaactttctgttgtgaaagctgccgagtctgtggtccctgtcagggcagccctagacacagacacaaacgatttccagctacactgagagtccatcccattccctgcctgccccaccacctcccaccaccccatccagctcatggattatttatgtgtctgtctccatccagcagaaaatcaggacaaagatgtggatttgtctgccctgttcaggcaaaggtctatcccctaaagcagtgcctcacacataggggctcagcacgtgttttccaatgaatgaatgaatgaatgaatgaatgcaatcccatgttgccagatctaaggactttccataaggagccatgtaagtggatttttagacagaatgttgtggttcctcagtcataactttttcttggtagaatgacaagtttcttttaaggaagtattccagttcatcaatgaagaagtgctagaatgagggtatcactctttgatcactcctagtgagttattggatcttggcaatcaccaaaactgaagaaaaagacaaccagacatccaaagggcagacgaccccacctgaatattggtgagactctagacccaactgacaaaagacaggagctacatgagacaggggaccatgttcaaggatgcaatgaagaagcaggcagaaagatccagaatgcccagaacactgcaggacagtggtccagtttctttaacaaggcaagaaatatgcaagatgtagaaggagaccacatattaaatgagacttaagaggtgtgtcaaccaaccacggtatatgagcctctcttagagcctgactcacacaaactattacagatcagataactggtgaaagtcaaagacctgacatttgatgatactaaaaaattattattaaattgttatgcactgtattggttttgcagtgtgtgtgtgtgtgtgtgtgtgtgtgtgtgtgtgtgtgtaaagggtgaccttatctttagagacacttcttgaaatacttgtagctgaaataatgtgataataaacttcttcaaaaatagtctggtggatgtgggcttaggggaagagatggagtttaaagtggaacaaaattttctgtgagtgatatttgttgcacagtgggagcaagaaagttcctagtgttattccctcaacttctgcaattgctcaaaattttccaaaataaaagcagaaactatgcagtacaatgaacacggacaggcatttcacaggagaggaatcggacatggccactaaaaatgtagagagaagtgaaccttatttgatcagcgaagttcaatttatccccattcaactggcaaaaagttaaaaggtcttacgataccacatgttagggaagacatagagcttctctgatacgtgggatagtatgctcacgttctgctgttgggagtataaactggcacaaccaatttggaaaaaagcttggcatgctctcctcaaaagtttatgctctccatgtgaattccattcaataattccatacaacgattctataattctatctctggttggttgtgtatgtgtgtgtgtgatgtgtatgtgcttgtttatatgtgtatacacatgtgaatatacatgcttgtgtgtatgcatgtgtatacatgtacacacatctctttgcacccacgagaaactcctgcacatgtacccgaggtgtcatgtataaggacgtcatagcaaatgaatgaatgaagggaggcagcgagggagggctgcccatggagcagagatagagatgtggtatggaccaaccagtactggacctggtgcaccagtgtacagagaagccgccgtgtggggcgactctccagatagcagcctgtccccctggtgcccggcactgcctcagcaggtggcacctgctggggttctcactctgcaagatgcctgggggacatacttcccaacttctctgtggcagttttcacttaaaaggaaacttgaatatttaatccgaccctaagtcaaatccttctgtgctagcatgagggcatgtgtgtgtgagtgtgtctatatgtgtgtgtctatgtgtgtctgtgtctgtgtgtgtgtgtctgcatgtctaatatgtgtgtgtctgtgtgtctatgtgggtgtctgtatgtctgtgtgtgtgtgtgtgtctatgtgtgtgtctgtgtgtctacatgtgtgtctgtgtctgtgtgtgtgtgtctgtgtgtatgtctgtgtctgtgtgtatgtctgtatgtctgtgtgtgtgtctgtgtgtctacgtgtgtgtctgtgtgtgtgtctgtgtgtctatgtgtgtctgtgtgtgtctgtgtgtgtgtgtatgcttgtgtgtgtatctatgtgtgtctgtgtgtgtatgtctgtatgtatgtctgtgtgtatgtgtgtctgaactttgtgaaaagaggcaatcacatcaggacagttgcaggccacagcgttctgtgcttcaccctgtccggggtgctaacttgaagccatgagcggagcaccccagggagctgccttcccgtccgtcttctgcctccacccacacagcagtgctgcagagcgctgttcttccacgagggaatagcagggcctctaaaaacccttttacaaatgtcgctttcatgatcaggaatccatttcaaagccagagcagagcgggctccccacaaatgggggctctgagttgaggggtgctggatgctgaggggagggggcaaaggggagtgatcccatgagtcccgagaataaaaggcagggctgatggtgccgtgactgctgggaatccagggtacccgtggctgtgaggggaaggcgactattctgaagagaataactttaacctctcattcccaggtaacgcctggagttgaggaagaactcgggcttaggggaagaaatggagtttaggtggaatacagcagagagggacccctgggcaggcctgcttcccctgacatgacccagatcctggcaaatcattatagtcccttcagggtgctacttagctacttaccctagactgggtagcttagctacttaccctagactgggtggcttttaaacaacagaaatgtagtggtcccaggtctggaggctggaagtccaaggtcaaggcaccagcagattcagtgttggatgagaacccacttcctagtacatagacagcaacttctccctgtgtccccggtggtggaagtggtgagggagctttctggggtctcctttataagggcactaatcccatgaatgaggctccaccctcatgaacccatcatctcccgaggccccacctcccaataccatcaccttgagggttaggatttcaacacgaattctgggagagacacaagcattcagaccacagcacagatgaaatgtccacagcaggaaggaacagattcctccactgggctgtcatctgagctcctgcctttcacgtcaacatttgtgagtagaaagtaaagaaaattggatcaaattaacctgaaagaatgaaccaaggcaagcacaacaatgagtcattagaaaacacttcgggcataaatagatgttctcttttggcaaatttcctaggttggtggatattttaagttttactaagaaaaacaaatgtaaatgttattaagcggctgggaaaaacaaagcatgtgatatatttttcacacatttttctttgtcctcccattaaactctatgttcatatgtagtttatattttacatctaaaacttgataggatgtttttcatttgttctgagaaagtggaaaagtagaaagatacgtttcccattgccacaccttagctgtttttaaaatgttctcttctctcacacacaatcaattgaaagagccctttcctttttcctaggacgtcctgagcactttgctcacactgtaggactcaaaaagtctgggccatgtcctgggatgacctaaatcagattcaagtcatccacagcgctgcttggtatgtgtgcaattcaagggagaatctcccacacacctccttgcagacaactctgagatttggctcttacaaaagattagttgggtaaatcactgttacaaaagattgccagaaagatgcgcttttctacggattataaaattgtcccctgaattaagctaggcttaccatagctagggtaccacgttgcctcacatcccataaaactgtcttcattgacctcgattttgccattatactctctgtttacatttatggaccctataagagggacatatatgaaattcagtactagatttagtatagggcttggtctactggattattgagggtactcttcatgggaagatacaggaataattaacctcagaccatagttctcagaaaggctatatttcttgtgttttaatgtgcagatgctatgaattatataactgattatgtttctcattttactgaagcctctagaaaggtcagggttgaattccaagcctacctttaacatagaagcagagagtagaattgtggttagtaagggtagggaggtgggggtatggggagaccttggtcaaagagcacaaagtgttagttatgtaggatgataagttgtaaaggttgttaaagttgtcagaataaaaatggagtcactaaagttaagaaaaccttgacaaatagagctggggaaggccaagaagaaaaggttctcaggcttgtacacctgataatgaaaaagactttacaaaaaccacaaccttgcacaaaggccatcacaaccttatacaaaaaaaaaaaaaaaaaaaaaaaaaaaaaaatgcttctggaaggacacctgccccgaaactgcctgtccaacctcggactgtaggaacaaaacgtgatgtgtatatatctacaatggaacaccgttcagccttgttattgatcttgtggccaagaataattattgcaaaacaattatgtaatcctcctcatttttttctttaaacacctctgtctttatctcctgaatatatacatagtttactatggcacatgtattcccattgcaatgctctactcgcaaataaacattttcttttagagagccactgtctgttattaaggttggcaacatctaacacacagcatggagaacacggttattaacattctgttgcgtactgaaaatttgctgagagtccatctcaagtgttcccaccaccaaaaacaaggtaactgtgtgaagagatgggaagtgaattagactgtctgttgtaatcagaatacgatgtgtatggacatcaaaacctcacactgcgtatcttaaatataacaatttcaacacaaaatgtgaaagcaaactgtaaggataggctggtgcactttgatctcttgttttatgctctgccttcattgttctgtacccttaatcgggtttttagtttcagtctattgtgtgagaagcattttaaattaataaggtgcctcaacttcctcttggaatgtagattgggtgtaaacatacatctgtaaatacacatatattctgttagaagagatggcaatcagctgcaggtacctgacagaatttgctacatcaaaccacagaaacatgctggaggaaaaagtaagtacaaacccatggatgagatctcatgatggagacaattacacctcagggtcagcatggggcatgggcatcccacctgttccctcccagcttcagcacagtgctgtggcctcagggagtcctctgatggccacaaagtgagcacagaatcagagcccagtggtcagaatggcccggaaggtgaacctgtcacctgcagagcctcttctgaaagacctgccctcctttccccttcctccccaactccacacccgccaccttcctgtggggacagaattcaggcaagactgccacgccagtccccagtgctaaatgacaaaccacgttgggctcatgccgtatctgccctttccttcacccttccttccagaattcttttgctcttaatatttctagggtagaagtagagcaagtactttatctatgggaataaatttatcacataaaaatctaacagagcttgagatataaatgtattcagtgtgccttaaaagtggtatcactgactcatcaaattgtcttgtgaaaactggatatcaagatgcaaaagaatacagttggacatactctatatcatacacaaaaattgactaaagatagatgaaagacctaaatgtaagacctacaactataacactcttagaagaaaagatgagaaaagctttatcacatcagatcgggtaatgatttcttggatatgacgtcaaaggcacaggcaacaacaacaaaaaatagataaatcagacgtcatcaaaatgtaaaacttttgtacatcaaaagacacaattaacaagatgaaacaacaacccacagaatgggagaaaatatttgcaaatcatatatcagataaggggttaatatctggaatgtataaaaacctcctacaacttaataacctcaataacaataaaaaaccaaataacccaattaaaaaatagcaaacgacttgaacaaacatttctccacagaagactacaggtgaccaataagcacacggagaaacgctcaacatcacgaatcatgagagaaatgcaaattaaagccacagtaaggcaccacttcactcccattggtatagctgctatcaacgaagcagaaaatagcaaatggcaaggatgtggagaaactgaaacctttgtggcactactggtggaaatgtaaaatagtatagctgctgtggaaaacaggacggtggttcctcaaaaacatttaaaaatgaattatcggccgggcgcggtggctcacgcctgtaatcccagcactttaggaggctgaggcgggtggatcaggaagtcaggagatggagaccatcctggctaacacagagaaaccccgtctctactaaatatacaaaaaattagccgggtatggtggcgggcgcccgtagtcccagctactccagaggctaaggaaggagaatggcgtgaacctggaggcggagcttgcagtgagccaagatcgcgccactgcactccagcctgggcaacagagcgagactctgtctcaaaaaaaaaaaaaaaaaaaaaaaaaaaaattattatatggtccatcaattcccctgctagattgaaaagcagagacttaaacaggtatttgtctacccatgttcacagcagcttgactcacagtactctgaagatggaagcaacccaatggtccatcagcagacgagtggaagaacaaaatgtgatgtgtatatacctacaatggaacaccgttcagccttaagaagaaaaggaatttgtctgggtgcagtggctcatgcctgtaatcccagaactttgggaggcagaagcaggtggatcacctgaggtccagagttcaagactagcctggctaacatggtgaaacctcatctctacttttagtatttttaatttttaatacaaaaactatctgggcgtagtggtgggcgcctgtaatcccagctactccagaggtcaagggaggagaatcgcttgaacctgggaggcggagattgcatgagccgagatcgcaccattgcactccagcctgggcaacaaaagcaaaactccatttcaaaaaaaaaaaaaaaagaaagaaagaaagaaagaaagaaaagaaaaggaattttcacacatgctacaacatggagcccataaccttgaggacattacgctaagtgaatataccagttgcaaaaagacaaatgctgtgtgattctgcttacatgaggtgcctagagtgtcaaaattatagagacagaaagtagaacagttgctgtctcattggggaagtggctgagggaagtggagaacagagagttggttagtttttaacaggcagagagtttcagtgttgcaaaatgagaagtattctggaggtggatggtggtgatggttgtacaatgatgtgaaagccctgaatacctctgacatacttagaaaccgttaagatggtacattttatatttttataatttctttttaaaaaaagctcatcgctgatacaaagtataaaacatctctcccaatacatgcacaagaaatgacacatgcagagttcatggacaatttcctacgaggcaagggaagtaaggcctgccctctaaatctgccttagcgtgtgagcccacagctttctgctgtgggttctgacatttctcatcacaccaagcgtcagtcctctcagacccagatctgaaagcgggggctgaaacctgtgttactgccttagctgtcatctccatggctgtgtgggatcccagagccacagccttccgtcctggcactgtgttgatttttaaggccttttctttgagatttgggacattattgtttcctctttcccagctcccccctatcaagctagagccctgaccattaggcactctggccagacccaggctctcccttgggctgggtcacacgctgtggttggggagtttcttctgcaacgaaggcctccctggacccctgactcaccacgcatgtggccaaccacacctctgagggcctggagcccagaccctccagtggcagggggtattgggtccatccacggagagaacccctgatggaagaggcgcctccctcctgggccatccacactgacaatgcagctgctccctgcccccacctcctcctccactctccgcaggtgttggtcctgcgcacctcactaaacttgctcagaggcaggttcctcagaggctgctccacgcatccaggaccggaggcctcaccagggatcccttctcagatccttaccctccctgccatctctcttctgctcaggtccacagtgggtccgtggccatgatgactatggagcttctctacttcaacttgaatttgcccttccttcaaccactctgtgtatttctacaccagcatgacaccttcccccctgcccctgccagacagaaagcttcagctgtaagggcagtgaggaccaagacactcttgccttgtccgcacctcttcacaggctccttcttcccacagaggaaggcttggcccccactgagagacgctcccttagggaacaggtgctgttctatttccatgccgcatttgccctcaccttccctgggcctgggctcggtagcaaaagaccacagagagaaattccaaaactgagaataaaaactataacaggaaatatttttaaacaaattgtattttaccacatctacatacatacacacaataacagaattacatactagatagatgatagatacatagatagatgatagatagatagatgatagatagtagacacatacataggtaatagatatatagatacatatatacatagatgatagacagatgatagatggatagatagatgatggatggatagatagacagatgatagataatagatggatggatagatagctacatagatacatacgtagataatagatacacagatatatggatgatagatacatatatacatacatgtatagatgatacatgatagatagatagatagatagatagatagatagatagatagatagatatagataatctacagtagtgagttggttgcatgttatgaccgaggaagaatataagatgcgtaccagatttctgatttggccttgaaagtgacctgggagtatttttaatgaagtaaacaggaagaaagtggctgatggtgttggaatttgcctggcctgggaggaagagctgagttaggataagaggagtgggatttggacacattggctgtgctgaggaagttgggggggaagctccaggctctcagcacatgtttggatttactcacagatgcacagatagcagaggctgagctggattttgaatccagtttgaatctacttctgacagaccccagagcccaggcttggaaccccaggcaatactgcccctggctacaccaagatattactctagagacaaaaatgcaatacacttttaagtataatagccaaaaatggaaattctgttggtgttttctctatggtaagtccgctcatgtcaagagaaactaactccatcttgaaaataaactttctgaatccctctcttaagaagcatgctgggaggtcgcagtgccccacagtttaaatgttaggaaatgcaggagatccagaaaattgacagatttattactaaatgtttacttttgatgttcaatgtcattaatttgatctaactggggaaattgtcagaattagcgaagatcatgaatcactgaagtatatttaaatgtcattttattacttccaagcactcataattaaagaaactaaatgttagaaaagaattgagccaagactttaatcacgataccttaaagagcaaattttaattataatgttcacattaaaatgtctcattgcaaatagatcttgccaatatgtttgaaagcagcttgctctcttatgtaaatgcagtttaatttgcttaattaagatgtttagcaactttttctttcataatacaaataatcataatagcagacatttattgagtgcttactgtgtgcccacagttagccaagcacttgcatggtactaccacatttcatcctcacaaccatgaagaaaatacaaatattatcctacacgtgatgaaacaagcttagaaaaggccaaagtggtgaaatagactcacagccaggtgatctgatggaagaaaccattcttagccaacaaaggaaggcatcaggaacaacaaagatgaaactgtctacatctacattaatagaatccaaagcaagtcagtctataactgaatatggacttttcctttatgatgtaatatttgaaactgtaactccctagagtttatgtttttctaagtcagatttattgaagtttaatttacctacaggcgaattcacttcctttaagtgtagagatcaatgaatttttacaaatttgtacagtcatgtaaccatgatgacaaccaaggcatggcacatctccctgccctaaacgcttccctcatgtccctttgtcagtttcctccggcagcccacacatcctggacaccactggtctacaggtagaagtggagtatgcaatacatagtatttgggcctggctgctttccttcagactaattcttgtgagatgtacttgtgttgctgcagtcacccctggtttgttcctttcattgcagagaagtgtcccaagtttagacgcagaacacaatctgtttatctattcacgagtttatcatttgagcaggttccagctttttgtgattatgagtaaactgctgtaaatgtccacattcaggcattttcatggatgtatgtttttattccttttgcataaattccttttcttctttctttctttctttttttttctttttttacagggttggggtttcactatgttgaccaggctggtctcaaactcctggcctcaagtgatcctcccatcttggcctcccaaaatgctgggattacagatgtgagtcaccatgcctgtccccttttgcataaatatctaagggtgaaagcattgggttatatggcaagggtatgtttaactataaaagatgttgcccaactattttccaaagtagctgcgtcattttgcattcccaccaacaacggaagagagttccagttatttcacacctttgtcagcacttgatgctgtcagacttttcagttttagctactctagtaggcttgtatcagtatctcacggtggttttaatctgcatatcctaaatgactcatgatgttgagcatcttttcacacactcatttgccgttctcatgtctttgttaaaatgtctgttcagcaggaacagaaaactgaataccacatgttctctcttataaatgggagctaaatgatgagaagacatggacacaaagaaaagaaggaacaacagacgttggggtgtatcagagggtagagggtgggaggagagagagaatcagaaaaaaatattgggtactatgcttagtacctgggtgatgaaataatgtgtaccacaaacccccatgacacaggttacttatataacaaacctgcacgtgcagccctgaacctaaagtaaaagttaaaacaaaaatgtctgtttaaatcttttgcccatttttattgggtggttgtcttcttattttctagttgtaagagttcctgatgtaatccggatataaatcttttatgaggtatgtgttttaaaaatattttctcccactctggccagtatttggatttttctgacagtgtcttttcaaggacaggagtctttagtttgtatggcgtcctattatttatttatttatttatttatttatttatttagcagttcatgccttttgtgccatatctagaaaacttttgcctaaaccagcgatgatttattctatcagtgttattgttttaggtcttaaatttaggtcaatggcccatttttagttacttttataaacaatgcaaacaccaaggcttatctttttgtttataaatatctacttgttcaaacaccatttgttaaaaagataatctttcccctcattgaattacaccgacatctgtgtcaaaaatcaattgaccacagtgtgacagtctgtttctattcattccattgactatgtctacttttatgccaatactgtactgtcttgatgaccacatcactgtagtatagctttaaaagacagtgtgagttctccaactttattcttctttcgcaaagttctttgggttattctacatcctctgaacttctgattaagtttaggaatctgtttgccaaattctgtggagattttgattggtgttgcattggattctcaaaatcagtttggaaaatcagcaccctaacaacactaagtcttctgatcatgaccttagcctgcattattcatttagaacctccctttaagctctcagccatgttttgtaattttcagtacacaaaccttgcccatgttttgtaatattgggatcctactgtatgtcattttaatttcaatttctcatttttgtttcctttataaagaaataaaaaattgactttggcatatttaccttacgtcctgcaaccatcctaaacacgtgagtcttaatagctgcttttgcagataatttggaatcttctaggtaaatagtaatgttgtatgaaaataaatgcagcttgctttcttcctttccaatttgtataacttacatttcttttttaccttcttgcactaccaataattttcagtataatgttgaatgggagtggtgcaatgtcctcatctgaaggcaaaagccttccatctttcacattaggtgtgatgctggctgtcagctttttgtagaagcactgtatcatattgaggatgtttcttttttatccataatttttagaattttaggagaaatagatttcgagttttctcaagtgatttttatgcatctattaagatgatcatgtggtttttctctttagtctgttaatatggtaaattccatgcatttattttcaaatattaaaccaaatttgcacttgctggaataagttctacttttttatgatgcattattctttttgtatgttgctggattcaatttgctaatattttcctaaggaaaatatatattattttttaagtgtatatttaggagagacatggtcctatagttttctgtttttgtttttgtttttcttgtaatgtctttgcacgggttttagtatcggggtaattttggcttcataaaatacttcctcctcttttattttctggacatatttgtgtagaattggtaatatttcttccttaaatgttcgatagaattcactagtgaattcaattagtctgaaaacttccttgtgggggtttttaacaacaaattaaaaacctttaataaatataagactatacagtgagtaaatatacatgttaattattttctatttttctacctccaagttttctgatttttttccacttctgtgcccaatgtattaatcagctcattacagaatacttcacctctggtatcacttctgaaggtttctaaacacagccatgtgacttatcttcatcgctttcccctctgtgctaaaactcagtgtctcctcacacacactgtccactctttctggtagatctctcatcatatttattatagttactttcaagtctcgtctgttggttctagcgtctgggccagtctcgaggacaggttggcttttgtttgtttgttttggtatgtgtcttcgaattgttaatcaaatactgggtatggtgagtagaggaacagcaaaggccgagatgactttaaattacacctgcacccaagctggcccacctcggtccctgagccgggatttgtcttgtcaggagctgaccaggcctcgctgcttggtctttgccttcagtgtgccccgtcttcagtcccgctcgggcacctgcagctgagcttctcttgggacctgggacctggcccagcacagcgggatttccagtacccgctgcaccctcagcgctgagcaggtgccgctcacctggccacagccggctcttcactgcgtgccccgcccgaggaagaccgacgctgtccattcttgctgggaggtgcgtggtgaggccagggggctccgaggcctcctgtccagcctgtctcagaggcagcccaaggacccaggcctcaagggtctggggtgggagggcgccctgcccacccccacggagcagccttctctaggctctcccagcccttccccggggtggaaggctcggccgctccctgacccctggcctcagcagcccttccctgggccagaggccacactgcagttttctcagctcaggctcactgtggagcaggggtcactccggaccctctcagagctcccacctcttccccgaagcagggccttccccctcccactggctaagggctctgtaccacaagagggaaaaggcgaccgcagggtggacctctgtgtctgtccacctgagggctccccgctcctgcctagcccccagtcccctccccctgcgagaaggctgcagaggacactggagtgaggatggccccgtggctggggctctggggtcctaggctggtgctgggcccacacccagctgtgtcctcatcacctctgtgggggtggctgtgtcttccacccgccctctgcccctcccgggctccccacccttcaggctgccacctggccgccctgctcccgataagttcagggaaggtggggttcccagatgacctggctgggcttcattgcaaaccaggttgtcactgcgttctaagtcctaggcataactggaagctttttgttttacttggttggttgtttgctttttaccaataatctatccaaatatcttctacggaatgaaaataaagcttgcacatggaaatggaaattaagaaacagaagtttttctggttcaaaatgagcttgacagttggtttgacttctgtgtctgagacacataaacgcaacgcaggctctgcatgagcacaggctccttggcaaaagccccagatcacaaagtcaaagcccttactggctcacagggagcacctgagtcatgggctgaggacctcaggcttgaaagccctgtaccagccggtcagcggctaacattatttgctaaaattaacagttggaaatcaatgccttgtccaacagaggtacaattgagctataattgattcaaggaagtaaaataacactgaagaagggtggtcagcctctaacttacaaggtgaagtgcttccgaccttcctaacgcaatggttctggggaaggcaaggatgagagtgtcagcgtgtcaatgataatagcattgtgcttatggaggaaaatgtatttatttttcagagagccatactgaaaaatttaggaatgaaatgttatggtttatatacatcaccaaaaaaatacttgagcaaaaaatattcacaaaaaaatacaaatataaaacaaaatcaaaaaaagtttatctagtccacgttcaaagtcccccaattgtccaaagaaatatactttactgctggtttcttcaaatcagaatggaaccaacaagtaaatgttacattgtattatcatgtccctacgtgtcattaatacacagcagtccttcccagtcttttgtgtcagtcttgttttcttgcaggtagaccaggtatcctcaaggcctcaccactggaggactcggaatcttggccgcaaagatactaacagatgtccacgtgataagccccaggacctgtgagaatggtatgcggcaaaggggctttgcagctttggacaaacaaggaggaccaccctggattttctatgtgagtttaatctcaccagggccctcataagaggaaggcagcaggtcagagtcagaggacgagatgtggccatggaggtcgggatggatgggagtgaggccgctgcaggaaagggccgtgagcaaaggagtactggcacctctggaggctggcacaggcaggaagtgggttctggaaatgaaacacagcctctgccaactcctcgatcttaggatctgtgccctccagaaccgttagacaaccagtgtgtgttgttttacaccacaacgtttgtggtgattagttccagcagccagaaggaactcacagccacccgctgggggacccgcgcgtaagtcatggtgttccccccttgtgtctttattgcttttttcctgtaattagctggttatgttcaaagtagcttcctgcattgttccgtgaattcatggctatatattttatactgtgatgatcacgtctcctgcacatcaaacacccaaaaaccagaggacttgtcattcatcactgcagtgtctacgtggccttttccaggatacgttatgaagaaatgtttgttagataaataagtgagtaaatgtgtactattgatgtagcaacttttaagggaagacattagaataagggggaattgagccttaccatatctgaggggttagttactgtatatttatcattattttctaaatgtaaaatgaaatggactcgcttcttgtttataatgggggctttggaatagtatggttcaccaatgtaaaaatagatgccatcccaatgtagtcacaagggtgcttataagagggaggtggaaatcagagcaggagaggagaggggaggagaggagaggagaggagaggcggcactggaggctctggaggcgcagcacagggcctccagccagggtatgtggacaaaggcccagaaatgggttctcccttgggcttccacaaggaaggcagtctgctgatgcctggatttcagcccagtgagactgattttggacttctgctctcaaaagtggtaagatgataaatttgtggacttttaaaattaactaaaatagaaaaggacaaaaatcgacctctccaataggtaatgagttcaactattgaatgaaattagtattattccatatatatatatgtaagcaataagcttagtgttaacataaaaaatagatgccataatgccacttgtttgcaggaagtaaaaatttgaaagtgaacactggaaactgttctgcaaagctgcccccaaatgactcctttgctcctaaaacagacctccagctgctgtgtgcctgtggtcttgctccttgatctgcagtgtcctgcaccatccacactcaagcatgctctggcacctgggcaccaagttcctgcaaagcctgtgagaaatccactggaccagaacctgaagttttatcaaagtcttggtggtttccatgcacagcaaaaagaaacagacttccaggctttcatgtgagagtgcgacggccttcctctctctacctccccacgagtagagctgcccggggaccctctgtggctgaaaaacagagaaagtttgcctggcacagacacattccaggactgggcaaatggtttggggagctggttttcaaatgctcctttacaaccctctaggaaaacaaggtgtggtgctttcctttcctcgccatttctccagcagcactctgaggatatgcaatgctagacagcacgtccttactgtaacaaaatgccagtgagttgtgtcctgagcccaggaggcttaactaatcactaaccttgaaatgtaccatctcacattgtttaaaaagaaagctgggccgggcgtggtggctcacgcctgtaatcccaggcttaggcgggcagatcacctgaggtcgggagttcgagaccagcctgaccaacatggagaaacactgtcactactaaaaatacaaaaaattagccaggtgtggtggtgcatgcctgtagtcccagctactcaggagactgaggcaggagagtcacttgaacccaggaggcagaggttgcggtgagctgagatcgtgccattacactccagcctgggcaacaagagcgaaactttgtctaaagaaaaaaaaagaaaaaagaaaaaaagaaagctgaggctgggtgtggtagctcacatctgtaatcccagcactttgggaggccaaagtggtaggatcacttgaggttgggagttcaagaccagcctgggcaacaaagcaaaccctgtctctacaaaaaataaaaaaaaaaaaattagccaggcagctactcaggaggctgaggcaggaggatcagcagagcccaggaagttgagggtgagattacaccgctgcactccagcctgagtgacagagtgagatcgtgtatcaaaaaaataaaaaatgaaaaataaaaacctgaatatccctggtgcgttaaaaggaagatactgcattctagtaagagtcaaggccatgtctgcagcttcagcgctgacgcgtgcttcttgccatgctgagccaggcaaagtgcgtgctgcacctgctctttcaaagacagtggtcccagagctgacgatgagctttttccaaagcctgaagatgaaagtgtcagaagaatactgtatgttttttcaaagttataggagggtaaggtgagaacacaagaacaaaaacttaattgcagaggaaaaatagaaaaactcagcaggtctgagatggcagctctgatctagacacagcaggtgctgcacccagcctccagaggcccacagccgaaggcctgcagaggctgagtcagaaaggacctagtgattgcacttcactgctaaggaaaaggtgagagggggctgacagcaagtaatgggacctgtgtttcattcctcccttttgacatggtatgacggtaacaccccgtgaccactctctaaagagatgaggaagaggccaggagtgaggcttgtttggtagaggacagagggtctgatacaaaatcaccctaaaatattctctaatcaccaattggtccccgctatgaccaggagtttgtggtggcctcaggtcttccctaagggtcaccgtgattctggtgcccttggacaagcctcaagcaggatctggcatctctcgagcgaacaaaagccagtgcccaggcagcagggaggcctctacacacctccagcggtagtagaagcaaaaatcatgataaaaaatcaggtcagcgtgcaactcatcgattttggctcatgccccaaaaagcaggttctctcgcaaagactctgagaccctgacccacaacgccaaccgaacgggggttcccaagcacagtatctgctaggggtcgaattatgctccccaaaagatacgtgagtctccaacccccagtccctcgaaatgtggccttgtttggaaatagggtcattgcaggtgtaataagatgaaagtcgccagggtggccctgatccaatataactgcgttcttagaacaccatgtgaagatggaggtggagactggagagagaatcccaccagccaaggaacaccagaggtcaccagcaaagcacagaggacagggagaggttgggacaaattctcccaaagagtccccagcagcagccagccctgtggatgctgtgatcacagacttccagctccagaacggtgagggagtgaatttctgctatttaagctgcccggtgcatggaactttgttgcaaggctccaggagactaatccagcactgaagccagaggggctgtatccataacggacccgaagggctttcaaatctcttctgtgagcatcacgtcccacaacttgtgtctccggccagctccgtgcttcttagcccaatacccagagttacttatcttaaaaatacagacagggaaaatggagattaagatggtggataggaggcaggactggcttgcagctcctgctggaacagacaaagcagcatgtggagagacccacatcgtgaacttttgttccaagaactaccacagcaacataccaggaaagcctagagaatccacggaccctttgaaggaactttatcgctgctgcaggctccatgagacgctgaaaaaccgtgagtctgcctgccttctcagtggggagggcaagttctcagcccaggtcaccggctgcctagaaatagactcggtgctgttgggggcacagtgggagtgagaccagcctttaggactgtgggctgcatgggagcagggtgaggcctgtgaccgccgcctttaccccactttcctggtgatctgtgtgatgcagcagaggccccctgcgaacatagctccattggcctgggaatcacacccccatcccccacagcagccacaccaaaccctgctcaaggagaatctgagatcagaaacacctaaccctgtcccacctgggggtctttctctacctgccttggtagccaaagacgaaggacataatcccttgggagctctacagccctgaccacctctggagaaacctgaatacttcaaaggtgacccaagggcaagcttgtcttctccctgtacaacctcagctgatgcactcctgaaagcaccacctcctggctggaggacaaccaacacaaaaccagtgcactgaacaaaaacacaaccaaggaccctcatagagtccacttcactccctgctacctccactggagcaggtgctggtatccacagctgaaagacgtgaagacggatcacatcacaggactctttgcagacgttcctcagtaccagcccagagccagtagctctgctgggtggctagatccagaagagcaaaaacaatcactacagttcagctctcaggaagccccatccctaggggaagggggagaacaccacatcaagggagtaccccatggaacaaaagaatctgaaaagcaggtcttgagtcccagatcttccctcagacatagtctacccaaatgagaaggaaccagaaaacaattctggtaatatgacaaaacaaggttctttaacacctccaaaagatcacaccagcacaccagcaatggatccaaaccaaaaggaaatctctgaattgccagaaaaagaattcagaaggtcaattattaagctacttaaggaggcaccagagaaaggtgaactccaacttaaagaaataaaaaaaaacatgttatacaaaatgaaaggaaaattcttcagtgaaatagcataaataaaaaaataatcacaacttctggaaatcaaagacacacttagagaaatacaaaatgtgctggaaagtctcagcaatagactcaaacaagcagaagaaagaacttcagagctcaaagacaaggctttcgaattaacccaatgcatcaaagacaaagaaaaaagaattttaaaacatgaacaaaagctccaagaagcttgggattgtgttaagcatccaaacctaagaataattggtgttcccgagaaagaagagaaatctaaaagtctggaaaacatttgagggaaaaatcaaggacagcttgcccagccttgctagagatctagacattcaaatacaagaagctcaaagaacatctgggaagttcatcacaaaaagatcattgcctagacacatagtcatcaagttatctacagtcaagatgaaggaaagaatcttaagagctatgaggcaaaagcatcaggtaacctataaaggaaaacctataagattaacagcagatttctcggcagaaaccctaccagctagaagggatcggggtcctatgtttagcctccttaaagaaaacaattatcagccaagaattttgtatccagtgaaactaaacttcataaatgaaggaaagatacaatcttttccagacaaacaaatgttaagagaatttgccactaccaagccagcactacgagaactgctagaaggagccctaaatcttgaaacaaatcctctaaatacaccaaaatagaaacttcttaaaacataaatctcacagaacctatataacaataacacaacaacaacaaaaaaaacaaaccaaggtattcaggcaacaaatagcacaatgaaaagaatagtacctcacatctcaacactaacattgaatgtaaatggcctaaatgccccacttaaaagatacagagtagcataaacttaagataaagaggtggaaaagatattccatgaaaatgcataccaaaagcaagcaggagtaactattcttatatcaaacaaaacagactttaaagcaacagcagttaaaaagacaaagaaggacattacataattataaaagcagtagttcaacaggaaaatatcacaatcctaaatatatatgcacctaacattggagctcccaagtttacaaaacaattatgactagacctaagaaataaagagacagcaacacagtaatagtgggggacttcaatactccatggacagcactagacaggtcatcaagacggaaagtcaacaaagaaataatggacttaaactataccctacaacaaatggacttaacagatatttacagaacatcctgcccaacaactgcagaatatacactctactcatcagcacatgtaacattctccaagatagaccatatgataggccacaaaacaaggctaggtaaatttaagaaaatcaaagttatatcaagtactctctcagaccacagtggaataaaataggaaattaactccaaaaggcaggctcaaaaccaggcaaatacatggaaatcaaatagcctgctcctgaacgactgttgggtcaacaacaaaatcaagatggaaattaaaaaattatttgagctgaacaataatagtgacacaacttgtcaaaacctctgggatacagcaaatgcagtgctaagggggaagttcatagcattaaatatctacatcaaaaagtctaaaagagcacaaatagacaatctaaggtcacacctcaaggaactggagaaacaagaacaatcaaaacccaaacccagcagaagaaaagaaataaagatcagagcagacctaaatgaaatagaaacaaaaagaaaatacaaaaattaaatgaaacaaaaagctggttctttgaaatgataaataaaatcaatagatcattagcgagattaaccaagaaaaaaagagaaaatccaaataaactcaattagaaacaaaatgggagatattacaactggataccatagaaatgcaaaagatttttcaaggctactatgaacacatttatgagcataaactagaaaatctagaggagatggataaattcctcaaaatatacaaccctcctagattaaaccaggaagatatagaaactctgaacagaccaataacaagcagcaagattgaagtggtaatttttaaattgccaacaaaaaaaaagtccagaaccagatgtattcacagttgaattctatcagacattcaaagaagaattggaaccaagcctattgacactattccacaggatagagaaggagggaatccttcttaaatcattctatgaagccattatcacccccataccaaaatcagggaaggacataaaaaaaaagaaaactatagaccaatatccctgatgaacatagatgcaaaaatccccaacaaaatactagctaactgaatccaacagcatatcaaaaagataatccaccatgatcaagtgggtttcataccaggaatgcagggatggtttaacatccacaagtcaataaatgtgatatagcacataaacagaattaaaaacaaaaatcacgtgatcatcccaatagatgcagaaaaagcatttgacaatatccagcattgctttattattaaaaccctcaggaatattggcatagaaggggcattcctgaaggtaataaaagccatctgtgccaaacacacagccaacattatactgaacgaggaaaagttgaaagcatttcccctgagaactggaacaagacaaggatgcccactttcaccacttctattcaacatagtactggaagtcctagccagaacaatcacacaagagaaagaaatcaagggcatccaaattggtaaagaggaagtcaaactgtcactgtttgctgataatataatcgtatacctagaaaaccctagtaaagaggaagtcaaactgtcactgtttgctgacaatacctaaaaaaacctaaagactcatccaaaaagctcctttaactggtaattgaatttagcaaagtttccagatacaaaattaatgtacacaaatcaatagctctgctacacaccaacagtgaccaagctgagaatcaaatcaagaactcaaccccttttacaagagctgaaaaaaaaaaccttaggcatatacctaaccaaggaggtgaaagacctctacaaggagaactgtaaaaacactgctgaaagaaataatagatgacacaaacaaatggaaacacattccatgttcatggataggtagaattaatattgtgaaaatgaccatactgccaaaagcaatctacaaattcaatgcaattcccataaaaataccaccatcatttttcacagaactagaaaaaacaattctaaaattcatatggaaccaaaaaagagcccacatagccaaagcaagactaagcaagaagaacaaatttggaggcattatattacctgactccaaactatactgtaatgtcatagtaaccaaaacagcatggtacttgaataaaaataggcacatagacaaatggaagagaatagagaatcaagaaataaagccaaatatttacagccaactgatcttcaacaaagcaaacaaaaacataaagtagggaaaggacaccctattcaacatatgatactgggataactgcctacccacatgtagaagaatgaaattcattcttcatctctcaccttatataaaaatttactcaagatggatcaaagacttaaatctaagaacgtgaaacaacaaaaattctagaagataacattggaaaaacccttctagacattggcttagataaagagttcatgaccaagaacctaaaaggaaatacaacaaaaacaaagataaatagatgggacttaattaaattaaaaagcttctgcacagcaaaagaaatgatcagcagagttaacagacaacccacagggtggaagaaaatcttcacaacctatacatccaacaaaggactaatattcaggatctgcaaggaactcaaacaaatcagaaataaaaaataaacaatccatcaaagtgggctaagaacatggatagacaattctcaaaagaagatatacaaatggccaacaaacatggaaaaatgcttcaacatcacttattatcagggaaatgcatatcaaaaccacaatgcaatatcatctcactcctgcaataatgcccataatttaaaaaatcaaaaaataatagatgttagcatggatgcagtgaaaagggaacacttttacactgttggtggaaatgtataactagtacaaccactatggaaaacagtgtggagattcctttaagaactaaaagtagatctaccatttgatccagcagtcccactactgggtacctacccagaggaaaagtcattataccaaaaaatacccgcacatgcatgtttatagtagcataatttgcaaatgcaaaaatgtggaaccaccccaaatgcccatcagtcaattagtggataaagcaactgtggtatatataccatggaatactactcagccataaaaagaatgaagtaatggcattcactgcaacctggatggaactggagaccattattcttagtgaagtaactcaagaatggaaaaccaaacatcgtatgttctcactcataattgggagctaagttatgagaacacgaaggcataagaaggattcaacggactttgggaactcacgggaaggggtgggagggggatgaaggatgaaaggctacacactgggtacagtgtacactgcttgggtgatgggtgcaccaaagtctcagaaatcaccactaaagaacttattcatgcaaccaaataccacccgttccccaaaatcctattgaaataaaaaattaatttttaaaaaattaattttaaaaatatatatatatatgtgggtcccatcactctcctgcttagaagtcccaaaaggcttccaggaaaaaaggatataatccaagaccttgccatggcctcgaatcctgacatcacactcttctctccacatgcatctcaggccagcctgggcagccccaggcctgcacatggttcctgaagccaagcccagctgaggcttccttggtccggccatgccagggtctgtctgtctgtctgtctgggacaatccacccctggtcttgctggttggtttcttctcatcagtcaggtcgtggcctaaacatggcgtgggtagagaagtctacggtaaccatgccccatgcctctgctggtatggcccacgcagagcactccctgtcaccctatttctgcacagtacttacccccgtgtgaaaccatcttgttgagctagttgtttatttgcgaggatgctaaaatataagattcgtgctgtcttctttttcatagaatcctggtgcccagcacagggccagacacacagttatcactccccagactttgcccgaagaataaaagaagaagggagggtgaggtgggggcggatcagcttgagtcaccacgcgtgtagctgacagtggaggaccccaggccacccccgcccgtggaaatccatgagaccgttcatcgtttcaagaaggacattgcaatgtttaccctattaacttggagataggcatttattgggctaaatcctcacgtagaatgagctttcccaacacaggagctgcgtcctatgcatactcagtcccatgtgcctggcgcagtgtgtggcctgagactgacaccagcatgtgttcacagccgtttcctcaagctgactgaattctcgccttcgctttctttggaaatggttttatagggtttgctccatctgttctacataagacagaagtgagacaccgggttcagggaccaggggcactcatgcctggctccgctgtgcccacggggcctccaccagagaagtgtgagactccgggttcaggaacgaggggcactcacgcatggctctgctatgcccacggggcctccgccagggacgtggagcggaggcgtttccttcttggtggccactcaacgtgcatttggcaagtgggatgtttgggttctacatcctggaaaaatatgtcttcatgattccctggagaattttatgactcacataaattgcaaagtctgtctccacacccagctctcagctgcatgtacattacaagggtacaaggattttttttccccattttattacttcaaaatacctgaaggataacaaactatacaattttctaactgacaccttgcatcttacccaaacacacacagcattatctatgggagaaaatccactcaattaaaaaaaaaacctatatatgtatataaatcttaccaaaattatttaaattgtccatctaggattaataaaatataaggagcttttgtaattcttgtaaatcaataatacatcccacctatgacaagatagcagtgaatagggaggtataatttttaaaagcagctccatctaaaagcccccggatttttgtgcactcataaagaaataatgcttgtctttctccagtgtgaagagaggagagagattttggaaagagaggagaaagggtctcagtgtggcaacgcaggtcccgtgagttccacgcagcctcggccagagtcacagatctgagcccctgcgtcctcctcaggaaagctctgctcgggatggcggctcagcgggaagccaggctgcttctgaggtctcacgggggatgaacctatgggaggtgggctcccccacatgtgggtgaggagggagatgacagggacatggagggacagacaacgtggccagcaccctctgtgtgaccagagatgcctgtagcaccgagataaggcctgaacagaaggaagggactgagccaccaggtttgacccatgacctgactgcattagccaaaaataaaaaatctgcccccattgttgagtacactgtgggaaatcaagggttctaggaggagaaaataagtctgtagaaaaagcctttgtttgaaattccctcactcattagttctctgctatacttagcaaattacatcacctttggtgcctcgatttcaccacctgaaaaatgggggaaaactaacagacctcctgcccacttcccagggctgagggagggtgcaaggcgtggaaaacaggcgcacatcaagagttgggttgttatttcacagccagtcctctgcaggcaggaggagagccacgccaccagtcctcaggggctcagacctgggaggccttacagacacccaaactggatctcatcgccttctccaacctgctgctccgcacactagacacagagaaaacggagctttctttgggtcttttgcttcatgatttagcaacgacctcaacgcagaaggtgattcttggctgtgatcggatgagcacaatttttttctggagaaccggcgttttctttatgagacacccccataaaatcaccaggcagcagagatagttactgctctgccccagaggctacaaggaagcccccacaggccatttgctggtgcacactccctggagccatgcgtgaggagccagcggtgagtgctccgctccaggctcccgatttggtgctctcagaccacgggacacagtctccagccggtgcccacgattttagagactgttcccattcgcactgagtaatcctctgtttctcggaaagaaagcactctgggaaatgtgcaaaggctgactttgttacagaagcagaaaaatgaggatcccagaaactgaaaagagctatacactgtcttcatctgcccaggaatgacaaatgacaaacactcagtgagaaaggaataaccagaaggagggatgtctgcagatgacaagagccagacttcttgtcttttgtggattcttgcaaataattaccacttacacatcaaatgatatgctgtcccaatcttctttacaaaatcatacgtttttcttcttttctgcctcaataaatgctaatgttccatgaagccaatgttattctcacccgctccacagtgcgtctaaacacagatgggcctgcagtggcttagccgcatcacccgctttccaggaggcatgatgcttaccctacccttttctagcatttctgcaaggactaaagtgattcttgtctgctggacagagaaacagtaagaaatacaaatgcaaatagactgccatcatggtgacttatgtaacaccagctttcagagacgccacagagacagattcacaggaggtaataagcagggcctggaagattgttttatcaatcttctttcaaatctactagtgatttcttgtaaacagtaattgcattgctcttaattgcttcattagtgcctgggcttcattattcaccttgtctcacttctattcagaccagtttagattgtttttctttctgtttttttatgaggaacaatggaattctgtctggattgcagagacatgagaggcaacgtggccgcacaggcggtttagcctgtcccgggccatatcctgctggagctttggcccagagctcctgaacacacccggcctggctctctctttcaccctttctgcctgttgccacgagtctcttcctgacccttttcctcaccaggggactcgtcgaggggtccaagcagcaacggctcggcaactccgggagctgggcattggaggaggccacgctgacacgctcaggagctcatccctgagcgcccacaggcccctggatgtccctgtaaggaggcttcctgcccaggcctgagggtccctctgtgacctctcagctggtgctgtgtcttcagcaccctccttggctcaaagagactgtcatctggcagccgaaaccctgtgatccccgtgtggctgtgtcctgccaactgatggtgacagcaggaaatgcacctgccctgccccctcgcccggatactttctattctgctatgaaaaacagagtaaaatttgagaggaaagggaaagtacccccgtagccacaaggaaatgaagtggaatcacgctgacattttcaataacacctggatctggttttataaagttgacctaacaagaaaatggtcctattgttatcaataaacataaccctgaaatctaagcgctttaaaaatccatgcaacagggcaggtgtggtggcttatgcctgtagtcacagcactttgggaggccaaggcgagaggatcgtttgagttcaggggctcgagaccagcctaggcaatatagtgagaccctgtgtctacaaaacaaaaactaattaaattcatgcaacaaattctaatatttttcaaaggctgttctgtgaaataaaaactcacctaaaaatcatctatgtatctaagaacatgtagggaacaaagacgataaaacagcacagagacccgggagcctggggctgcctggccctgcacagacttcgcctctgtgccgtggaagtggacaggtggggcctctcctggcccaaagccattgaagctggctctcctcctccatcaggacagcctcagccctcccaaccgcccagcacagcagctcagaggaggctggccgagcgcagccgccgccacgtcctatcccaccaaagatccatgctcagcatcgtggccacctaagtctcacgagtgtggctgtgaggttcgtttgagtacacttggcccaacatccagatcaggttcccaggcaacaagacagcaggttgcctctagaccctcaacaagtccgcccagttaggcctgcagggcagtccccaggggagccacgagcttgtttcctgcacggagctgtcgcctcatggaggcgctctcagccccggtgctcctttgcctcagtacacatggcctgcaggagagaggcaggatggggagaggccagagcctcagggagccagggcctcgcctgctcacaggagtcattttgcttctagatttttcttccacgactgtgatgtcgctatactgagccccttcaagtaatctcttaaagacgtattgcctgacagaatctgctgggttttgtggttgttgttcagaatatgaaggatgcctgcctctgatgcgtcagatgaaattagaccaagaatccacccatcccgtgaatttatgacacaaactcccccacatcactactgccttcttgagggaggaggccgttccctcagcaatggtgaataaaggtgtattgcagtaacacccaagctcaagaacagacatcttgtcttacacccaagcttcacacgggaccttcaccagaactcaccttcttggaagctgcacagaaccgtaacgtgaggaatcacatgcctagatatcctatgtgagctatcccaaatgccttctacacttcaaaaactatgtgagaagtctactccacgaaactcatatcagtgaaagtactcacaagttggagtgatcacagcacctcctgcgctcctccagggcaagcctcgctcacctttttattcttttccatgaaccataatgcctggcctacagattatcaataaatattcttggctgaataaatgaatgggaaaactgctgctgacttgaatgatttttttcctaaataagatgactttttatcatatatgttcagactggcaagaggcatgaaacgtttatcagtttagttgccacaaaatttctttctttttcaaaataacaacagatgttggcaaggatgcagagaaagggaacgcttatacactgttggtgggaatgtaaatcagcacaacctctacaaaagacatatgaaaacttttcagaaaactaaaaacagaactaccatttgatccataatcccactactaggtatctaccctaagaaaaagaaattattatataaaaaagacaccttcacttatctgtttatcacagtacaattcacaatagcatagccatggaatcaacataagtgtccaacatcgaagaattcaatcaagaaaatgtgatacagatacatcatggaatactattcagccataaaaaagaatgaaatcatgcctttagcagcaacgtggttggaaccggaggccattatcctaagtgaagtaactcagaaatgccgcatgttctcacttataagtgggactaaagaatgagcacacgtgaacatagagggggaagagtaaacactgggctacaaaaggtgggagcgtgggagtgggggcgaggatgaaaaatcacatgttgggttctgtggtcactgttctggtaatggctatgctagaagtccagaattcatgactacacaatatatccacataacgaaactgcatttatactccctaaatctattaaaagacgaagaagacgaagaagacaaagatgaagatgaagaagaaggaaaagaagaaaaaggagaaggaggaggaggaagaggaggaggaagaagaagaggaagaagaggaagaagaagaggaagaagaagaggaagaggaagaggaagaagaagaagaggaagaagaagaggaagaagaagaagaataagaagggttttgtgattgtggttcagaatatggctcttttatttgagccataaatccctaacctagagaagaccttgcaaataacccctctggaggccaagaaggatgtcgaaagcctgtctctaacaaaagttacacaacatcatagagtattcaaatgacattcatctgcagctagactaaaaaactccatgttgggttttcagcatcatctatcagaaacatcaagtaaacaagtaattttctccagtattttctcattcttcccacaaatactgcaaatgtacctaaatatcaagattatagttctgcaaaatactcctaaaatctgtttggaactctattccttcatttattaagatgcaaagatatactggttttctattatccagatacagtaagcatcaggaaacagtaataatttcctccatctgatattccgttatcaaaaacaacttttaaagaggttggttactttcattacattctatgatagattcacatctagatttccaccaaaaatgtagagaacacgacaacttgagactaggagctcttaaaaaataaacactgttgatgaattaaaggattttctgttagttgtatacatgcactttggggcataacatgtgctatggtctaaatgtttgtatttctccaaaactcatatgttaaaatcctagcaataaaggtgatggtgttaggaggtgagaactgtgggaggtgattaggtcttgagggtggacttctcatgaatgggattagtgtccttatcaaacagaccccagagagctcccttgccccttccaccacgtgaggacaagggtaaagacggctggccatgaaccagaaagtgtgccttcaccagccatcaaacctgccatgccttaattgtggacttcccagcctccagaactgcgagcaatatctttctgttgtgtagaagcctcccagtgtggcattctgctatggcagcctgaatgcagcaggacatggtgttatggaatcttgttgcttcaactgaacctagcagaatgaagagtctgctccacccatcctggctcagggccttgtcgtcagcctcctgaagccaactactaagtcatcacataagtctgtctgcagtaaacacactgaaagttccctggaaatcacagttcctacaaaagcctaggcaagtattctgaaaaatgacagccagtcatttctctgagacctttggccttatgaatttgctgggaaggtacatcttcctttcctacccctaccactttgcaagtatcagattgagcatcatattttcaggagagtcactgcctcatgcctgcctaccttttgatcatcatggaactggcaaaagcagcgctatctacttttccaggggatgcaaaggtacaaggccaggccaagcatagtgttcaagaacgcagctggatcgctgcgcagctagaagagagctggactctagactcccagattagtgaaaatgcacagaaccgaaaggcagctggataaacgtaaggcagctgaatgccatttttctttatttaaccagtgggctatgtcatcggatcataagatccagcgacacttggcttaaatgttgcattggtgtgcataggtttagatggtagtgaaacgtagcgttcagcatctgagcagaccattttctaaaaccagtaatgttcatcgatccagcccttccagtctgcaatatctgccagctattttaaaagtcaacagagttgcaaattttctaactgttctggctccaggtggcatgtggctgagcgactcagtcttcttaatggccaagtcaatggcccacggctccggctgcctctgagagcgtttgctttaccagtggtggaagtgtggctgcgtaactacaatgccttgactacagcctcaactcagccttccaatttacctctttgctggccagtgtctccctgatggatacacttatcgttaccaaaatctcccctgagaacaccagtgttgccgagatactctcactttattaaagtctaagtctgttttctgctgcctggatcaggcccatgctcctgcacagcatgaaaatgaagaaatgcacagcctgcagcagcaagagctctttcttctcttccgtttgatgaccacctcgggctgataccctgtctctctttccttctttcccagtcaacccctacaggccctgggactcctctccgtccactggaaaggcaactccccacggatggaatccgctcttctccccagctctgctgagcacctcatcagacattttaagcagctgtgtcacatgacttccagtacagggagccccacaccaggcttccatgccagctggttactcccaggcctccttgactggtactaatgcaccatgaccctcacaagtgcccatgccaggagaccatgaactttacctcgatggacagccttccgtcctatgctccagctattctttttgagggagattaccgaatataataagcacatgatatgtacatatgcatatatacacgtttgtgcatgtgtatgtatagagacacatatgtcactaaaataactgctcacagatatttaatttcaaacttccatttcccccttcaccaccttctgggcccaatctccccaaacaaagcagagtgtaataaaacgtgtatagttacttcttctgcagtgtcttctgtggtgggctccacatccaggttgagatcctcctctgtggtctgataacaaagatagatgttaaagatggttagcattgccatgtgtttgtaggtggcctcatacaggttaccaatatgaaaaagtactaactaaatatcccgcatgatttctgtaggacatggaaaccatatcaccgtcccttcccacctgaatttatgtttaactgtgtgatgcttcatgtccgagatggatcctttatacaacaggtggtaagtaaggcaaggagtgttcacactaaaccctaactcaaacgactaaatcaatgaagcgagtgtgacttacggtacaatctaaaggacgacaaggtgattcttgccagtggagaaagcgtggattttcatgaagctaaaatacgaacggagctgatgtggaagcacagagcagcggtgaaggcatgtgtgaccactcccatgagaacggaaccaaatcacagtcccaagtgagtgctgggagaatggattctagcagagaaatgaggcccagcccataaaacgtaaagcaagtgtttctgtggttggcacaaggtttaagtggaaccatctgggtctgagtctttggtttctacttaacaacttggagccacctgcttaacctgggcctcggagacatggcagtgcttctgcctagagatgtggggagagctccacggaagaacaccagccagccatcagcaccggctgccatgcagcagacacgggagagctccacggaagaacaccagccagccatcagcaccggctgccatgcagcagacacgggagagctccacggaagaacaccagccagccatcagcaccagctgccatgcagcagacacgcaaagtgaactgctgtcattattactatttctagtttcatcttctcacctagtagccaggagataatcatctctatccaagcttgactatgaatcttcagggaatcatgtttgatctgcattgtttaaaaacggagctttctctttctctatctaatgtattatgacatcccagagagaaaaatcatgcttattcctccaagagaacacaaataaaatgggtcagccagaccttgtgggctggcttatggacttgccttactcatcatttctcccattttcttatcttgcccccaaagcacgcccttggctgctgtaaccccgctgaaagcaatgattgaaaagtcctgtgtttgagatgtgccttcaacttgccagaacataattcatgaaatactacatgtttctttttcatgctagattctgccggggttttctggaggttctggctcttaatgagcacgttgccttgtcaacacacccatttatgggttaattatatatctgaaatatctcagaacaacacagagaaccacaaagactttccctggacagtcagatgaatctcccctggtctacaatttttataaactgtatttagtgttctctagtacaatggacctcagacccagttcagttcggttctctcagactacagatgagaaaacaggccagaaaggatagcagcttgaaaaggtggttagagcaaaacatgaatccaggaatgctgattctagtccctggaaatccaatcatcagtcctgtcacatttgcataacagcaaggaactaaagcaataaaatctaaactaaatcactaaaaaataagcactaaaatctcttagcagattttccgatgagaaaagcatgcaggctcctcctgcaagggttttagggcatttaacttggagttcagaggccagatatgctccatatagctctgccacatttcttgatatgtgagttattttaataccatgcaacataaaacatggacaaaactagagaggaaattcagactgtgaattccaaaacacagaggattttgtggatttggaaatttcctcagaaacttgaagtacctcatggttaatatttaagctttcatttttctatagaaagaactctggttttctgggttccaagtaaataggaatttaacactgtccatactccaccagctgtgctctcctgaaaaaattcagctaagaagcctgaaaaaaatttattttgcttcaagagctatttaatgtatccaattttcctcaaaacctttaccatctgccctctcctggggctggcaaggcagggcagaccatcagtcaactcggctccaaattcttgccacttgcaagtgctttctaggctcatggcatggttttcaaatcatgggaatctattcattgctgatccatttatgagcgatttgagaaatatgtgaaacacaagctgctcctcatggctttggtcactggaaataatgtaaagaccagggtcccacctggaattgtaaagcccctggccccctctctcccatcctttctgagcccagggcggaatcctccctctggacaagcccttcattcgtgagggctgagcaccttacagcttcagcacaagccaatgtgctgacgatgaccagctgggctataggaagcactagtaaatgagaaaagaacttctagctgatcacttgctcgttcactaattcaatatttagaaaaattgaatctctctctctctcaaaaaaagtagacttgaaatggcaaccgcagtaagggaatggatctttccaaggcaccatcctcaacaccaagaacaaccccatgtacaaacagaagaatcagtaacagtagggagccctggtgtcatccttctcccaccccaggtactttccatgagcagcagtatctgggctgttccatctaaaacaaatggacttcaatgtccgtgctatgcccaacagtctctgctaaacatcaatacatatgtcgagcattatttagcttggctttccaagaaaactattcaatatgaagcattcagtaaattctcttctaaaacagaatctctcattcagttcaaaggtatgttatgtgactatctcaagacgtacatataagaataaataaaatttaaaatagcattgaatttataagtacagtgctgggagtaggagataggcaaaaattaaattggactttgaggaggtttggtgagtgattacaaatgagccatgtttaaatgccatttgagttgctataaacacagaacaggtatatctaataatttagtagacgttaataaatttggggaactttctcttctaggaaaatgtatgttgaccatctccaattcaaatggagcaaatcagattccgtggagcagaggtttgcgtgtccccagggaagcatggagtgaaaaactctcagcagtgattcctgcacacccaccagccctgggacgggcaaggaacactttgatttcattatcttttctgtttatctttaatcacacctctttatctgaccattcatccttttaaggttgcattatcttttttcgtttaagatcacattatctttatgctctctgttccttgattcatcattgatttttgccttctggtttcatctttcactgtagcaaatggaaggcttctaatttaaagccacttgttgaaggaaaatcaaactgatgcagattagtttggaaacgggaatactttaagacttacatagactttaagaagcatcctgaagtttccttaagggcaacaatttgtttcttgtactcattatcatttatgtatttacaccacacacaatgccgtgcgtgtatacacacgcaatgtttatccatgtgcatacacaacgcaacatatacatccacacacactggatagccaactctctgacccatcatagtcacctaatggacatgaactgattatagtaaatgagcaatgcattggctgcagagttcggattcttgaggatgctgtgaaaagtgcgttctctcctgcactcacctctatttccataggctccacctcgatctttttccatagttccagcaactgtgcgattggcatttttaaactttccttttctgctggtcgagtattgatagtaggaaaggaaataaacagaggctcggaccggcacagggggacggccagacgggatgtcggaagccaagggacgc

SEQ ID NO: 345 - DNA, 217873 bp, Homo sapiens
attgttaggctagaaaaagattacacttcataaaaccatgtttattcaaaaaaatctattcagaaagtctggaaagcgtaataaatatctgtacagtggccacccatctcaaacatgaattacaaagcaggaacataaaaatgatgtgtaaacataactgctgagccagtgaacaaagtgctgagtcaggagcgaggcagagaagcgtgctcagtagaacgacacagatgctgcagcctccgtcctcagcccctcaagctgcgctggagtccaccttccgccctctccacaccgctcagggaccggcagcgtccttctccattctcgaatttgcatgacgcttagaaaggtaggaggcagcaaaacgtgtcagaaatgaacggagtgcaaatcaaactttgccatgtgcttgagagaatcagtaaagcgttaggtaaaaatcccaagtgcagctttaggataacaccatttaatgaacaatactggataacattaagtactattatcactttaaaattcaaacaatcttccaaacatcaatacatacacagttagtttaaaatcacagacaaatcggacttgagggtaaaagtgaaatcctcacctcttgcccatgtttgactttgggatggaattcagcaaagctctcccactgcagattgggagaatcaggtatttctcccacatggggggctgccagggaaggaggaccctatagggtggccagcaaggggccactggcggtaggtcaggaagcctgagatctagggttcaatgtgtttataagttctgtgattttcatgacccgggggtggggggttgggttatgatgaactgtgtgaggaaggagagccagttaacttttggggaggtctatgtcatttgtgcaaatcatacggagcatttcattcgttgtggaggtgcgctgagctggcaaaatgcgaattctaagaacaccttcatttacatgtcgactgctgcttgaaagcagtcacttgctatttcactaaggtttttgaaagcttagtttaacatatgataccataacttctttaggctgacttttgtggaaggatgtcaagtatcattttgttctggatatgggagggaaagtagaggtatttcacagacactcagcggagcagggccaagccagtgttctcctccgctgatgcacatcaaatacatgtaaggacagagctcgctgtgatggggagtctcgtcggtccctttggcattcttagagttcagaagctaagtctgtacaaactgggatgactgaaaaagaccatgagctggtgccccatgggcacacaaggagggaaaaccgtggccgctttctcacggatgctttccctttcacttcccccacttctcactccctgcaccagaacccactgactttaagcaaacagacaggcctgcacaccaagccaggccaaagggtccgggcagctgatgggggaatcgttgcctgtgtagcaagcagaaaaggtgatgacttttgttcatttctgggaggacagattgtgtgacctcaggattatccacttcttcctaagtttctaaaaagaagtgaaataattaagacctaaaaagcaaattcatcatggtggaagtcgttctagccttgggaaaaagcatcttctatggagaaaatgtgaggaataccctgtgggcactatggaaacaggtattcagtccgacttgctccttttatgttttgtggttctctaagaaaaaaaaaatccacatggattaaagcttgtgaaacaagtttatattttaaggtctgaaaacaatcagaccaagctaaggagttatttttcagaacgcagcacattttttctttatttttttttttttagttgggtacgagaatcgagatggagggggaacaaaacccaacaaaataacatcttcttagggaaaacctggctgtggccagcgggcacctcctgaagccctgcttgctgcagaggcgccgctcttcagtgatgcagggtgaggggctgagcggcgcctcctcccatctagtctgcttgggggccgccagggagcatcttcaacacccttacaggacaatgaaggacccgtgtgttccctctgccggctggactgggcgtcgatcctgctgcccggaacctctcactcgattttactcaatgaagtagagcacagcatggcctaaatgccccacacccgccctgtgtgcacacccaggggaatacggatcagtgtgaaaaaacagatctgtgcaacagagacacaaaacgcaacacaaagccacagcatctacaaagtgcatcgctcctgtccacgctgatctccgctgccctcccacctgtgcctctgcccctcagtctgctgggtggggcctgtgtctccctccagcctccagctggactgagaaggtttgggtgggaagccacagagctccatttctccaattcacagtttctccacagaccagaaaaatcgaagtgaacacagcaaaaccacagctttaggtgagcacacaggaagccgacacagggctgagcaggtgcgagaacccacgactccctgcaaagcctccagatagctgtgtggccacgggagctggggacagacggcagcccagtgcgcttggccccccggggaaagccgagactggaggtggacacaggctcctccgagaggcacccccttccatcctggtgacacggagctctcaaggcaaagatccagcctgccttcctctcgtctgggctcttactcctcatttgaatctgggacagaggaaaggatgggctacccagcacctcaggcaaaaactgaagggcgaggaggaaacggctctttggattattttgggcagaaccaggcatctcctcctggacgccacagtgccaaccccgtcatccagcccgtggggagccccgggatgccaggtcaccccagccctctggggccctgcaaccaccaatggctgcgccctcgcactgccactttcccaccgggtacctgggacgtgggtgtcgggagtctgaccaaaccgaccggcttcataattggaaaacagatctctcggcagaaacagaagccatgtatgagaggacccgcgggctctgaaagaagcccccggcctcgcacgggcacgcgaggtgaaggggcgcatttggtttcgcttgggagaaaagagagcgggcggggaggctggcgcagtgaggcttggagaagcccccaggtcaggaccctctccggggctgaaaaagaaaacacggacacggcgagggcgggcgccgcctccctgctggacttgtggtcactctgggtgccagacgggctccgaggccggggtctgtgagcccacgaggatgctggcaggggacgctggggccagggtcccacccgctacagccgcgtggacgtgagtctcttcatgcctctgcgctgagccaggttggatgacagcacgggctccagccgcggggcctgaggtgttctgtttagagcaaagtaggtggcggccatcgcgccctgcaaaacagaagacaagggtgagagccgcggcgcctcactccaggggttgagccggagcccggggcctccatgggcctcagctgcccccaggcaacgtgggagaaaccagagcttccccagggtccctggagcatggagtgctgttagcctgccgccaggggccagcacacgtgggccccaggagacaggggccctgtctcctgcacctgccccccccaccccatgccaccctggcactgtgcttgtgccttgggggaaaatgttttggacgcttgtggagcccccaggctgaggtcacgtgatcccctgcattctgacagtgaggccaggtctgttttggggctcgctgggtcctaggggacacagcgaatgccagggccagtcaccctggactttggccactgttgaggagtctggactcatttggaggaacaggcatatcctggagtgaatccaaattctcagaatggatctggagggggcggctcttaactggatcatgcctattcctgctggggtgggacagtctacacttttcagaaaaggagtcccacccagaggatggggtgcctgagaggctactgctgcctgaatgtaagtcacttatgaaggggactttttttgcatgtgtggcctagaatagaggctttgaacttgagtggaacagccacaccagctgccaccacgtcagcagaggctgccacctactcaggtaggagccctgtgcaatactgcacgtgtctggtgaagtgcacgaaggtaggtgggccggcggtgcagtttggggctgctatgggctctttctctgcactctgtggtttcttcggagtgattgcaaggtatcaggctcttttctgggtttcccattcccaccactctgtcctcactgtcgcctgccggtaccttcaccaggtgcacgtcctgtcggctgagctggtttggggacaggtactctctgttgaccacccacgggtgtttgagcacttgcatcgccgtcaggcgctgatgagggtccacgtggagcatcttggacacgacgtcctgccagggaaggtcatgagagtcggggggatggttggatcatttgtgctgggtcagagagcctccccagcagaactcctctccctctatggcaacacccaaccactatgctgagtgtgggtctttgcattttggggtcatgttcactttcaggtttagaagtatgtcaatggtttttagctttaaatattaccaaacttggaagttcactgaaggtttatcttttattaaatatttcatgtctaaaaagttaaatgtggaaatattagatgatgcatgtaaatcgatgaaacactgtttcttgtaacaattatatctttccaaagggaaaagctgaaataattaatattccacaggtagaaatcaattcataatgatgcacatacttacattttttatcaggactacccataaatatttactacaaataatcagaaaccgcaaaatctacaatctggagccatcagatatgtccagtgggttcatgtgcaataatggtatttttccatttcattgtaaagtcgtagcagtaaaaacctctaaaacaagattctacatgtgtgtacacatgcacatacaatacagtgcacattctattacagtgaattacatttgcagagtacttggttacagtgtgaattacatttgcggacaaacctgatgcttctgctctaatcaccataatcatccttgaggtaaatggggcaaatattacttttcctaatttgcagatgaagacattactgcctgaggaagatccaagatgagaatccatattctctccactagcctaccctccttccttagtgttcccaccacatttgaagaggtaataaaatgaattagaatgcggctgggcgcgttggctcatgcctgtaatcctagcactctgggaggctgaggcaggtggatcacttgaggttaggagtttgagaccagcctggccaacatggtgaaaccccgtctcttctaaaaatacaaaaatgagctgggtgtggtggcatgcgcctataatcccagctacctggggggctgaggcaggagaatcacttgagcccaggaggcagaggttggagtgagctgagattgcaccattgcactccagagtgggttacatggcaagagtccatctcaaacaaacaaacaaacaaaaaagaatgcatatagaatgtgaagttgaattactcattagaattttgggtcatgaaacaactaagaaatactatgcacaataacaatatcttttttatacagaaaaatctaatgccttttgatatttgataacattgaccttggtaatttcttgaaacaagtatctcctagaaaaatgagtgttgtcattttcaggtgtaaaaacaaaagcctttagggctttaataactcttttcacgatcttatagtcatgacactgagagaagcagtatttttacttcatacctgtaggatgtggagaaagacatactaatttgtagctttgctggtgtttggaggactggaggttctgttgtgtgctaagtaagagaaaggaagaggcacaggggaaagacgggggatgtggtggtggtagggactggtggtgaagggcaggaagggttggtgaggccctgtgaggcggcagagacctctgcctgcagcagcgatcttgacaatgtgcccttgtccttgactttgctccttttccaacaccttctccctgctcccatgccagcttccaagatggccttccagacacaccaccagcacccacgtcctagtctgaggctctattttgggaaccagaactaagacatctacactcatttaagacaaagtgagggtgtggacaggagcatttggactgtcagggtctgacatctgggatatgctcactaaatgccagctgccatcacctctgccaccacctccaccatcacccttaccatcattcctccatcacccccaccataatcttcaccatcacctccacaatcatcctcaccgtccttcctccatcacccccaccattaccctcaccacaatcaccttcaccatcatcttcaccatctccaccatcatcctcaccatcctcctccatcacccccaccattacgctcaccatcatcttcaccacctccaccatcatcctcaccatctccaccatcaccctcaccatccttcctccatcacctccaccatccaccctcaccatccttcatcacccccaccatcaccctcaccatcatcttcaccaccacctccaccatcaccctcgccatcctttctccatcaaccctaccatcaccctcgccatcatcttcaccaccacctccaccatcaccctcaccattttttctctgtcacctctgccgtcacccttgccatccctcctccatcacctctaccatcaccctccaccatcatctctgccattaccttccattatcttcaccatcacctccactatcatctctgccattaccctcattagcctcaccatcatccccatcacctccaccattacctccacaatcactaccatcatctctcactatcatctcccaccactcccaccgtcacctccatgatcactgccaccacctctgccacttttgccatcccttcatcacctccatcatttcctaccatcacctccaaaatgatcacctccacgatcactcccgccacctctgccaccacttctgtcatccctccaccatcagctccatccctgctcccaccattacctccaccatcagctccatccctgctcccaccattacctccaccatcatctccacaatcgtcacctccaccatccctccacaatcacctccatcatcactcctgccattatctccaccatcatttccacaatcattccctccaccatgccttcaccatcacctccatcatcgctgtcgccacctctgccaccacttctgccatccctacaccatcacctccatcatcattcccgccattacctccaccatcatctctacaatcatcacctccacgctcactgcatgaagttgcactgagatgtcaacagcagaattggaatcagagcccctgactccttctctttcagcccttttacatgaacacgggaacagctgttggtgctgcttaccagtggctggattatgatttactattggattagagaggaatttgatgatgccaagtaaaaaagcgtctgatgggcaaacgaaataaggccggtcataaactgtgtggactgcagacaaggccaaattcaaagtattttacaagaacagaagtatacctctggacaagagctctacttgtttgtttggtttatgaacatgcagggcaatcattctgcaatatcactaaaagcatggtggttaattttatatgtcatcatggctgggttatgttacccagtctagaggttgctgtgaaggtgtttttcaggatgtggttaacacttaagtcagtcgacttgagtaaagcagttaccctgcacaatgtgggtcagcctcatccaatcagtggaaggcctccttaggaaaaagactgctcccctgaggaagagggaattctgtggcagatagcctgtggtgggcaactgccccatccatttctccttggggctccagcctgccggctgccctgcagtcacagacttccccgtccccacaatcacgtgagccaatttcttacaaataaatctctctctctatacacacacacacacacacacacacacacacacgcacgcatgttctgtttgtttctttggagaaccctgcataagataccaagatagtggaaaatgtgaaaatgctaaaaatgtttttgaaaataatgtttttagatgaaaggcttaaaagatgccgaggataaggccaggtgtggtggctcatacctgtaatcccagcaatttgggaggctgaggtgggtggatcacttgaggtcaggagttcaagaccagcctggccaacatggtgaaacaaaaaagttttagtacaaaacttttttgtactaaaaatacaaaagagttagtcgggtgtggtcgcacacgcctgtagtcccagctacttgggaggctgagacaggagaattacttgaacccaggaggcagaggctgcagtgagccaagattgtgccactgcactccagcctgggtgagacagagcgagactccatttcaagaaaaaaaaaaaaatatgctgaggataaaatacctatactacttacataaaacctatcccctggcttcctcagaaatcatatggctatttcagaatctgaatatttaaaagcaacgctgggacatgtactcactttagctgcgtcagatatcgagtcccagtttcccccagaaagggcatacttcccactgccgatccgcgccagaatctcctcaggggtatcgtctggcccatttgcaaaaggggtaaatctgtataattagacaaatttgtggtaatgagcttgtattttacaacctaaaataaagtttgcaagttgatatcaccccttggctgttcaaaggaatagcactttgcttctccctcctctgctctgaagccaggattcatgggaaagcggaacttacctctaacactatgcccgttttccttccttagcaattgggtggctagaggttgatgggcaagtgggagagccctgtgagacctgtgctgtatcccctccggacccaggtaaactgggatggggtggcctagtgagttgcctggtgccgtggtttccacggtgatggtgtggcatcatgcgagagagcctgagacgtggagtctgagagacccacggtggatgtattcccaactctgtgttctttgacaagttaactttttgagcctccactgcaaatgcagagtgtatgcacaaatacacatacatgcttggtgcagctctggccatattccaagcgcgtgggaggtgttcatggtgtcccaccttaaaacacacccacacactcctaggaaaggaaggacacgtgtgctgccagcgcttcctctagtgggaaagtgtgtgatctagttttccgtataggcaaagtgagtattagaagcgtcacaaagtaacctgactgtggtattggtaagaaactgaggttccttcctttgctactgcagtcctcagggtgcggcttcagggcctgatttactctccttctgctgtggacactacctgttgacttatgatgaaataagtgaaaagcaggccaagctcattcattctcatgagggcattcaagccattttgctacagcaaacaggattcgatggtctagggttcttttctttttgcctccattcaagtatttaataaacgtaataggaaccagcggatcttgtaagatcctagaccttcctgcctagaagcaaccatggtgtgtcctcttctcactcaggggagagggaagggaggctggtacaggttaaagtgtttagcccagagtcacggctagtggcgagtggggctcagatggaagtcagctgtctggatggcaggcccaggccactttctgtaacaccacgtgtcttaccacaatgaaccggcccgtgcatgactcatgaccacgaaacccaggtacagatgctgtttgaccctgaagctgctatggggctttcggtttaagaggatgtctggaaggcacatctgttgctaccttttaaaacagtggcaggtgcagcagagagaatggggactatgctggcaaaagacttgatgttttgttcatgagctgagtttaaagaaaatgggtggctacatttcttgtccttgttgttcagttgtcctgaggggctaagaaagtctgcgagtgttcactcaaggcctgggagtgtttgcatacacgttgggtttgcccacatgcgcacactaggacagggctggccctggtcccctgacagatcagccactgaggctgctgccctgtgtctcctcctgacacctgtttgaggtgactgcttaccctgccagcatggtgtacaacaggatccccaaactccagatgtcacacgccgcatcatagccttgacgcttcaggacctaggagggaacgacaggacaccggcacgcccttcactaaggacattcagattgacagcacgtttctccagcggcatcctacgccggcaagctggggaccaggaggagggcggtgccatgtcttcggtgtgaccactgtttcttaaggcaaagccaaccctaaggtactgcagtgggactcctcccaggccagccacatggtaaactagtactctttccagacacatgacagacaggctgaaaaggagggccttaatttttaaggcagaaggatttttctgttacggtaaaatatgtatgacataaaattgaccatcaaagccctttttaagtgcacagtttagcagcattaagcccatttacattgtggtgccaacatcaccaccatccatccacagagcatttcaccttcccaaactgaaactctgtccccattaaacaacaactccctgtcccccagcccccaacacctacccttctactgtccgtctgtgtgaatctgactcctccagggacctcataggagtggaattatgcaatgtttgtctttctgtgactggcccatttcacttagtataacaccctaagcttcctccaggggtcagaagttccttccttctgcaggctggacaatgttccgctgtgtgtgcatgccacgttttgcttacccattcatccaccgagggacactctcgtggcttccaccttttggctgttgtgaatagtgctgctatgaacatgggtggacacatgtctctttgcgtccctgccttcaattcttttgggtatatacccagaagttccattctgggctacgtgataacatttaatttttttgaagaactgttaaagcagcaaaacttgtatgcatcctaggattacatacttcagtagagggcaatcctctgatatagttacagttgaataacaacaaaggaagccacaatggtgctcatggattactgcagatgactggatttagcattaaatatcgagtcgggagagctcggctcaatttccttagagatgagagcaaggagcctgtccttttctctgtatcgctgctaccatgtgtgagcctgcaccatggaggggaccagccagcgcatgctgaatgaatgtggtgctcatggtgcaagcctcacttcctaatccatcagcggggtgaccttcagaagtcacttacacacatggagcttgtgctttctgactctgtgaaacatggttaatagattttaccctgcctactttgtatggtggatgagagtgaaagtaaaaaaagttggtaaaagtgctttgtaaatggcaaaggaatatcacaacctagggcattctacaatcaataaaatcaatattgtgggagaccagaatatgccaccccaaaatatgctgcataggcgtgaggggcgctgagctgaagatacataagaagcagcagatgcaggagagctctgtgtcctccatttgtctaaaatcaggacatggattaagacaaaaggtacctacccccaaccagagaggacaaaggcttcccctagggacagctttggatgcatgtggtcccacctgggaccagcctccataggccagccctgcacctccccaagctgcagcccctggagaccctaaccctcttcctttgtcttgccaggtctctaaaaattctctgttctttgttgcagataccatgtaggctggattcaaagccacctctgtgaggatgactccttctctgggcatctcgcatgcataaatgagaagatgtgtgttaataaacttctttttctcttgttaatctgtcttttgttacaggggtctggtccagctaagaacttatgagggatgaggaaaacgtcattttcctcccccataatattatcaatattaatattgattaagtaaggcatgaacagaggcttataacctggttactttcattttttttagtttttattttttgagacggagtcctgctctttcaaccaggctggagtgcagtggcgtgatctcggctcactgcaacctccacttcccgggttcaagcgattctcctgcctcagcctcctgagtagctgggactgtgggcacacaccaccacacctggctaatttttgtatttttagtagagacggggtttcaccatgttggccaggctggtctccaactcctgacctcaggtgatccacctgcctcggcctcccaaagtgctgggattacaggcgtgagccaccgcacccagccaaacttggttatttttaaaggggccacaggttgctcaagtgtctggatgacccctgcataacctaaaacagcctctcagtccagcccctggctgcacatccgttcacgtctcagcacgcagaagcatctttgcaatggaccagtggccctgggtgacctcttaaacaactccaagacccacagtgagatgccaggcgcctcagacctggctgctcgcttgactcccctcccatcggagcagctctggtccagttccatcaagaacccacgggatccacacagactctgaagtccgccttccttcccagttccctcctcccctgtcccattggcaacatcagccacagcccttcccttcctctctttaccactggcttttctcaaaggcaagaaattgggcttagatttataaacacatccttgaattcagaacctaatggaacttgttcccgggaaatgtgaaaagagagaagttcaccaggtgcctgctagctgctccgagcggggctgggagcagacacagacactgaacaacgtaagctttcagtggcaaatcaccccggagccctgcggttctcaatctgacagctgctgacttgctgctgtcggggaaccaatctggagtgagaattggggtgcagagaaaatccgtaaacttagttgctccctgcgctatgacggatccatttcccatcccaggtgaaccgcagctctgcgtcctggttgtataaggagactactgcatcatctctctaacttggaataaatatgcagatttcatccaaattgtctacagaagacaattttacataaaaatgttactgttgaaaagttttttcaaatgggaaaatgagaatgataagaacaactacgtttaagcaagattggcccctggctcaagagactgaaggttctcgtttctgtttcccaacaccactgctgacgcagctcaagccgcctctgacatccccgctgtccggtggctctgcagtgggagggggcagagcctgtctttgcggatagagaggcctgggtctgcagtcggggaatgctcacctccggggccacgaaattggccgtgtagcagggtgtcatgagcagcccgttccccgcgcgcagctgcttggcaaagccgaagtcgcagactcggatggattctgggctccccgactcatccctgtacaggatgttactcggcttcaggtctcgatgaacaacctgcaagacagaaggcacagtgcctacttgggggctgaggactgagcaggagagggagggcaggtgcatttggaggggagggtgcatttgggaactgtcttcctagcaggtcctgcaagcaggcaacaggccaacagtgtcaacagctgctgtcttctccagagggccccccaccttctcccattctcctgtggtggtcactcacttctgagctcctggtgtcacctgcttttacagtgaatgaatatttgagtaaataagtgagcacctctccaagttgaggccgcagcttactggagctgtcacataaaaggaaatgtggtgagctctggagataggaatgaaaagcattttaaagatgatattcattcaataactactccctgtgtgcccacccccatgcactgtgaggtgttggagcagcaccagtgagcagcacagatcaggcacctgctgtcctgggtgcagcaactcgttggggagacggaccagggccacgcgatcatgcagtcactctgcaatcatgctctgaggcctcccatggaggactgcgctggctgcaatgatggtggggccagcacacctcaaagcaaagcagctatttagggcacaaagcaatgtgttctgaggggacagagggccattgtgaggacgtgtggcgtgcctttgtacagcttggatcctgaacatctcaattgtcctaatgaaatccagtgggaggatgtagaagggaattaaagggacacactccagcagtcaggcctggtttacagaggtcctgatggcaaggcaatcaaagactgtggctttacttccattacctcccctcattaaatacaagcagatctgcagaaaacatcatccaaagggcttcccctgagtttgactgtactgggaaaacctggaagtaagtgcttaatgctcaagactgggtgaccacacagaaaagaccccagtgtgtggtcctggaagaatattcccgtttggagatgactgcattctgaaaactcaggactacgcacacagctggctaagacagtatttcctgcttcaggagaaacactgggaagagatggcgcacagaggaaacatgtgatacggtgcagctgcctccctgtgaggccagggctgggaccaagagcactgcctggaaccagagagtgggagtccaaccccactggccacctactcatgtgtgaccttggccaagatactcaaactcctgtgcccctcgcctgcacagtgggtgtgatctagggttagggagtcagtgaatgaagagcttgaagtgcagcctggatcacggtgaggcccacgtgaacctcaggcatcaccgtcatccctgcctcagcgtccctgcgctccggttaatgaattctttacccgttgcaagtaacgaaaattcttaatttcttttgattaaggccaaagtatttttttggctaaagttggtaaaaatgattttagaccctcaaagggtagcagagtcagccaccccaaaatatgctgctttggcataaggattatttggagctgaaaacaactgaaaagatgcagatataagcaaagctctctgccctccccttctttacctaaaaggaggatataaatgggtaaaggtgtccctcctgtcctctctgcctggaaggatggaagggaaactcctctagatgcttacagcctggagaagcttccagaataatctctataacaaatgttcctaactagccctcatcttctgttagtttcccatagacttagcttcccacagtctgctgccttagaaacacagtcctttttctttgtcttctttaaaaattattattctttttaaaatttaaaaaattttaaaatttgagctcttttagggctcctgaaggaagcactaaacatggaaaggaacaacaggtaccagccactgcaaaataatgccaaaatgtaaagaccatcgagactaggaagaaaccgcatcaactaatgagcaaaataaccagctaacatcgtaatgacaggatcaaattcacacataacaatattacctttaaatgtaaatggactaaatgctccaattaaaagacacagactggcaaattggatagagtgtcaagacccatcagtgtgctgtattcaggaaacgcatctcacgtgcagagacacacataggctcaaaataaaaggatggaggaagatctaccaagcaaatggaaaacaaaaaaaaggcaggggttgcaatcctagtctctgataaaacagactttaaaccaacaaagatcaaaagagacaaagaaggccattacataatggtaaagggatcaattcaacaagaagagctaactatcctaaatatatatgcacccaatacaggagcacccagattcataaagcaagtcctgaatcacctacaaagagacttagactcccacacaataataatgggagactttaacaccccactgtcaacattagacagatcaacgagacagaaagttaacagggatacccaggaattgaactcagctctgcaccaagcagacctaatagacatctacagaactctccaccccaaatcaacagaatatacatttttttcagcaccacaccacacctattccaaaattgaccacatagttggaagtaaagctctcctcagcaaatgtaaaagaagagaaattataacaaactatctctcagaccacagtgcaatcaaactagaactcaggattaagaaactcactcaaaacctctcaactacatggaaactgaacaacctgctcctgaatgactactgggtacataacgaaatgaaggcagaaataaagatgttctttgaaaccaacgagaacaaagacacaacataccagaatctctgggacacattcaaagcagtgtgtagagggaaatttatagcactaaatgcccacaagagaaaggaggaaagatccaaaattgacactctaacatcacaattaaaagaactagaaaagcaagagcaaacacattcaaaagctagcagaaggcaagaaataactaaaatcagagcagaactgaaggaatagagacacaaaaagcccttcaaaaaattaatgaatccaggagctggttttttgaaaggatcaacaaaattgatagactgctagcaagactaataaagaaaaaaagagagaagaatcaaatagacacaataaaaaatgataaaggggatatcaccaccgatcccacagaaatacaaactaccatcagagaatactacaaacacctctacgcaaataaactagaaaatctagaagaaatggataaattcctcgacacatacaccctcccaagactaaaccaggaagaagttgaatctctgaatagaccaataacaggctctgaaattgtggcaataatcaacagcttaccaaccaaaagagtccaggaccagatggattcacagccgaattctaccagaggtacaaggaggaactggtaccattccttctgaaactattccaatcaatagaaaaagagggaatcctccctaactcattttatgaggccagcatcatcctgataccaaagcctggcagagacacaaccaaaaaagagaattttagaccaatatccttgatgaacattgatgcaaaaatcctcaataaaatactggcaaaccgaatccagcagcatatcaaaaagcttatccaccatgatcaagtgggcttcatccctgggatgcaaggctggttcaacatatgcaaatcaataaatgtaatccagcatataaacagaaccaaagacaaaaaccacatgattatctcaatagatgcagaaaaggcctttgacaaaattcaacaacccttcatgctaaaaactctcaataaattaggtattgatgggacgtatctcaaaataataagagctatcgatgacaaacccacagccaatatcatactgaatgagcaaaaactggaagcattccctttgaaaactggcacaagacagggatgccctctctcatcactcctattcaacatagtgttggaagttctggccagggcaattaggcaggagaaggaaataaagggtattcaattaggaaaagaggaagtcaaattgtccctgtttgcagatgacatgattgtatatctagaaaaccccactgtctcagcccaaaatctctttaagctgataagcaacttcagcaaagtctcaggatacaaaatcaatgtacaaaaatcacaagcattcttatacaccaataacagacaaccagagagccaaatcatgagtgaactcccattcacaattgcttcaaagagaataaaatacctaggaatccaacttacaagggacgtgaaggacctcttcaaggagaactacaaaccactgctcaatgaaataaaaggatacaaacaaatggaagaacattccatgctcatgggtaggaagaatcaatatcgtgaaaatggccatactgcccaagctaatttatagattcaatgccatcccgatcaagctaccaatgactttcttcacagaattggaaaaaactactttaaagttcatatggaaccaaaaaagagccgcccgcatcgccaagtcaatcctaagccaaaagaacaaagcttgaggcatcacactacctgacttcaaactatactacaaggctacagtaaccaaaacagcatggtactggtaccaaaacagagatatagatcaatggaacagaacagagccctcagaaataacgccgcttatctacaactatctgatctttgacaaacctgagaaaaacaagcaatggggaaagggttccctatttaataaatggtgctgggaaaactggctagccatatgtagaaagctgaaactggatcccttccttacaccttatacaaaaattaattcaagatggattaaagacttaaatgttagacctaaaaccataaaaaccctagaagaaaacctaggcattaccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacaaaatgggagaaaattttcgcaacctactcatctgacaaagggctaatatccagaatctacaatgaactcaaacaaatttacaagaaaaaaaaaaacaaccccatcaaaaagtgggcgaaggacatgaacagacacttctcaaaagaagacatttatgcagccaaaaaacacatgaaaaaatgctcaccatcactggccatcagagaaatgcaaatcaaaaccacaaatcaaaaccacttttcattaaaaagttaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgtggcactattcacaatagcaaagacttggaaccaacccaaatgttcaacaatgatagactggattaagaaaatgtggcacatgtacaccatggaatactatgcagccataaaaaatgatgagttcatgtcctttgtagggacatggatgaaattggagatcatcattctcagtaaaccgtcgcaaggacaaaaaaccaaacactgcatgttctcactcatacgtgggaattgaacaatgagaacacatggacacaggaagggaaacatcatactctggggactgttgtggggtggggggagggggggagggatagcattaggagatatacctaatgctaaatgacgagttaatgggtgcagcacaccagcatggcacatgtatacatatgtaactaacctgcacattgtgcacatgtacctaaaacttaaagtataataataataaaattaaaaaaaaatttttaaatttgagacagagttttgctctgtcgcccacgctgaagtgcagtggcgtgatcttggctcattgcaacctctgcctcccaggttgaagcgattctcatgcctctgtctcctgagtagctgggattacaggtgtgtgccaccaagcctggctaatttttgtattttcagtagagatggggttttgccatgttggccaggctggtctcaaattcttgacctcaggtgatccacctgcatcagcctcccaaagtgctgggattacacgtatgagccactgcatccagcaaaattattgttcttttgttaaaatgctatataagctcaagttctaacaactccttggagttattcatggctgggtgctcccgtgtgtatgtgagatgcacatgttaataaacttctgtttttctcttgttaacctgtctttggccagtcttgtttatagggcctccaccgaagaactaagatgggcagagggaaaaaagaatttttcttttctttttttttttttgagatggagtctcgtcctgtcacgcaggctggagtgcaatggtgctatctcagctcactgcaacctccgcctcctgggttgaaataattctcctgcctcagcctcccgagtagctaggattgcaggtgtgtgccatcatgcccagctaattttttttttgttgttgttatttttagtagagacagggtttcaccatgttggctaggctggtcgcgaactcctgacctcgtgatctgcccgccttggcctctcaaagtgctgggattacaggtgtgagccactgcacccggctgggaagagaatttttcttcccttgcaccgtcactgagcctccagacacaagagagacgatggtggcacggaaggaattccaggacaatccgcgttctcagctcttgaacccataaacccttgtggttttggttcctgccctgaagctccctcctccccgaaggctgccccaggcatggctcctaccccctgggaatggaggtagtccatggtcttggtgatggtgcacaggacgtcactggcttcgcgctccgagaagtatctctgccggaggatgcggtccaggagctccccaccacgcatcagctccattaccaggtacacaaacttgccatcatcatagacctgcggagtggagaaggggcgcacacgtcaccacggctggttgctgtgaaagagcaactactccagaggggacaggagagggaagtcagaggggagaggctgggaccacagggtcctatgggagtgcaaacaaggcttctgcagggtagaagcaaatggccattcctgtcataccatatgtgctctttttaggaagaaaacggctttaataatctgctgctaagcagggactgagtaaggacatacaagatgggcgtgtccttagctgagatgaatggcttcatgactctgccaggagatatttgttatttatttattattattattttttgagatggagtctcgctctgtcacccaggctgaagtgcagtggcgccatctcagctcactgcaacctccagctcctcctgggttcaagcgattctcctgccttagcctcccgagtagctgggattataggtgcacgtcaccatgcccagctaatttttgtatttttagtagagacagggtttcaccatgttggccaagctggactcaaactcctggcctcaagtgatccgcctgcctcagcctcccaaagtgctgggattacaggcgtgagccatagtgcctggcctgccaggagatatttagacgttaagaaatgcaaatgttggcaaaccaccttgcaagagcagggcctcaaggcagtgcttttcaaactgtaacgtgcatccaatccaatcttggggatcttgctaaaatgcatgttctggtcctgcagactgaggtggggcctggccctccgcatttctaaccagtttcccatgatgtctgtgctgctaccgcatggacagcactgagtggccaggcgctgggagcacagagaggctaggcagagtccagggcgaagttacatatcagagccgtgctgttgcttcagagaagcaatagaaaaagatagttttctccatactggcttttatctcataaactaaataaaaacaatatgctctgattattctttttatgtttcgattttttgagatggagtctctctcagttgcccaggctggagtgcaatggtgtaatctcggttcagtgcaacctccacctcccaggttcaagcaattctcctgcctcagcctccggagtagctgggattacaggtgtgcgccaccacacccggctaattttgtatttttagtagagatggggtttcaccatgttgaccaggctggtctcaaagtgatctgccttcaggagacctcaagtgatctgcctgcctacgcctcccaaagtgctgggattacaggtgtgagccaccgcacccggcctgttcgggctattcttatgccaagcttgcatgttaagaccgtttgcacgcagcagtcactatgcatgagggaaactgaggtaggcccaatatcctgtgactctaggttcataatgctagaatcagtttggagttggagcgtgaggaggaaaattgtctcctgtctgtgctcccggatcccaaaccctgcacccccatgggcctctatgagagactccgcctgtggactgtaattcacacaagctctctcttcctctgttttacttgctccctccatgactggggcggtggctgtcaaaaagacttgagtacacagtccagcaagtcagctccaagtgactgagatatgtgggtggtggaaaccagctgagacaggcatgagatgtgagaaagcttgctctgagtgaatgggagttttgtgtcagttgaagaaacagaaggaagtggagatgctgttgcacggggaccactcacatccttgagggtgatgatgttcgggtgctggccgtaccgcaggaggatctcaatctcttccgaggggtctctcttgctcttatcaatgatctggaacaaacacagcacatggcagtgaggggtctactttaggctttcgggtggtatctgctggtggaccattgagtttggataaagtctggccccaggtggcccaatcactacaatctcacacccgaccaagagataacctgagattgtctggagattcatggcaagtcctttctttgacaactagtgtaagatttacatctacaaagaggagtacaggctgggcaaggtggctcatgcctgtaatcccagcactttgggaggccggggtgggcaggtggcttgaggtcaggagtttaagaccagccagcttggctaacatgacaaaacctggtctctactaaaaatacaaatattagccagacatggtggtgtgtgcctgtaatcccagctactcaggaggctgaggcatgagaatcacttgaacctgggaggcagaggttgcagggagctgagataatgccactgcactccagcctgggtgacagagcgagactctgtctcaaaaaaaaaaaaaaaaaaggagtacaagacttcagacatgaattttaaggtgttataaggttgggtggagacacgtgtagggagctcatgcaagtgccaccaaataacagactgtgtcccaccctcgcagtgggcaccatccacaacaagcctccagccactgtgcaccttctgccttgttccgggaattacaaaccagccacaaaatgaggtgaggcgcatggctctcaccaagagatgctggggatggtgcgcaggccagacctgccttgctgtttagacatatgcaagctcccctcccccgcccagcatctgtatccgatgtcttaggataacagataaagttgcttcaaccccatggagacatatggtttctgaggacagggtgttgggatttaagcctaccttggaaacaggaagtcgctgttggtccctggtggctaatccctctggaggtgcctaagtcccgcccttgccgcccctgctgtggggacgggaccagtgggaggagggcaccacactcatgggaaattggcaacatgcaacatgtattttgcaaacaacactcagagcagaagaaaagcgattggaaacaccttcctaaccatgatttgtactattctcacattagttcaacctaattttaaaatagtctctatttggagaccgtgcagtcattttactactagaatatgagggtgacttgcttttaacttctatcatgtcaaagtctctaggcagagctttgcataaaactctatttcgttaattttttttggagacagggtctcactctgttgcctaggttggaatacagtggtacaagcatagttcactgcaacatcaaacccctgggctcaagtgatcctcctgcctcagcctccagaataactaggactacagaggtgtgtgccaccctactcagctaatttttaaattctttgtagagatgatggggtcttgctgtgttgcccaggctggtctctaactcctggcttcaagtgatcctcctgcctcagcctcccaaagtgctgagattacaggcatgagcaactacacctggctatttctttactttagagaaccaaacgcttgggtagcatttgactcactgctcataatctgtcccctggtcacccttcgtccactccccgtcaccgttataaaaactcaccatagtgccagttctcaccccattatagtttcaaaggatgctctgccacggccaccattcagctgtgactgcatcagtggcccatgatctgtgagtcctaatagcctgcgttgtaaacaggcagaagagttagggtccctttctggacatagaatttctctccttctgctgcatttaattctactgaagttttagctaggacactaggactaattctattgccaacataaatgcatcattctcaagtagagacttttaaaacgatcattcaaggaggggtgggggactttccctaacatgccacagcctaagcaggtcctgggaggctggtcctgcactgcttgtagggaagctggctgtcaggtacccaaactcctctgctcctgtctgcctgtgggcatcccgtctatcggggccgggatcctgtctttgcaattagagaaggttaaaatacatttataaatttataaaagaattcagtagaagattttttcgcaaatatgatttcatgataaagggatgtgttcttagcatgaatctgttttatcactctcacagtggaacaagatgcagagtaaacaagaaagtgggagctttttctccaccgccacggaccatcttcaagatacaaggagtaaaaaaggccgacgcgagcaggtgcatcctacgccatcccttgttttaaaaatggagagaagaatgcagatagacgcatccatttccttgtgggtgcataaaataaccctggaaggaaggaggaaacatttaattgccttgccttcctgtgaggaggggaacagggtgcctgggggcccatgggtgggagggaaactttgctgtatccacatgaatttttaaaaattttgaaccacaagaatatattgtctattcaaaatatgaaataaagaattccaaaatttcagcttactattttgtaagctgaaattgcaggacaacgtgactattattttaaagaatctgggactacagatggctgccctctcaaccctagtatctattttatttctatgtgttcttttgttgtgagtcttcagaaaaattctgacttacaatgataagtatttgtaaacagttttcaaagacagattaccttaaactcttgcttactttaaaaactatcttaaattgtaataaaagctagcatgtatgtgcacatgtgaggcacactggatttcaacccatcggagccagtgtcctggtcatttgctagaatctgatacacatttaagcatgcatgttgactttcattacattttcaacatattagttacgcctttcaaaatcatgtaattgcttggtggaacccccaaagcacctctgtcaacaaccaaacaccacacaccagctgttcgctgaggtggcatttggggaaatggaggaaaatgaaagaagctcccaggctgaggtcctgtggggacaggagctcatctggaggagactccaaggggcccacgagtgctgctgtttctcaccacagggtagagccagcggtctttcagcaaacatctggtttgctcctgaggggaagtcacgtttgctgtctcaggcgacaacactgctgtgggtgtgggtggcttggcctgtggccatgtcacttgctggtacttgaatgtgggtgtctgcaggctcagctcccgtggagggctggaaaggtggaggaaggcgttgctcctggggaggccacgtgctgcgtggttggcggcccagccgctgagccagtctgagccccagctgagacctggcctccctgtccactccctgtggggttgcaggagctccctgggcctctctacacctagctttcttcatctgtaaaactagaaaacaccaggcactcctctggctcactgttaagattcaacaaattaatatgaatcgatcccttcatactctccctggtacacagaaagcacttggtacaagtgagttattcctattacagagataaaatagaattaccctgacaccgccaggcaagggactaagcagctgtgacctgccacgtttacagccctgaaatgctgctttcggtcctgtctgaatcctcactgcgagtccgtgccatgaagcagtgtgatgtttaaaactaatgtcagcagtagagcgtgtttcagttaaagccccagaaaaaaaaaaaaaaaaaaacctcagatgtcacaccaactgggtcaacccagaggccttaattaaaggatcgtttgcaaaggagtagagtggctggagggtcactggccggccagcaaggcacagtgtaatgccttgggggcagtcctggctctcaatgccaaagagctgcgcagggtcagtcacaggaccagaaggggctgcatggggtggggaggtgcgccctgacaggggctgtgggcagaaaggcctcggcccgacacttctcttcccactcttgtcctgtggtgtctgtctcgcactagcagaactgcccaggagccagaggcatggaagtggtccctaacagtcagcctcctggcttccttgcctcctggcctcccagcctctgaggcacagggcagcgaggagggtgggtttgcatgggaaatggcgctccccgtcctggaagggaagtcccacagactggggtctctcctgcctcagcctcccgagtagctgggattatagggcacatcctggaagggagtcgtggcgggaataggttctcacacgaccctcctgggctcccgccttcccctgacccgggagaattaatccaaatcaagccaaggctctgagatgaagtggcaaggcagttctgacccagcgtttccgtcccggatgctgtcaggaagtgctggctgcttttccctgtaactttttctgaaaaaaaaattttttttttttgcttttgtttttatttttgcatggagggtgagctatttgagcaaggtaaggctggagagtgctaacgcaggagtgggcagtgaggtgtggctacagtcctggagtacatgacctggatctgctgcgggcagccggggtttggacacactgtttaggagcaccagggagtgggccccaagtgcctgccagcgcacttcttctctatggggtcggtttcttggggttgaccgtgttggtcttactcttattagagcaagctctggtggacggcgttcctcattctgagaataatattgttttataatctttattatgcaacaaaacagggaggccttctcagcaagcgtggtgatgaacaaggcctcccctccaggctgacgctcaaataatgctgacgcgccacggagtaggagtggtgtcgtggggcgggggacaagctcgctcagctttctttttctcatctggcaacagctggttagaaaggactcctacaacctccagagaagggcattctccaggggttggccacccaccacagccggtaaataaactttccatggtgttgccaccgagcaggctgaatatttccaccttccttagagatgctgagtctaggggtctgaatatccacgaagcaattctgggttcaacatggatggcacaccaccatgatcttcctgagcacggacacatgcagccatgtgccaaacaaacactgccattcctgctggccgaaggcgacaacaggagacttcgctgctcttgataacacctttcctcctgctggccgaaggcggcaacaggagacttcaccgctctcgatacacctttctggtctttgcgtttctctaccttccctgtctttcttgtctctctccatcagtggagacaccgtctcccgggacactcagcaacctgagcagatggctttgaggcagtaactacgcgggcagtggcatgagctcacaggcttgcagaacactcccactaggcaggccatttcccttgagttgccgaaaggatcagtatcgtatttgacacaaaggtaggagagcatgtaatcatttgtaaaatttaacagacaccttctcctgtaaaattaatttaaactaatgacagagagaaagaactcctgttttatcctggtagaaaaagttaaaatttccaagctcatcagttctccttctaaaaataagctctattcatgccgaacatctgtcttaattccgtttctttttttggttggcaaattacacacacagtgtgaagatgggcacagaaacaccacgttcttttcaacggtctcacgtgagtacagactggagcctcctcaggaaggctggcccgcgctccaggcctgcgtggtcacgccgcgtcactacagttaacagctgggtgacacatattcttgcacagttctaaggatctcactttatttcttatcagattctgttgctaaagcaaactaaggtactttcaataccataacaacaaaaatttgctaccgaaaagggagagtagctgcatcttaactcatgtgcttctttctaggaaaacccagccccactgagcttgtgcggtcttcttctcctgcacgagctttcagacaattgaagggaaatttacaagtgcaacagtcagtgaacaggcacgtatattggtaccatgtgtttgaagatacaacaggccaagagaaagagccaaaccaactgtaaagctcatttaatttcagattccggagatgcactccactttttggtatagtttctggttctgtcattgacacaattcctaaatggctaagctgtgagctccctggagcaggtttgtgttctcaccttgccctgcgtctgttgcagtaaaagcgtccaattaaaaaaaaaaaattctcaatgaatgaaaaaagtaaccagcttcctgaacaaggggattgctgcagaaagaaatggattccaaaggcacgaagtgctctgttgaagaattatattataaaccccgattttaaaaatttgaatttgaaggaaagctcctgattcatattttttcttgtctttatttttaattaattaattaattaattatttgagatggagtctctctctgtcgcccaggctggagtgcatggcacaatctcggctcactgcaacttctgcctcccaggttcagatgattctcctgcctcagcctcctgagtagttcggattacaggcacgcgccaccatgcctggctaatttttgtatttttagtagagacggggcttcgccatgttggccaggctggtctcgaactcctgacctcaggtgatccaactgccttggcctttcaatgtgctgggattacaggcatgagccaccgtgcccggccatatatttttcttttaatcaacacttagcctttcactaccaaatatttatgctaaatgaagataaggagccccttcattgtgtgctgaaattgagtgagctcctgccatgtgcccgactttgttgaggtgctggaactatagcaaaagcaaagcctttgttgccctggagtggctgccctcacagggccgtgcacacagacagtgaacaacccatgcagggggaacgtgccatagggaagatgatgtgggtgaggggggctgctggctgcaaaagatggaggcggggaactaaaatcagggcatcctgtgggctttgggtgcatatttgtgttctctggttggtcctgacttggaagcagggacagaacttaggaagctgtcagtcattcatcaagtcctggccatgtggggctgactgtcacagaatttatagttcagcttcctgggctgtcactagagatagcaatctggcttcctgcaagcctgacacagctgctggcctcccgagctatgtattgtagataaaggggctggctgcaggtgtgggtcagacttctgtcgggcacccagcctggccaccatctgctgtgtatccactctcagcccccagagcccgcggaaggaaccagccttggggacactggactttagcccagtgagacagatttcagaattctgacatccagagctggaagacaataagctcaggttgttttaagccactagatgtggggtaatgtgttgcattcctaaacaataggaaactagcctgtgttgaaagaccggggagaggtttgcagtgggagagttgagagccaagttttggctggtgggtgggagcctgtgagatgggctcggggacccggtagtgggcagaaggcacatgctacatcttattgctgatgaccgtcctccgccgcatgcctgctgggaggggctgagcatacgagaaacaaaaccataagccaatcacattaagcctttctcgtttcgaaaaagcaaaagtgcagctcgctgccagcgctcatttgattttacataaacatgttcattaaggctgaaacaaatctgattttccatgtgaaaataaaatttaaaaactgttactggagttatttctaaacagaactaatatcagaatcatctgaatcatcagaattgtctattttggaaaaattggattcatcaaatgaatctttggccaacaactgtttgagaacgaagttaacatcccatgtaggaatgctacgttttctaggatttgacattatcagcaatcgattatgactatattttgtaaatggaaatgccactactaaaaacagaatgctatcgatagaatgatgtcctttgtttccaaagttggtatactagagcggtgcaaaaataataataaaagtgagatatttcgcggcaaagttatctcggggcaaacgctgcagccgcaagtgccgccggtgagtattcttggggaaaacgggcaaagggttaaatcatccagaaaggcagcttcccagtgtgtgtttcgaggagatacaaatgcccaaccaattccactgaggagcttctttgattagagaatgcctgtgcagagacacaggctggacagagcatctattctggcaggcgatacagtcattttcccgtcttcgagtctctctcttctggtggaagagaaatttatgccaccgttttcctcagtcatgcaatctgttaccaaagctgccccgtctccttccttgtccatctaaatgttgctttctttcttttctattttctattttatttaactgctcctagtcccggcctctgtgcctgtgaacgctcctttctctgtttccactgtggctgtgaaggcatctacagcctctgcctgtctctgcaccactgctgttcttgagatggttcatgttgctccttcacatagctcaactctcaactgctgtttctctttgcttcaaattttcacatgatttctatgaaaaatgcattttgatccctaaagacaggactggcctggacctctctcttcccaggtttggccacagtggtttgactcagctgcacagccacctctgttccccaagacgggtgcagctaacaccccacgtgatactgggaagccccatggtgaaaccatccactgctttctcaatggcttagaattctttgcaggacctggcactggatcctctggagtgaacttgaacacaagctcccctgagtcctctccttctccggccccgtgcggctcactgcagcgcccagcgttaggccatgggctctttcaagatgtagcttctgcaacaagcccaggtgctgccctgaggacgagcaggctgtgatccacaggagccggggctagtgctgccagtgacctcggagcacagactgaaaacagaggtctacatgaacgcagaccatcctgaatgctgtggggaaggaagctggagcagctgccgggggccgggggccgggaccctggctaggggcctcgcagctgagtgctggaggaaccaggtgcactgtgcctttggaggtgaagttagaggaagcggtccggctgccgctcagcacttacacagctgaaccatggcccacttggtggcagcaggacctttcactggggtacacccagactcataagaccaggagactcaggtgcgattttacatagagctccacttgcacctggcacaccttccccttacagcctagggactttggctatttatcaaacaatggatttttcttgcaggtcccatgacttgagctttccagctattctgaagcccagccttactgcccagccccatctgctctgaatactgcctcattctttcatggtttgggtactctgagatgcatagagcatctggctgaaacagaacactggggctccccgccttatgacgagtgagtctgctggacaggggtcgagagtgtgcactcggggtctgactgcttggacgggaacctgctctctcactgaccggctgcgacttctcgcatatgtgttgaaccgttctgagtttctgttccctcatggggataatgaaaataattacaccgtgggatgctgtgaggattaaatgacttcacacatacagagcgcttatagcagtgcttggcacgtactgagtatgaagtatttactctcgtcatcctcgtaactctcgtcaccatattctatctaacgcctgcagctcctggtctcaggaacttcagttctcgggcagtttcctcttcatatgtgtactgacgttggtgttttgcaaaagagggtcaaggtggcaaaattggcactcgaatgatgtaatgtagttttatgcctattatgacatctataataaataaaaacttcagtcattagtagagatggccaagagctctctcaaggtatgtgtattaagcttatgagaaggggagatactagtgacacaagctaacatttctgtagtgaattagctatgatatgtgtagacagttgacccttgaacaacatgggggttagaggtaccgacccctcaagaagttgaaaatgcacatataacttttgacttcgccaaaacctaactaatgtcccactgttgacttaaagctttaccagtaacataaacggtccattaacacatattttgtatttgtataattatatactgtattaagaataattatacaattatatactgtattaagaatacagtatataattctgtaataatacgatctagaggaaagaaaatgttactaagcaaatcataaggaagagaaaatacatttagtgtatgggactgtatttatggatatagtgagtttatgccatctgttcacaagatggatcgtctgtctgaaaaggggggcactcacagctgcagacctcaacctggggtacgtatcatgcaattcaacttttgttttttttggtcatgtgatgacttttctctgcctcttgggagcactcacagcgtccctagtggcacgggacttcttagtggttctatggtgttattcaaggtttatggaactgcactaaacacggtgaaaaatatgtgagaaccacaagataccattttttactgctattcccaattccctggagagacagactcctcacatggagacgaggagtgtcacaggacgtttaaagcggatccttccaacacctgagcttactacagcagcaatggaaggctgctgtgaaattcttacggtagtgccatattcgccacagttaatttgctgcagctatgatttaatgctgaatctatgtttgtttacatttatctcaactgcaaatggcgccacgtatggtctatgcttgagcacataaattttgatacattttaagtttgtataataaatctgtgtatattttatagtagaaaatgataaaatagactagcatctatgtatattttatgcatcctgacataccattttcttaactttttaaatatttctaggctatgtggtttgtctgtgagtttcttcaaattgtaacaaatctctaaaaaattttccagtatatttactgaaaaaaatctgcatacgtggatcctcacaattcaaccccgtgttgttcaagggccaactgtatatatttacatattcccccaccaatataatgccaggaatccttccatttatacaaatcagcactatctagaatatgtacctaattatgttaagcaacaaagtcctaagaataaaataaaaacaaataattccctctctcaattcttataaagtgaatacagcatctttgatggaataggaatattattttttctttcaaatacacctctccccttccttttaatcctcctggatcacgattacctccaacacttaatagtcacttctattttaatcttattttaaatgaagggtgccctaatgtgcggacagcaatgcagccatccgtcatgctattttgaagccctatacaacttcatcgcccaccactagtctccctgggttggttataaaaacaaaggcggactttagttttccattagattacttagctgttttgtcccaataaaatggcttgtagttattagaaagtagggcacatctgttcacctacaatgtgtctgataaaaggaagaggaagcgctgagggaacataatagcttttctcattcaaccatcagagcactggctgggggcaccggcagaatgcgctgcatcaagtccagcctgaaacagtgccgtgcgcgtgagaaggaagagggtcggtgtcttcccgcccgaggccggactgccccagtgaaggatcttggacgttctagtgttgtttgccgaagtcgagagggagggacaagcctgggaatccaggttgtcattcagcccacgtgaattgagcccctgctctaagctgggcactgtgttggagactgcgatagctagaattggtcttaattttagtcctaattttaggaccgattctagctgtcacttcccacaacctttggcagagtacccagcatatagcagggactcaagttaaaaatgcagctgaaaataaatgcaaagtgaacaatcttgtcgtttgatttactcaggtaaactggtttcagtagaaccttaaatgtagtttacgttattcagggtaattatggtggcaaaattagaaacctgcaaaaatgcagaaataacttaaagcaaaatataatgatattctaagaatgtgagaagtactatgattccatactcactatgaacctccatacctgaccgtcatagaggtgaagagctggccccactctcctcttagaaggacctgcactttaagtcacggcccagtcacagtggggtgggggtggggggctgcccgcagcacgtggggaacactgagctgttggtcggtcatcatcctgttgctaaaggactcaccagaaactcaatgaagaagaaaaactccatccccatctccaaaatatcaacctcctggcctttatctacatgagacctgctctcacccacaaggatgctgaggctgggcttctcaacctttcgttggggcagcaggttgtgggggctgtcctgtgcacacaggatgctaaccagcttccctgacccgtattcaccaatgccaggagcccctgtcccagctggaaaaaccagaaagtctccagacattgccagtgtcccctgggggccacagttaccccaaatgaatatgactgccctgggcagaatccatcgattctggtcactctcctcattgcttactaaagattgctgcatttctctttctgtcattactcggtggggacatttctgggtcatccctgccattgaatgggaggatgccctgtctggctgtgacgggactgcttctgaagcagaccccgtttgtatccatgagccaggggtaggtgggatcgtatacggctcaagcggcaactgggagtggtaaagccggattctagtgacaatctcggctggacatctgctgagctgagatccaactcacacatcagataatcagctgccacatgcttagttctgggtcatgttagaagtcaccgaactttgctgtttcttagtccatcaataggtggggatgctgcttctcatgaacaagtcagcagatacagacaaaggccaaaagtatttcaactacattccacctggaaatgctgaaaacaaaaccgcacagtgctctgcactgggtcaaagcagttttggtaacaagtggacccattctaaataacaagctcgttgcacagaaatgccaattcgtccatcttggaaggaaatccaaacaaccgtgtctacctgcagataattgaacttgttgtcaccgctcccttgaccggctgaaacgtgcttctgaagtggctctggtcacaggagccttctggaccacgagccacatctctctaaaaagtcccgggccgttcatggggctgcaccttcccgtgctcggttaatttatgcatcttccagactacacattattacccactgtagtctcagaagggacaagggaaatccctgccatgtctgctggccaactttgtccagggaacttcagggtttgtgaaagagaaacaggaagaccgggctctttcttctaccatcggccagagccacagtgcctggcttctctccccgagagctgttgctgaaattccacagagtttgacctcaacaagatctttgaggactgacggactgagtttaagctgtgtaacaaagctgaattcagacagtgtccatataagagctggatatgggaatattaggagaaaacacaccatcgcctcgtcactgggggatttacttgcagaggcacaaaatgggggctgatccgcaggctgtttctggaagggcaccgcggctgctgggctgaccaaaccgtaggcttgtttctttgagctcactgggaagcagtgattgtttctgggattgctgtctgtcacctggtaaataatctaaagaaatcctgtgagcaatgactcaggcagaaaaaaattccaaggagcctatgtaggcttacgaagcacatgtgaaatacgtttcaaagtacaagtgaaattctcttgtctaaggcagaatacaggtctgctcttcaccactggaacatctggacacaggaacggcacctgggtatgcagatggtaggcgcccatctaagtgctcctttaaaaaactctcccaatgggatggaggagcaggacaaaccaatctcaacaatccaaatcctagaaacgcatgaagcctacgcgccccaggctgcagaggcaaccacttcataacaaaacttggttttctcctgcccttcacaccacgggtggacattctaccatgacagtaaccctcgctgcagtctccacccaattacagttccaggaactgtaaatcatgatctatttccttccattcacccttcctggatgtgttcaagactctgggcagactaaacacagagatggtatcagagcaaatcacaaattgattatttctccatatttaaactttctttttttgtttgagaaattcaagataaatttgtcaataatccataaattcttgacccaaacaaaatcaagggacctgagattttttttcggctggcgtcttctatgacagcaaagcgttttcccagtgcaagaaacacggtagacgttcccagtgaatatgcttgaggatcccaggccatgcttgaggatctacccttttgaaatacctgttttcacaaaatgtcagtggagctctgggcaaatgaggatggaactgggtcatctcaacattgtcattattttgaacaatctcttcagagtgtaggagaatcacagttgatgaaaattactctttttacacgacttgctggctgggcagatgttctttgaagggcaagcgtagcaccgtgtgctacagacgtgtctgggaataagccgggagggtcctggtcatgatggcaacacaggctgggacctcgctctgcgacagcctggggtttggctccactggaaaggggcagagtttcaagtgtctcttgctgtcttttggagaggatgtacaatgtatctttttttaacataaatttcattctgattttagcaggaagctttacctttaatccacattttactaaccaaaaatctctagaaactggtattctggattcccagatcaaatatttaagcagcaacaattacgaaagctaaagttactatgtagagattgccaaattgggttacaaagaattgtttctctatactgttcttgacggttgggagtaaaaccattagctctctgccaaagtttgttgtaagtaatacaagcttatttatttctttgagtattttcttcctcccttttttctttccttcctttccttgccaaattctatacctgtcccccaactctgttttctcaaaatactgggggcccaaaacttttgctcttggtgtatgtcatacaccaagctacgaaaggtgctcagtccctgcgtggtacatatgactgaaaatattcatgatttgcaaaactaccttttaatgggtgacctcatatcaaagcaaactgaactccatcatatcagagcttggaaaatggcaaatggagagaatgttcactcaggctcaggtgtccctgctggagtcactgcacagctgagcacgtgagcacatatgctgtgctcctatgctccgtgctcccatgtgctgtacatgctcccacacgctgcactcacacagggccctgctatgctcctatgctccgtgctcccacataccacacgtgctcccacgcgctgcactcacacagggccctgctcactcagcaggcctgccttaccttcacggcatactcggtgtctgtggctttatgcacacatcgcttgcacactgagtaggagcccaccccgatgtcctccttgatctcgtagccatcggtgaagtggatgttgttcccgtgtaactgctgcagagggaccaagagaagaagagttgtcggaaccctcacacgaggggacggtgcagctacacgcacacagaatgtggggcgaagagaggcaccgactgtgaactgagtgtgtggaggcctgggagctcatgggtccccctgcccaaggctgcagagctacttagtgatgttcttgacctaaatgccagcttctctgattccttgggctatgactcttaactttgagacaccaggccgttctgtgtccactggctggtatgtttctcgcaaagatctgagagcaggagaatgtgaaagtgaaaaggaagtgctggcagctgctgggtgcgtggctccaatgcctgtgtgcagagcaagactctggatggaaacatctcatcggaaatctgactccatggtgtccaagtcacagcctgctctgacctgcatgcagcagccccacccacccgctcttaactaagacagaaagccaccatggcagcctgcactgtcatgacaacgtctactttacacacctgtatttctccaaaggccagggaaggaaataggatggaaatccaatgccattcaacttacccggatttcattcttaaataagtttaatcataattagaattaagtttaaccccttagaattctctgtattctggttacatttattaggtgggaaactcattatgaaaataccaccttccaaagacctcccaaagattccatttcatcatgggaaaatgatgcccacaaattaaactgctaccctagggtcctggctgggctccacacagtgaagatgctccagtctctggccatagacaccatggtgacattcttcccagggctttaccttccctctttaagacgaatgccaagtagggtaggagcaagggctcagaacaccatggaataccaccacggagaccattacagggaccaccatgggagccaccacggggaccaccatgggaaccaccacagggaccaccacgggacaaccacgaggaccaccatgggaaccaccacgcggaccaccatgggacaaccacgaggaccaccatgggaaccaccatgacagactaccacagggaccaccacaggaaccactacagggaccaccatggagaccaccacagggaccgccatgggaaccaccatggatgtcacctaagggaccaccacaggagccaccatgggaaccaccacagggaccaccgtaggagaccatcatgggtaccaccggggaaccaccatggggaccaacatggagaccaacacagggaccaccatgggaaccaccacagggaccaccagggagaccaccatggggaccaccacaacagggatcaccatgggaggctaccctagggaccaccacaggaaccaccacgggaaccaccacagggaccaccataggagaccatcacgggtaccaccagggaaccaccacggggaccaccatagggaccaccagggggaccaccacagggaccaccatgggaggccaccctaggcaccagcatggggaccacgacagggaccaccacaggagatcaccacagggaccaccacagggaccaccatggggaccaccacaggaaccaccatgaggaccaccatggctaccaccccagggaccaccctgggagaccaccatggggaccaccagagggaccaccccagggaacaccatggggaccaccacaggggaccacccaagggaccaccatgaggaccaacacaggaggccaccatggggaatatccatgggagaccaccacagggaccaccccagggaccaccctgggagaccaccatggggaccaccacagggaccaccacagggaccaccacaagggaccaccccagggaacaccatggggaccaccacaggacaccaccatggggaccaccacagggaccaccacaggaggccaccatgggagtatccatggggaccgtcacagggaccaccactggagaccaccatgggggcccacaatgtgagaccatcacaggaaccacatgaaggagcaccacgtgagatcatcatggggaccgccatgggggataaccacgagggaccaccatggcagacactcagaacaatgggaagtgtgagggaagaattggtgattaaagtccacccatcctaagcacccaacccccgggtgactgaggccacagggaacaccagagtcacccatcatccaagtgccctcttacccccaacccactgcaggcaaacacagttacctgcacgattgggtgaactgggactttgtgcagatcttgctgtgagggctcctggatcaggcttgaggccacaaagctgaatcctctaaacaggtgatgagcgtttgcactcggggggacgccaggagagtctgtaggtgacaggggcagagttcagatgccacgaaagctgggtgaccctggggtgaagtgatagtgtgtgtgtgcatgtggtatgtgtgtgcaagtccgtgtgtgtgtgtgtgtgtgtgtgtgtgcacgtggcgtatgcctgtggtggaggaaaaggtaaaacagacatgtagaaatgctgaaccagatgaaactacattcttttggcttgtgctaatggtttgatttttaaatggcaaaaatacccagaacaaaaacttcaggattatcattgatggcatctgttagtttgccaacttctgaatttactctatattcttgaccacactcctccacccctacccactccagactcagttaagaaggcaccaatgacctcaggatggaattgtcagtgaacatgaatcctgtatccttagcttctggtctctaggttcgacaggtcccacccctgtgcccacagctgcataactgcatgtgtgctgtgcacgtgctctgctctccaaggacatttgggcaacgtttctcctgtccacagcaaggcatagtacgaaaggagtaattcccttccattaagatttttctgatctctgtaagatctgtgttcaaaagcatgactgctgtgagattgatcccatttcaagtttatcattaagaaaaacaaaaggataaatccctcgtggggaaaaaaaatctgcatcatacataacagatgagaggttaaactctctattgcccgaaagctcccagagatcaatgagaaaagagcaaaatactcaaaggaaggaattctgatagctaccataggcatgaaaagatgcccaatctctctaaggagtaagcatacacatatttaaataggacaacacttttgtctaatgaactaacaaaaatgaaagaaatcaatcacatctgggtttggctgggggtggacacttataattgtaggagggagcataactggcataatcttctggaaagtcaactggcaacatttaaagccaactttaaaatttcaaaattaaaaattttgaaagtaattctacagaattactttcaaaagtgcacagtaataacaaattgtagatgacgcaaacaaatggaaaaacatcacatgctcatgaatcagaagaattaatatcatcaaaatgaacatatcacccaaagcaatctacagattcaatgcaatctctatcaaaaaaccaacgtcatttttcacagaattagaaaaaacaatcctaaagttaacatggaaccaacaaagagcctgaatagccaaagcaattttaagcaaaaggaacaaagctagaactagaagcatcacattacctgacttcaattatatcacaaggagatagtaactaaaatagcatggtactggtataaacatagacacacagattaacggaacagaatagaaaacccagaaataaagccacatgcaaagtcaacaaaaactttgtggggaaaagacactcttttcaataaatgataccgggaaaattagttcgtcataagcaaaagaatgaaactggacccctatgtctcaccatatacaaaaatcaactaagagattaaagacttaagtgatgaaagacctgaaacaatgaaaatactagaataaatcctagagaaaactctttaggacatgggtctagcgaaagacttcgaaagtcttttaagggctgggtgcagtggctcacacctgtaatcccagcactttgggaggctgaggcaggtggatcactaggtcaggagttcgagaccagtctggccaacatagtgaaaccctgtctctactaaaaatacaaaaaaaattagccaggtgtggtggtgtacgcctgtaatcccagctgcttgggaggctgaggcaggagaattgcatgaacccgggaggcggaggttgcagtgagccaagatggcgtcactgcactccagcctgggcgacagagtgagactccatcacacacacacacacacacacacacacacacacaaaaaggctttaagaccagcataagaaatcatcaacagaatgaacagacaacctgcagaatgggagaacatatttgcaaactatgcaactgacaggggagtaatatctagaatttacaaggaactcgaacaactcaacaacaacaacaaaacaaataaccccattaaaaattgaccagaggacataagtagacatttttcaaaagaagacatacagatggccaaacagcatataaaaaatgctcaagatcgctaatcatcagataaatacaaatgaaaaccacaatgagatatcaccttacatcagtcagaatggctattactaaaaagtcaaaaaaataacagatgttggtgaggatgtggagaaaggtggtgggaatgtaaattagtacaacctccatgaaaaacagtacggaaatttctcaaagaactaaatggaactatattcgatgcagcaatcccactgctgggcattgcccaaaggaaaagaaatcgttgtctcaaaaagatacccgcacttggaagcttactgcagcactattcacaattgcaaagtcatggaatcaacctaagtgtccatcaacaggtgattgggtaaacaaaatgtggtacatatacgcaatggaatactatttagtcataaaaaagaatgaaatcatgtcttttgcagcaacatggatggaaaagaaggccattattttaagtgaaacaactcacacgtggaaagtcaaacatcgcatgttctcactcataagtgggtgctaaattgctaaataatgtctgcatgtggatgtcgagtgtggtgggatagagaatggagacgtggaagggtgggagaaggtgagggatgagaaattacttaatgggtaaaatgaacactcctcaggtgatggttacactaaaagaccagccctcaccactatgtactctacccatgaacaaaactacatctgtacctctgaaatttacagaaataaaaaataaaacaggctgggcgcggtggatcacacctgtaatctcagcactttgggaggctgaggtgggcagatcacgaggtcaggagttcacgaccagcctaaccaacatggtgaagccctgtctctattaaaaatacaaaaattagccaggcggggtggcgcacgcctgtaatcccagctactcaggaggctgaggcaggagaatcgcttgaacctgggaggtggaggttgcagtgagccaagatcgcaccactgcactctagcctgggtgacagagcgagactctgtctcaaacaaaacaaaacaaaaaaacaagcaaacgaaaaaatcccaaagtacttagacataaatgtagaaaaagtctgtttcagtgatatgtgttacagaaaagaaaaaggagacactaaatactcctcactaagacaatcatggtcatggtcaacagtggcccatctgtatcaggatgctttgtaatgattgcagtgtgagtcctgccagcgagaccagggccatcagaaggagccacagttgcatggactgacagagacgtggcttcctaatcgtttgtcaaatcaaaaaagcaaaaagctgttgaacaatatgaagaacccagacattacttaaaaaattaaatatattttaatatatttaaaaacagaataggataatagattaatatattaaaatagaatatatattacactaaaatagaatactataatacattatataatatgtaaatttataatatatgaaaatataatacgtaatttttcctgaaaacacacatatgtacaaatttaaacattcttatttatatatcttttaagactccctgtatgtatagttgtgtgcatatttgtatattcgagaattctctacccgcaggcctttgtctctcagcacttcttccccccctcgtctgtttaggtgctgtactttgaaaggaagaaagtgcacctagttctcagttttatctccacacggtgcggcaggtgtgtgggggtgggaggcagctgcagagaacacgtgttttgtttcttagcatcatattttggggacaacggttatgagggcagccgctccgaagcccaggagccgggccccacgccgcgtgggcctctggtgcaagcgggggccaggccgtgggcagatggacgacgcagcgtcccactggtgctcttcctggggtaggaagcgtcatggacccgggctcatcttcagtgtcctgaaccaagaggcagctagagccaggtgtcggccctcaaaggggccaaaaaaggggccttcacagtcaccccaggtagatgcccacgcgacccctggactaatgtgaccagagtcggctgtgtttggaaataaacttccaacgctccagactagcgaagcgtcgttaaaaaaccgaaggtaccctgagtggtttttagaaactgaaattctgcagcgcgacccggcagagaagctcggggctttctgagcggctctgcttcgcggcacacggagccgctcgaggaggaggcgctcctgctacacccggtttgctctctgcacaaagtctggctttgaggtctgcctcctcccaaagatcccctgagctaccacgggccgcagattctcccccggaaaaatgaaacacacatggctacatcatggtttaagaaatcttcaaacctggaggcactttgatgtcttcccttagggatttagactcagagcttgagcttattctggggaatccgcagagccacacgagtgtgaagtgctgagcaaggattgggagtccaatttacagcctgtggaggagtgtgtgcgggggtgggggcacaggccatgttaacttgacagacacagtttcattggtgaatggaaaatctgtaattccaataagcaatgtcttctaaccaaccaagaggcacggaagacacagccacaaccttccgtggccagagaacccatgcctctcctcacacagaccaaggagagcctgcggaaagggtaaaagtaacagcaatttaccgaaggccaagtggatcttcaccaaaagttaagaggctgacatttggtcggtgtggctagctagtaaggaaatgacaggtggcctaaatagaatttaaagcactttataatcacctgagggatgccgattttcagcacagtatttaagaagagcaaaattgtgagtcagataaaaggagatgtagaactacagtaattacaaacaacctctcatggtcctgtgggtatttcctgatttgtggagtctgcctgatcggtttaaaatcttagattggcatctcgggctaagcagcatgctctagggggcagccaaggtgtgatcagggaatagaaaccagcttgagcgctggctgaagtttcagaaaagactgaaagcctaactgtaagaaattcccactgtgagtccaggatctaacatagaggatttgtagcttatccattgcttcagagtcacatttctacagctgctcattcacccagccatgtgctcagctcacatgcttagaaaatcctactctcctgtacaaatcagaatgagtttaatgtgtctttagcacttcaattactacctacctcaaaggcaaacagtggtgtgataaattaactgaaactgattggagaactggaaacactaaggaataaaaaaggcaattctgaatagcactggagtgcattgtgtctaattatgttttccttaggctattattaaaatacaatggaattctctagaagctcaaaaaaagcttccggttccactggccaactaggttggggtttaaattcttcacagataagataaaaggcatgtccatatgaatattagagttgactgtattaacattttcttaccaagcagcacaaacatagactttctttccacattttaaacacacagccccacatgttggcacctcacgaggatgtgtgcacgttctgttagggaccttatggtccttgtggacttagggacaacgatctcgtggtcagacctaattgcctctgagctccttttacattcaggccaacaataggtggagaaatatcatgacttgcttgggtgacctgtgggcaggggcaggagggaatccccaaatcctgccccatcttttcaaactcagaaactgaaaagtaatcctgttctgtgaattgggttaagtttgtcaatgggaaggaccaaccccaacacacaaatactttctaaggaagctgagaatggggtgaggtgaaaatcccacagtcacttaccggagagagcagacccagaagtgttctccaaggcagcctcattacatcatgaatcagtgatgaaccaaagctataatgatagttttaattctacctggggactgcaggatgacccaaaagaagtaactgagcagccggtggcatgactccctggtttacagtgcccggaatcagctttcttcctgttcttggtaccaatgtggcctgggtcaggagctggcctaggcccatcaaaagtcccgctaaaagccccgcaaccctccctatctgcacacgctcacaccctcctcaatgtgttcatctgggtatatgggaaacagggatttcaccaacagctgaatctggaggaacaaagtggattctctaacttcatctacctgacattttgtggttgaccatatatttgtttcccgattatcttttaaaaaataagaaaatttcagattcaaaagcagcgagaaaaaatacagtgaatccccgtagatccaagatgcagcctggccaaccaccagctccctggacttgtcccacttatgtctacagaaggagcttgtggatggttttgtacataaccagcatactgttagtgttgtggactgaattatgtccttcccaaattcaaatgttaaggccctacccccaagtgtaactgtatttggagacagggccttgatatggttcagctttgtgtccccacccaaatctcaggctctgtgtccctacccaaatctcatcttggagccctcataattcccatgtgttgtaggagggacctggtgggagatgactgaattatgggggtgggtctttcctgtgctgttctcatgatggtcaatgagtctcatgagatctgagagttttaaaaaggggagtttccctgcacaagctctctctttgttgccatccacgtaagatggggcttgcttctacttgccttctgccacgattgtgaggcttcctcagccatgtggaactgtaaattcactaaacttctttcttttgaaaaattgcccagtctcaggtatgtctttatcagcagtgtgaaaacagactaatacaggcctttaagagaataactgaagttaagtgaggataaaagtgtggggccctaatccaagaggactagtgtccttataagaagacagagagacaccagagctccatcttgctgtctttgcacacacagaagaaaggccacgtggggacacagcaagaacacagctgtctgcaagtcaaggcgagagctctcaccaggaaccaaccctgtcagtaccttgaacttggacttccagcctccagactgtgagaaaataaatgactgttgtttaaaccacacagtctgtagtattttgttatgatagccctatcagaccaggataattaccatatataaaaaagcagactttaattcattaatatcccaaaaagataacttttaaagggagctgaccagttctgatgaaatttgctagaccccaagagtaatttcagacacaccaggagaccaaatctatgcatccaattgctgtgctatttagtagccgatactacttttcaaatgggtttctgttttttgcatgaataatatctatagctcataaatctatagacataactgacagccttccctctccgtaaatgcactttaattgaaagagggattttaattgcctccagtttcttttcttgctcttgctgtgtgtctctctgacacaggaagtaactggaccggtgtcttggaataaggataccttcatcatttccaaggtggaggttatatagggaacaacagagaactggggctatcacttaaacctttatcactgagcagagaaaacaacaacaaaaaacccaaacagaatggacagttattttccatgaaaagaattctgaggcatgggaatttcttgttcctagatatctgtctctaaggggtcaggtgggagaagccaccgatagagggaaccactgtggcacacacctgtgggcgtccgcgctgtgaactcggggtcaaagtggaaggtgtcctcaggcctgcccactgctggtttgaacggtggcttgatctccttccggtacagcgtctattaatacaaggaaagcaagacagggcactgaggatgcacagacattgccacagaacactggggacagagaaacctgctgtggggagggaaggatgttcttatcacagactgcattggccttgtggattacaagggatttctaaatactctgaaatatagatggcataaaatatattatgtgtagtatgatagatactatggcatatataataacgatgtattatagaaaggtatagaaaaggcatagtttgaggtatgagggtttggggacatgccaagtgttcttcattttagggcaatagttttctagcttcttcttggtagtagaatcttcttttccaagtaaaatcatacaggacagccaccacttgcccccactggggacagcagtgaagaggccgtgtggctctctcctccctgccctgggactttggggccagcaccacggaacttcagctctgcggggcactgcaaaaaccgccgacccagagccaccccagggtgctctcttgccagtgtctcagggcctgtgctctggggccttggcacctctgccagaaacctgccttgggtgtcagaatgagggcgcccaggctcctcgacaggaggacgcctgcatctgcagagaaccggcccttcccatgccccctctgggcccaaacttatttccccaacaggaccttggacagaaggcacagaaagtccacagccctctgtgctccggtctcagagctgcctgcctgacaatgctttccaaagctgagatgtgttgttttcaatcctctagggcaacaaggcattctgttgggaattcaatgtaaagaaagcacacacaggtacctggaacctggcgtagtcctcaggcgggtgatgctgcaggtggtgcttagatggagggagccgggggagcccagtgctgagagaagtgtggagggggaggggcactggagggaggactggggcctgaggcctgactggaaggccgagggacctccgggcagattcagtagaggatgctgggtttagtcaaatcaccctgacgacagaaggcacgggccatgccagtgtgctgaggggccagcctggtagttagcagggcagcagcagggcagggccaggctggggtcttgccccccactgagcatggggtttccttaatcctgcctagggagggtccccacggtgttcgcagaaaacatccagcctggagtcctgtcctgggcacttgtgtgtgaccatctagagctcagttctggactcagggaccctcatggccgtgcagctctggaaaatggacacagtgactccagctaaaacctgttctacatctctggaaagcaaatttcaacacctcctccgatgaggcccgacgggaagggagaggagggaggagggcgtctgacatctgggtcccacctggggcacaccctgctctgcttatccgggagcacctgggtcagagcccaggccagaaaccagggcccacagctactgcaggagggcgaggtgccaacagacgcccccgagctcccccgggggcttatcaggcagcaggatgtgccctgatgtgcaagagctcagggcgtgcacgcgggaaccatcggaggagaaacaggattgaattcagccctgaattatttgctcatttcctgccttgggggcatagatttcattagcaccgagttactcttcaagccattttcagaaatgaaaagacgctgctttctgcagtgaggcacaggacaggtgggaataatctccccagacacatgtgcttgcctgaggaagtctcctgagctgggaagcccaggccatcgggtgccacgaacaggccagtgcagcccattccccacccagagagtcctgagagccgggctattaagaatcctgctgaagtcaaaatcacatcctccctctgtgtgagagcaagcgagggagagaggtggagagagagagagagagagatggggagagatggggagagagggggtggggggagaaagagacggaggggaggaggggagaaatgggggagggggaggggaagggggtaagaaagagagagagcacgcactagctcgatccagcacagagccaggcctcctacttttattatgaggaggaatttatttacacaagagatttccattaaaaacaaaataaaatacaaaactggttgtcacgtattcattccagtgtgaagtgtttacctccggaaagcaggggcccacatggcccctctagctcctctcctccgtgccagctcttcctccatcatcctggggacccatcttgcccacccctgcccctgccccaccacagcctctgataaaaccatccccagagcctggtgcccagtgcttcttcatagaggggttttgcccccactgggacatttggcagtgcccaaagacactgctggctgccacacctgtgtgaccgctgcaggctcccaaggggtggaggccagggtgtgcagaacccagccacccataacagccccaccacacagcatcgcgcaggtgccacccagggtgaaggtgggagaccctggccctgcctgcttccttctctacctcacccttcctgccttgtttctgctccaaccctcaaaagtgcaacgtcaaccagcttcttcaagaaggaggactggatgttgaggcgactggccactgtccttggaaccccttcccctccccatggaacccccggtggggcagggctgcaggctctgcctggcttcctacaggccacatccttctccctcctcgtccaccgatggggcaggcaccacagcctcgcttcacagctgtccaggaaagcacaggctctatctgtgaccaccctgcctctggaggctcacatccagaggctgtcaccttcctgccttctaagtcagattcacagcccagcactggtactgctgtgacctcctctgggctgaggccatcccactcctttaatactaagtatctgctgctaagtcaggtcccggttccctccagcccaggacactgcgcctgggggctgggctcagacttcccctgtgctctgccccatctgtgcctagcccggtgctgcgagtcacctgggatgcccagtgaggaggtcctaagcccaggtagtcccgtagcacttttgtaccacacaaatagctccccctcacacggcagcaggaggaagcccgcctctgctttccccgtgctttccacccctcggctgtgagcccaggctttcagctcacagaccccaacaagaccagagggaggcatgcgtgtgagagtggacggagcgcttgctgagggccagggccttccttctgtgccgcgggagccttcaggcaactggccaccccgtaacatgggtccgtgtgccaaccgcagctatgaacacagcctgttcactggggcctgcagaccaccatgccccacctgctggaggctgctgcgttctcactctggtctgggccaggcagtgaggttctgtgcgggccgccggtggccaactggagccggtcactctggccctttggacggcttcctcgaggcttgctgcaatcttaaaggccggtcaatgtcttcctgatgctgcgtaaacatttggaaggtgctaatatgtgttattactgtgtatgctttttctttccatgtgcaaacctaagaacgggtttgaggctttgggggagaagtcatccggcctcttgctttgtatgtaaaccactgtaggcagggttgtgttgagagtgaaacagcagcagcatctcacctgggattctgagcttaacgagacagacactggcaattctgccctggatcccccctttctgagactctgggacaattcatgccgaaaccgacgagagaaaatgcagtctcatgatcaaattcgccaggcacatttaaaatcatctcatttgtcccaggatgtcagaatgacacagtgtggccgcagggctgaaacgaatttcacgggaaacaagcgcacgtgaggaagcccggagcaggcccatcaggattctatttatactaaagaccttcagctaagtgagaagaggaccgagacagcaacagaaaaacgggaactgggtgatgacataggaaacagatgctagtttggggtctcagaccctaacatctgccttctgtagacggttttggcttcaggcattttggaattaatacgctccaataaggcaaagggcacatttatagattattcctaaaataataatgcaaaaatatgcagaccagagagaagacaggatcgaaagcgccgcaggaagaatctaaacgattttcaaagcgtcacgatgggtgtgacaggtcagtggctcatggagcgggactgtgcctgcagtttacccggctgtaggtgggtccaacagaagaagcacctgaagggtgatgattcattgcacagagtccttgctgggttccctgaagggggagtgctcctagtgtatataatgtaggaataaaaggatagaaatctcgctgctggcaatgggagcaacagctgcatggagacgcctgtgctgtgaggccctgacccgcagcctacagctcccacacccccaaaccactctctgcgccatactgcaaatactccacttgtgggcaagaagaccaaagtggcctgaagacccggaacccaccctctgctcctgccaggacacacaacagccaagttcagggcacaccccacgcgctgccagatcaccgagcgacctcaagcttctcattgtcctgtgcctcagtctcctctacaagtttctcccatctcacagcatcacagctaatggtgtgcttggaagggtttcaaactgtacaaagaacataaacatgagctactagtattgatcatgaataacgaataacagtaataataagagtcagtgcaatactaagggtctaggccctggacagagttccagaaacaaagatgtccctccctggtgactgtgtgtctccagcatcatcattcactgcctgtaataatatttgcagttccctgggtccccctgcaagggacgccaggctgggctgggagccgtcctcagactggcttgtgctgtctgcagtgattaacttttacgaagctttttttgggttcgtgctaattctgtgttctcagcatgcttcagccacgggggaaaaaccaacacagcttctatctgctggactctgccgtatcctctgcagaggtttgtagtccgatcattaactcgtggcttctcactcagctcatcaagcagagctggccttcagaaggaatggctcccgtgcagacgttcactcgctcatctctgaagctaaattaaaaggcagcagcccacacctccaccgtccccacacttactgtcagcagatgggtcctgctccagcaggccactgaagaccccggggacagcagtgggatgacaggtgtttacttaaaaaaataaataaataaataaataaataaaaagatctgctggcagtatcggatcacagagagcagcagaaagcaaaataaatatcctaatattttcccagttggatcctgaggcaagccattgggtgaagtacccaggcagaaatctagtggttaggaaatgtcttctcattcgtcattaaggagtgtctgcattgcagagggaacggcttttggtgttaacagttcttgcaaatgaggctgaactgtggttttcagttttctgagctgccgaaaagcagaatgggcacatctggacaaatacatcacggagtaaaattaccccttaaataaatacctttaaacatcttgcattttagcccctgctttctgaagaatgggttgatggcttgcctggatgtgttattggggtttgaggttagccatgaagacacatgggctgctactggggccgcagacacaggagaacacacgggcaaacttgactcatgagagaggatcagctgagatggggggaccactggactcatcctagcaagatgttgacagcttctaagaccatcacggagcgggactgtgcctgcagtttacgcggtgtcctgaacacggtgttttcatgcctacacatctttgctggaagcatccttcttctcctccttctgcccctctgctggttaattccactcgccctctttcaggcatcatttctctctctttctgctggccactttcactgtgcacaaacctcttccatcggtggatgatggcgttatgggacagcagactcctcagtctgtgagcagctggaggacggggctctgcgttccagctgtgacgtcatggacatggacactttgctggtgcaccaccagggtgagcaccaagcgttatttatcaaatgcatgaattaatgcaaaagtggcatttctgagctcttctgccactcacgggctgtgtgggttcagggcgctgggcagaacaagagcctgccattcctctagcactgctgcctgccttcctctgggaagtacagacatgaaggaaacacgcctggttctgatcaatcacaaggacctctctcaaaacgaaaacaaggccaaaataaaatcaaattaagtgctaagagcaacaaaaggaacttctcagctctgattctagtctgattcctttgaaatcacgcagaaatgccaccttcttgggttgtgtttgctttccagccacagggagaccagagcaccctgagcagaggcgctgtgtagagaaggctcttattgccacaggaaaaaggcggcttctgctcagagctcgccggacctcagcattctggaatgcacattaatctaatgtgtcatagttttccaaatccatcgtattgttaaaattccaggcatctcacaaggttgtcttagcaagtgcgtaagcccttctgggccatgcatactttggagtggctccactcttggctgagtgctctgtgttgcactgtgtcacctgggggttcggtgtgaagagacttctctttcctaccagctgcagccctcagggtctcccatcccaggatgctgccctgcccacctgcagctccccctcccagcccagcaatcctggttctccattctcccaggcatggtctctggaggaaggactagagtgtgagagtgaggaaatggagggggcaagtctccctcgacagctgtgactcctgtcttgagagtctcactcattcattcactgattcattcactgacttactgactcattcactcacttattcactgattcactgactcattcacttattcatttgctcgttcactcactccctcattcactcactccctcactcactcattcactaactcactcactgactcccttactcattcactcactcactcattcactcactccctcattcactcattccttcactcactccctcacttgttgactcactcattaactcactcccttactcattcatgcactccctcactcattaactcactcactcctttactcattcattcactcattcattcacttcctcactcattcactcactcattgactcactgactcattcactcactccctcactcattcactctctaactcactccctcattcactcactccctcactcattaactcattcattcactcactcattaactcactcactcactcccttactcattcactcactcactcattcattcactccctcactcattcactccctccttccctcactcatccattcactcactcagtagggattcataaagtgcctcctttgagccaggccctgttttagagctgtgggatacacctctaagccacagattcctgatcttgcagcttacattctagtggcaggagacagaaaataataatatacatcagaaacacatggtattttgaggcgagtcagaaagtgataagggatatgaaaacagagcaaggccgggggctggggtgctgggagaggagctgcagtttggaagagccgcaggacaggtctcataagatgacactgaatggcagactggaaggaggagaccagtgagcccttgggagacttgggcaggaggggccctggaagccagaccagctggagccagtgcttggggggaacctgttccatggaggcatgggaaggaggctccgtgaggatgggaggggtgaggtgtggctgtcctgaccactttcgtgtgcttctccatctgtcccctgctgcatcctccttgtcagcacagtgtcctcctgtgacatgtgcagacccatctgtccaccgcctttctctgccaagtcatcacaagacccacgggtgcaggactttgttccatctacggctctatccccagccctggaaagtgcctgagactgggacgcccagcagaaagggctggataaatggagaagcagatcatacggggagaagctgtgtggtcccaccttaaccactggcaggcaggggaggggatgcaacatgctgtgaccccctgaggggcaggcatctgggttccaggcacagtgctgtgctaaccatccacaggctgacacccaggtccattcttcatgaaacaggcttgcctgagatctaaacgccgtgtaaggtgaagtctccatagaaaatacattccaacgcagagtcgaatgacagtgaccttaggtgcccatctgtgaggtgagcacagcctgagcttctgataagcctaaattttcagggaagctaagtaagagactccaaagggaggccttggttttcatttcttggaggtcctggttgggaggcacagatgtcctgaaactttacactcttttctctaatcttactttcgaaaagaagtctaatcttacgaaagttctttagtcagaactgtaaaactaggttttaaaaagttatcactcttccccagtttgagtgctttgctggggctcaggctgaaggaagaggagagctggctggttttatccagcactggtgttacacattcccagaggagaggtctggggctgcaggtggggcccacctcttaatgaaatgcgtggaggccccggactccatgaggacataaagaagacagaggccgggcgcggtggctcacgcctgtaatcccagcactttgggaggccaaggtgggtggatcatgaggtcaggagatcgagatcatcctggctaacacggtgaaaccctgtctctactaaaaatataaaaaaaattagccgggcgtggtgggggcgcctgtaatcccagctattcgggaggctgaggcaggagaatggcgtgaatctggcaggtggagcttgcagtgagccgagatcgcgccactgcactccagcctgggcgacagagcgagactaaaaaaaaaaaaaaaaagaagacagagaggaaagcgaaagcagataataaactctatactgtagagggcatttaaatcttaaaaagtgttccattaaaatcttttgaggttaatttgttaggtcaggaaaagaaaatcccaacatagctgtttttgtgttaacctaaaggaaagagctgaaagcaactgataggaaaggaggtatcgccttcctcagatggaaggaacagcctccgagttttagccgcgagaactccctgtgtgggggacgcgtcagacgctgactgcttcaccattcggagttggcgtcttggcagaaataggcaattgacacttgtagcttggtgaaaagtgagatacgagaacttctcagacaatgtccagcctggcccagagaactggaaatggaggctttaccaataactccactaacagaagctccagtttattccaacaactcggcactgttgttttttttttttttttttaaatgtgacttccacgtgggcatcagcttgactaacgatggaaaatgcagtatcgaatctgggcctgcccatagccctagcactaaagggtcctggttgagcagcttgtcatgacttttgtctgttcagcccttgaggttagaagacagtcactcctggagcaatcgggaatatgcagggctcggagaggccggggagtgggtgcagggaggacagaagcctcgactctgatgggcagaggagagtagaaggaggaaagctgaggggacttcaggcctcaagctggagggaggggcactcacgtgtctgtgcctcccaagttgccagcccgctcagcagggtcctgggggctccctgcctgcaggtggcttgtctacattcacctccgacctacttgtgacccggacactgaggaccctctgcaccaagccgtatgttccctccacccacttctgtgtcacgcgtgtgcaggtggggactgtggcatgcaacttacgttccagtctatggtcacaaagaagggatggcgcttaatttcctccactccgtcaatgccagcacctgtcaacaacacagaaatgatcatcagaacaaatccaagatggggttctctgacagtttccaatgcagcagtgtggagggtggggatgtgcagaggtggggccgtgggaaggagcccagaggctgctcactcctgcccaaggcacctgcgcacctgccgatgcccccagctcagaaagccacgactcagccccgagggcttgtgaggcagaggtggcctggggttggagtgagcaaaagaggtggtcaagagaagcatgggacaggccagccaggtgctgcctgctgcatgtgacggctgcctagcaccccactgtcacccccaggagcttgaggtgcctgtgagtgtgagcaccaggtggacctcccaggaggccggaggggaaggtgcagagcagagttcctggcaaagctgctgcagttaacccgggagggaaggattccaggaaatgaagaggagttgacaggactgagtcccggaggaagccagagcccagcctcctgcccacacctggccacccctgagcctgctcagacaggtgactgtgtttacctggaggctgcttacaaatatctctgctttgttctgttatttctacctaacctcctcccttactttgttgcgtacaatcctaaggccctggggcagaaaggaaggagggaggagtaggcggagcgctgggggccctttcaggcagcatgattccctaacggtggatacatgtccactcatctgccagaaatcgccactgtccccccagaacgagcccagtgtggacaaggcctttagtcagtagctcagctcaccgactgcagaagcgtgcccattcacggaggcactactgttcgggaaagcggtggggcagggagtgaggggccgtggaatcttgctgcagtttctgttcagtttttctgtaaacttaaaactgttctgaacacaaagtctattaattaaaaacaaaaggccctaaagctctaggactctgtgttttctccaggatgggacggccacagaggagcccatcctcccgggtcacgaatccgagaagaggcgggcttggctggaaggggcagtggcggcggtggctggggaattcctgccagctccgggcccagggctggggagggtctgatccctggggcccggctcccctgttctgcaagctgtgttcctttccgctgccaactcctaacggctgtgctccaaatcagagcctcctgtgccatgtatgccccttcgtggagcccccctcatgtccagctctcactcctggaagagcggggctgcccggggatgctgtggtcagcacaggtgtggcccggcctgtccggctggaagctggcctggagtggcgcaggtcaccgggagtcacagcagatggtgccatcgttggctggaactgcccgtgtcctgacccctcccacccctccattccgcactctgggcagtgatgtggaggaggctcgggggctgtggtggcctcagaaagcgcctctaggtggtcaacggctcagagacagtccccttaccctggaagcttggccagggccatggtgctaggaacgaacccacatactaaatgcccctgaaggcactctcacagcactctcagctttgtgttattcacactttgacgtgaaagtccatctagaaggaattagaggaagggcacacattcaggagtttctccttccatgaggacgcagaatcataggacagacatagcacacggacatctcagtcatccgatgcacaattgctgttcccattttacagacgaggacactgaggctgacacaggttgggtagcttgttcaaaatcagaccagaggttatgagttacaggtactgggtttggaggcacatgtctgaaaagcagctgaggtgccccaccttctgaagtgtctttcccgaggactccctgctgaggcccctccgggtccccagtctagctcccttgttctcctctaaaccctgagcccagggatctgatcccaggcctttgcaatcgcagcagctggcatgagccttcgcaggcgcaccagtggctgctgtaatgaaatttccagagcgacagtctgacttccaaacagccctccccaagcgcccatcctgtgtgcaggcctcctttgatgatgaccagaactctgggttgaagagtccttctggtcacgatgattaacagaaagaccctcctctgaagtgtgcctctcctctactcttttgtttggtgactgttggacgcatggccagaggcactctcaaaaggctggagattggaacaaacagttcagaggccctggtacacgcacaggtgtggcaacttgttggctgtacttctttggaggatctatttcacattttgtacccactgtatttccttcttgttcatcatttgcaaatatggtctgcaggaattttagaaagtgagaggcagaggaaatacaggtattggtataactactatgtaactggtatatgctgggtttacctggatcactgcaatcaacacatttctatctttacctcctttcccctaaggtagtaagattttgcaccatgtttgtattttaagccctcagcaaaaagagtcaacaggggaataacactttggttatcactaaaaaattacaggggttccaattacagggggaaacatgaaacaggaggaggacttttgcactcagcaccttgaaacctgtgtcaaccctcccagggcagtcaggtttattattcttgttaaaataggtgactttgcactcggctccccctttttatctccactgaacccactggacaaatgacggtgagtggagttctgggcggggagaatcggaaggtatcaggctgatgctggaatcacggctggctcgctacgggatgcggatgacacgcactgaaggccttccttggttctagaggactgctgccactcatctagatcatgaagcactgacaagaacagggacagaaactgtgagcacagaaggccggaattccctcctgtcaggcttagcaatttgtcgttaagttccttaatgcagggcaaataggagttcaaggttcaggggaacagaagattcaagaatcacacttcttctcggtagtaataacacctgatcctgtttgtttaaatggcttgtggtctatctccaaattggggcgtcacctaatgtgtttatctgggtctgtgtctccaattgctgttctctggttaagggtataattttgcaaccagttggaactctcatatcaatgactaaagtgcagtgcagtgcctgtgaatggatttttttttttattttggggggattcattctgtcgcccaggctggtatgcagtggcatgatcgtgactcactgcagcctcgatttcctgggctcaggtgatcctcccagctcagtctcctgagtagctgggactacaggcatgtgccactacacctggctaatattttgtattttttgtagagatggggtctcaccatgttgcccaggctggtgtcaaactcttgggctcaagtgatctgcctgcctgggtctcccaaagtgctgggattataggcaggagccactgcacggatgatttattctttcattgcaccgattctgtccagctcttctactccatatttttcacgaggtaagccattcatttcattgtggggattctaaattctcagcaggtgattcccaaagggttttggtatctgccaaaaatgtgtgcattgtgtctgtatatccacagatagctttaggagatggttaattcatggtttgggactcctttgcaatattttcatttttgttgtttgagagtcacacaaacccatctccgacacttctgggaacattcagtagaatcttactggctgcctccttaggtttcttacatactgcaagcttctcctaaccagcccaccatgtccagcctataaccatccagggcaacttccatcattgacttaaatactaggtctgctttttcaatttcttcatcacttaaaggttatctacacattatttgtttaaaggtttttttttttttttttttggccaatttgaaatttcatctatttcatgtttacaccctttgtcagggagtcgctcgtgtcccacaggactcagccggttaggagtcagggatgggctaggggctcaggcttgagcggtgtgggagtcagatctgcagacaggccctgggcatgggtctctagcggctccctagggctggttgtgagggtggggctgcctggtcttcagcaaccatcaaagcctggcttatgacaggcagtcccagcaatgccagtagaaactgggatgaggatcagaatggaccacgtttgaagtcattaaaaacacatcatctggagatcagttctggacaggaaaacagtaacaagagcaacggaaaacctctgcccgtgcgtcagccacaggcagcaggtgtgctgtgaagacagcacgcctggcttaggtgatgggcgttgatttgctgtgctatttttgtgctcatcagcacatcgaattcctttctaacctttccctcactttaaacttccccctgggagtctcagaatatctcatgagtttctaggagaagctacagatgctcattaggaatgagctagaaagctgtcagctttggaaaaaaggaagatttggaggtaggcttaggaagttttatactcactgcaaactcctgtcctgggggggaagtcgggagataacaaataacaaacactggtgctgaaaaccccagcagttcctgatctcagtgcaggatacatttacagctgtttctagacatcactatggtataaacttccatcagaaatggaactcacttaagtaatgagaagcagccaacaccacacccagggtctagccctacaaagcctgttcagcagaagcatcacccacaaccgcgagcctctcccatctcagccgggagcagcgccaagcacagagggaccaaatgtcctgctgagcctgttcctgcagagcttcatcccggagcctacccgtgatgctgccttggtccgtgcttacagggtgcagtgccgagggcgctggccaggagcccctttctcacctttcttttattctattctttgaagtccctggatttgcaaatcactcagagtcaccgagtcctccacctgggaggcgttttcctcgcacagacaagaaagcagacagcctgagcaggggtgtgaccctccaaggcctctatcgtgggatgtgccccagcctgtggtgcttctgcttagactgggtcaccccatgctgctacagccaccccagggtctttctctaattcacaaccacacaaccaccagaacaacagtgcgaagaaacaagactggtgtcccctcggctgcacccttgagagcccccacgctcaccacacccactgcgtactcccgagcgtggcccggcccctggctgctctgtctcctctccactcacccgtcacccaggcatggggacattgcagagtcacacgtgcccccaggtgtgccattcttccttccttcctcccactactctgcacgtgacgtttcttgggcccagaaggcccctccccccacaccccgtccagcatctgggacatcttctgagacccaacccaggcgtcctcacagagcagctctgtcgcccccactcaaatagatcagtggccccaaaccagtggcctctggaggtcagtggcagtgccatccaccttcctaagccagcacctgctacgggcattcagtacacattcactgaacagatcacacacgaaggcagggggattcagtctagaactcttttgaacgaagacattttatcttcaggggatgtggaggtgggagaaatgccagtcttagactcagaagcctaggagcctggagcaactcacacgggggcagagggccgttttctcacctgcagagtgtaagagaggaatgagatgcgtctgtatttctggtagtctggacatgtataaacacattatgccatctcttccagctgtcaatatctgtgcagaaactctgggaggggtcaactcccccaaatttgtatgctgaagccctaatccccaatatccccaatgtctcacaatgtgaccacatgtgcaaaaggggtcactgcaggtataatgagtccggcatcagcagggcaggcactcatctcctatgactgctgtccctagaacaaggggaaatttggacacagacccacacggaggagaaggccacatggagatggaggcggaggtcagggtgtggcattcacagccaggggtgtcaaggctggccagcaaagccccggggtctaggagcggccagggacacattcctttcagtgggagcacagccctgcagccttgagcttggacctctggcctccagagctgcgggaggacacatttctgctgttcaagctgcccagtttgcagttctttgtcaaggctgccccaagaaactcacacagaggggcggccaacgaacagctcagtgttcactgtggtccgctgggcattagagacgtgtgtttttatccgtgtttctcgctacactgtgcgcacacagagggcacatttttcctttgatttcctaatttctagcttattgttttgtccactgatccctctgtcaactggactgaacggaactgtctggaaatccagaggcttcccgctggtgggggctcattaaggaagaggcaggggtgaggaggtcgagaggcagagagggtcccctctctccctgggggaggccatagagagggagagtctacagctcgaggggactcacactaggggagacaccaagagaggacaggtgggaggcaatgaagacgcatttgctcctcctcccagcccctcaattgggccctgaggtcctgtgtggcgagtccagggcgggagagctctggcattgagagctcttatcagacaggctcaacacaggggcagctggaggtgtgcgattgccttgcatatccatgcgagggcccagggttagaacgaggcctctaacagccaccaattccccagatggtcaaagggagaactcaattccaggctcttttggaggaacgagaataaggctcacggcagtcagaagcagaggtaagttccagccacaaaaccggccgcctgtgcaggtgaaggtgactctgcccagcggggttttcagactacctggctccagctccgcaggcaactaaatccagcgccctccctggataaaggctgggcaattaattctgactgtagcttcttcatgttgagcctgggcatcttaggttgtaaaatacacctgtgggagggtccacagctcctcgaaagcttgatgataactcacttagacacggtttgaagggcgatcttggcccgaggtgagccattctccatgcttgtgtgagcttccagggggctggtatcttttaaccaatactcatctctacacctagggaggaggtagctccatctttctctcatccataatttaaaccaaatactaaaacaatattttaaagaactatgattttagtaatgttaaatttgaagggttttaatttaaaaaataggttatttagaaaattatttgcttctcccagaacaaggggagaaaaagtacaaacaccccaatactttgtcacattcacccaatttactgtagcaaatcctctcccagcaatataataatgtttgaaagaaaatagtgactctggccaggcacagtggctcacgcctgtaatctcatgttgggaggccaatgcaggaggactgctttagtccaggagttcgagaccagcctgggcaacatagcggggccccttctctacaaaacagtaataaactagtcaggtgtggttgtgcatgcctgtagtcccagctactcaggaggctgacgtgggaggactgcctgagtccaggcaactgagactgaagtgagtcatgattgcaccactgtgatcagcctgggcaacagagcaagaccctgtttaaaaaaggaaaggagaggaaacagtgactccaagacaaagcgcttcgattgctgcaagaatagatctgaattgttggctctcatgtacgtttggatgaataaatacgtccagcatctccacttctcctttctgactccaattcgcatttccagggggaggccaagcaggggaggggtgcacagcaaaccctcacgcatgtggccccacaggtggtgactgcggcagctcggctgggcgggggcggttaccatgcgtcacctcagagggagtggcagaggtggggtcgcggtgcctgccacctgaggcggcacgtcccttgcacatatgctcacgtgcttatgttataataagtgtccagatgtcatttgggtgcttgggaatgacaaggcagagactacacagatttccatcataaaagcttggtcttgaaagaggagtttcagccaccggcaaggttcctggcagcaactgtgtgaagatgttaccctctgagggatcagaccccgggcaaggcgggcatgactctgtgctcttgccagggtggatttcccgggtgagcttcgggactctggcattggcctcaatgttcttctggctggtactgcaggctttccatttacccttccattctgcaaccagctcagtggagggtttaacaacatctattaaaatgcatctcacaaaacgatggttttctccagaaaacgctcagaattgtggctcctcggctattgtgcaccagataacgttcctctgttctgtcccacagccaagtggcagagaaagaaaagtgtcagatgagcaggaagcaatgaggccggggggttggacacccttcccggccacaggcctctgcacaccggtgctctctgcttgtttatgtgtttactcgtcagacccattacagtgcttcccacccatcaggcactgctctgcctcctcaaatcctcctacttcacgatgtcggtgctggtattaccctcagttcgtagaataaataagcaagcacagagaggtgaagccatccgctcaggcccacacggccaggaaggggtgcgtggcgtgggtctgagcacctggctctcgcttcactttgcttctgtgccctgccctggactccagcctctcccacacgctcccctctcctctttcgctgctgctctttcttccccttccatcaggccctctcccctcttctgagatccattttgtgcctcatctgcttctctgccctggctgcaggcatttgtgcgcgtctgggctgcagctggccttgctgtttgctgtcagagagcccacgagcatgagggccacactttggcttcacgggtccccagagcctagcccacgagtgagggaaggcacgggccagactgcccattatccactcacacttgctctggacgaaagcacccagtgtctgcccaagagccatgagaaaggggcagcaggcgatgctggggacaggcggtggccccagccacggcgaggtggcagtgtggtcctgcaatctgccaggggggcggccccggccacagtgagatggcagcgtgactcgccagctgcccgaagagcatggtgagtggcagcatggtcctgctaactgccaggtgaggtgaggtggcagccatggtgaggtggcagcatggtcctgctaaccgccagggggtggcccaaggtggggcgtgtgctagcacgtcacagagaagtctctggcatcaaatgtttctccctaaaacaactttttaaaaactgggttttcaatcataaaaataatacatattggcagaaaaagtccatattggcatgaatgaggtgaaaggaaaagctccccttctgcccgtccctccggggagaagcacccgctgtaggagctgcttgcctgtgtttgcagaatttttctttgcttacctcccttgcttccaaaaacacaaacaggataattctgaacgttctgtgctgcaatgagctatttttacttaacacttctttttttaacttacacatccttccatgttagtgcatgcagaatggcctcactcttcagtactcacatagtatcccctgtgtagacgacggtaattcagttaaccgtccctgggtgatgtgggtttcagcttccatatctctctgtgcacttgtgtgaatatatttgaaggatatattatttgaggtggaattacttgggtgaggtgcatgtgctttacttttgcagagatttttcaggttgacttatgaaaagtgggaaaaacacaccccttcacccggaagttgggaaactgctctcccatcgccaacagtgaggattgccaaatgtgtgcctctgtgctaacttgagaggtaaaaatgggctagacctccatgaagacagtaaggacatgaaatatcacgaagaaatgtacaggtactggctgattcgaaagcacaaaaacattcacggaaagcaacaagtgccgaactttcaatagccccttcgtaagacagggagggctttaggaaaaatcttcaaccctcgctagatgttttggacctgacaagcaagaatcttatattccttaagattgtgattttatatatatatatatatatatatatatatatatataatatattttttttttttgagagagagttttgctctgttgcccaggctggagtgcagttgtgcgatctcagcttaccacaatctccacctcctgggttcaagcaactctcctgcctcagcctcctgagcagctgggattacaggcacccatcatcacacccagttgatttttatatttttagtagagatgaggttttgccattttggccaggctggtcttaaactcctgacctcaggtgatccgcctgcctgggcctcccaaagtgctgggattacaggcgtacaccaccactcctggccaatttttgtatttttggtagagatggggtttcgccatgttggccaggctggtcttgaactcctgaccttagctgatccacacgcctcggctgggattacaggtatgagccacaatgcctggccaattttatatacatatctttcttctagtgtttttctaaaccttgatgcttttcgcccaatttttctatagaataaaaattctatataaaattcaatgaaaacaaataagttgggatttttacaaaattctgaaattaagctacagtgaaattctgggaaattctctgcaggaaaagagaataattatacattcattccatattaaagtataaaagaattgagttgtgaattaaaagatagttcatttttcaagtttaaaaggccaagtcaagtactcttatcagaaatacaagcatagctatagggaattttcctgaaaagccttttcaatttttaattaagactgagcaaagctcaaagtggtctttgttgttgcaaagattagaaataaataagccatgaaggctcagctctaatttgtggctttaaaaaggatactgatgtctgacattgctctggaatcaagccaaggtcccctttgaaattgaattaatagatcttaaagtatttgctgcagagtggaggcctctgatgagatagtagagtgtacgtatacctctctgatcaatcttaaagtatgtgctgcagtgtggagagctctgctgaattctctgatgagatagtagactgtatgtatatctctctgatcgatcttaaagtatgtgctgcagagtggaggcctttgctgagttctctgatgagatggtagactgtacatatacctctctgatagatcttaaagtatgtgctgcagcgcggagagctctgctgagttctctgataagatggtagactgtacgtatacctctctgatcaatcttaaagtatgtgctacagagtggaggcctctgctgagttctctgataagatggcagactgcaggtatacctctctgatcgatcttaaagtatgtgctgcagtgtggagagctctgctgagctctctgataagatggtagactgtatgtatacctctctgatcaatcttaaagtatgtgctgcagagtggaggcctctgctgagttctctggtaagatggcagactgcacgtatacctctctgatcgatcttaaagtatgtgctgcagcttggagagctctgctgagctctctgataagatggtagactgtacatatacctctctgatcaatcttaaagtatgtgctgcagagtggaggcctctgctgagttctctgatgagatggtagactgcacatatacctctctgatcgatcttaaagtatgtgctgcagcgtggagggctctgttaagttctctgatgagacgggagaatgcacgtgcatctctttgttttggtgcaggcacacacaagtacactggaagtcttggttctttctcattttacttgggttgtcaccagtttctggcaggaaattctgcctcagctatcggggcccaagagccaaatgtgctccaaatctgggccctcggtgactgcagagatgccaccctttcctttcaaatgcaactgcccttgctgggggaggaatgtcccaggaaattctctgagtaacactgtgtctgggacaggtatctgtgctccgaggaaagaaatagttttctaaatagtttgtttttgtctcagaaaccagagccaggagcaatgacagggagccactcagttaacgcctagaggccttgcttattctggctgcgatcacagaaggcttcgggcgatgatgaggaaacgagtgtgaccctctcaggctggcttcacagggttagccgttggaggagagaaaacccacccaaattagtgaagtggaaaggtttcatgaacttctccagtttcaacaagtgaaatctgtgtgtttgggtgggactggagacaagggaagatgagggagaggaaggaggagagagggagagagacatcacatcctattgcatcttccctaaaacccagagtgcttcgcagccatgctacaggacgccctcaccataaagcaaatgtgggggatcattttaaattagttgcctcccaaaagggactgttctaaacaaaggtggccgtgcagccttgaccttcaacagggagtcccaacacttttccaattgcctcaaaagcagagattctggaaaaccagatgcaacaagatgccccaagactcacagcctgaagactgcggggagcctttgggccgatggggccgcttttataggacatgtttgtgccacaccaggtaagagaccacctgggacgtctatgtgtgtggggagaggacacgcgcagctgcatgctgtcggagctggaaggaactgcagggaccatcaaccccaccttcatttcccagagaaaaggagggacagggcccatggctgtgcagctggccacagcccagtagggtctagaactcagaatccggacaacccccatgccactgtgggccgcagaccagaagctcacagagctggggccgtggcctcctggatcctgctctcacacatcctgctgccacaccaacaccagagaatccaccgcttctagcaggaggacggcccgcaaacgctcaggggaaaggaaaaatcaggcctgatttcttacggagttggaaaaaattaagaaaagcccattttgcattttgaagaccaaaaatgtcgtgctaacgaagaatgagaagagcagggcctttttttcctctttttaagattaagggtaaatcgcatcctcactaaataagagaagctcatacatggtcttctcagaaacccacagagaaggaatgggtttgtgcttccacattcgggaagggaggacccaggcctctgcgacagctgcactgctctctggctggtcgggtgccaactagagccgactcctgcacacatagggtcccgggacaagcccttgtaccttggaacagagcctcactcaaacagaaaatgatgaacacaattttacagtcttgtcatgaagatcggaggagatgacaggtgcgcatgcttggcaggtgtgaagtgctaagagaatgcaggactgtgcaagtcactagcagaaaaacactttgtgaacaagaattctgggtaagcgcacagaaacagcatgacgtccatgtccacaggcagagcccgtgcatctgagcaggcactgcgggggccaaggcgtgacatgcccgcaaacctgtgctgtcttttctgctttaccacttgacagggaaaatggatagagatgaagcaggagcaccaagggtcaggctcgactcaactccacacacttcagggcaaggagcttttcagagcaccttaaagaacaactacaattccttcaattcactttagttcatgcatattcaccaggggctctgcgtggtccgagagctggacacaaagatgagccagacacaacctctgccttcgtggatctcatcacttagtgaatacctgtggccggcccagctgcctggccagtaaagccgccactccagccctcatttccttcctccaaccacagatgcttgttctcctgccttccttacggtgccatatgtcacgagtgccatgagacagggttccagtcaacaagaagtacagagaactcccaggggcttccagaaaagctttgtttttgtgaaaaaggggacagaggcagctggcctcatccagttcctttttctcctgcagtgaggatgtgattccaggaggtgttgtagccgcattgccatcacaaggcaccgaggataaggatgaaaaggcagtgcactgaggatgggaaacagaagccacaggaagatctgggctcctgacagcagtagttcagctgccagtgtctacaactcatccaccaccacgtggtgtgttaataagagaatgaaaccgtgatttggaaaactaaattaattgaacaaaaaaattaaaattatttaaaggttctattccttgcagctaaaagcaattcctatggatacatctgttttcataagtgaatttcgtaagtttcttgtttgacctgctttgaagtactgtcacgagaattcaagtcagataatgactaccttagtgcagtgccaaggcatcttctcatcctcatcaacagcaccgtgccgggggaaacctgaggctcgaagaacgacctgttctcctggttcattagaaatccgcccaggcaggggaacgtcggagctgtccacccaccctctgccaccacccatggggcctgccttccagggctgtgtgggggaggctgtgcttacacccagcagcatagagaatgaggggaggagagccacagacacaataaaggtgcaacctagggtcacggaaaagaacagctctggaccagacactgaaaaggctgatgaaatgagaccaggggctccagacatgggcaaacttcagagttgagagatgagtggaaatggcatgcaaagatgcttctgtgcattttgtggcagtttacagcattgcaaactcgattctaaggcaggcgtgtcctgaagtgggttgagatctgctgagctggggagcaagcccctgccagcgagcccctgatcccctccagctgggagggttacttcctcccagaaggattacatccacattgctcttagggctgacggacactgcaatggaagggactcaatttaattcacaatctggaagactcagatcagaaacatgacctttgacatagcatttggacaaaccagggcaccgcgatgcattggcttagctgagacacgcttctcaacttgcatctgtctccaaacacgccctcagagttaagaaacaccgcctcccccacctccccagacgcacggtgatgaacgggggggtctgtaaacaaaaggccagaccacacccagatttgggaaaactgcagtgaaacggcaacttcgggacacagggtgggacacaagcccttcctgccttgcccagcccaggctgtccctctgtccaaggctgcatctcccaccactgggaccccaccctcagggggtgaggtcttgcccatgacaggccctgtgtggatagggactctgggcactaagggtgagcgctgagcccttgctgcgtttcctgagccgagtcactgtgtaaccgtgggtgtgcaccaggaccagcgagtgaagggccaaggtgcagacagctttaggagctgcacatctcttggaaatgtggctgtgaccctggctaacgacgaccgtcaccactgatgaaaaggaggagtcctgatgactcttggttggaatctcaggtcccatctgggactttgctgagggggtcccagtaacaacaacgtggcaaaaattgtttggtcagtaggttcctctaagccatgaaccccacacacagctgtgagcacacacacacacatgtgcacgcacacgcatgaacacacacacacagtgcccctgtgtgtgctgcagcatgggccctctgtcctgatcaggcgtcctcccctctggtcctgagtgctctccatcctgggcctcccatctcattgtcgcccccagctggcatctcagtgacttggggctgctctgctggggccttcagctttgtccacagcactgttggtgaatacccctctaaggaagctgcctctgtctgggtgacagttccccagcctctcagacccttgactggggacagcgctataaaatgtgtgcagtgacctgctagttagttttcatccaatgcactggacacagtcctttccacagacaccagcatggggccctgccaggtggcattgggggctgggtccatcggtgtctccatgtgccctggcatggatgcactgtggtgtgggtggcacgggctccgctgcggggtgagtctacactctccagccatgtgggctgcaattcagtctagaccctggcccttccatgtcagtaacagcaacgtggagattctcaacagggggactttgccaatgtcaggagacgtttgatcatcacggggtgggggtggggatgcgctaaacagcctcaatgcatggcgcagctcccaaaacaagaattaaccggcccaaaatgcagacggtgcagagccgtggccgagacaccgtcctccagccccaggctgtggtgtggacgtttcataattgattcaatgatttccttattgattgatgcttacttcatcttcaggtctttgttaaacaggaagaccttcggcaaacaccgtttatttgtaccccttttacgcaggtatggctatttctgttggagagatttctggaagtaacacttctgggcaaaagggtgcatacatttaacattctgatggttttaccaaggtgctgaaatgttgcagggatttactctcctgacacacacccacgtgccctgggctttctggattggcctgcagtgactggcagacagtgacggcagaacaccctgtgacatcacccatgccacggggagctcaccgtgtcacctgctctgacgtcaccagtgccacgggagctcactgtgtcacctgctctcctggtagccacgctcggcatgcagaggtgctcggtgacaaggaggaattgctttactgtgttgtgtggaagaatgaaaacaggctgagtggacaaaggcgctgacagtgggttatcaccgagaggtctgtagagtggaataaaatatctgcttacacagaggagaactgcctcggaaatacaactatgggacatctttatatgaagtaaagaattactatgaagatgaatctgcaggaaggaagagtggtttacgtgataaaaatctggattagaagttggatgtaaatgtgtttaattaggtgaatacaactatgacaattcattacaagatgaatctcatggggattagtactcagtactttaaatacatcaatgttgatttttaaaaatcaccttaactccttttttctaagatcacagttatacttcaattatctcacattgtgaaatatgactgtggagtaggaaggtacttttgattagcttcactttcaatcactgaaggattgcaaatgaatgcaaaagttccctgcaatggaagctgatgtggggaagaagttaaatgggtccttctttctttggggttaaggcatgcagagaggaaaatctagtattttttccgaaatgaagtatttcctgatttaacttttgccttcccctctggtatgtcttctatctatgaggttagagtttaaaaaaaaacagaatttaatgtgttcctttcgttttcttgttaaaataacctgaaacaccctgctccagttgctgtctaaaccgtaaacaccctgctctagttgctgtctaaaccggaaacaccctgctcttgctgctgtctgaaccgaaaacaccctgctccagttgctgtctaaaccggaaacaccctgctcctgctgctgtctgaaccggaaacaccctgctcctgctgctgtctgactctgagacaacacggccgcgccaactcgctaagaccggcccagcccacggagtaatcctcaatacgctgtcacatacacgaaaagaaaatcaatcagtagttaaagtagatcctgattttaatagatgtggaggtttctcaatttagggagaattaaattagaagcagcttttcaacggttctgtccttagcttagagactttcaaaactcagggaagtcagattggttgaaggatactaccattttgggtaaaaccagtggcttttagaaaacagcttatggtattttggcagcaactatgtgttttagaagctgtgaaggggccttttttcctggagctcagatggcactggtactatttcaacctctaggtgaggtctgttttcagtgaccttggttggcattgggccggagcaggagggtggccctccacatctccactgtagcttgcggggcagcgccctgcacgttcccgtggtggggtgtcccggggaatcttacccagccggttgcaggggttccgtttgaagagagctcgcagcaaactctgtgcctccccactgaggaactgcggcatccccagcttggctctgaaaaacaagatcctattttaggatctattttaggagaacaaggacaagctataaagagggccccagtcagcattcagagacctcaatcgcagtcacccagagcagcccgtgctctaccacgtgggtcttaggacccttttatgctttaaaagttactgaggacaccaaagagcttatgtttatgtgggttacagctgtgatatttaccacagtagaaagtaaagtgagaaatttgtataatttccatttcctaattcactttaataaatttttattaataaacattatttaataataaaatcattaaaaaacaataacactcccattaacacaaataacattgttaatggaaattatctatgttttctcaaacatacatataaaaaagtctttagtggcattgttctgcacttgggtgcgtctcttcctggctcataggagacagctggaccctgtgctcggtctgttgcgatgctatgaagaaaacctgcgagaggaggacctgcaaaccccgggagggtctcaggaccaccggagtcctcagagcacactgagaaccccacgcgcagagcctagtgctccctccagaaattctccatccctcccaagtggaatgccctgaggccacacccgtgacttgctgtcagggattattccagctttagcaaaagtaaagaacatgtcctcccttaaaattcaaacaatgagaatcactgcaaaggtcctgacttgcagctctcagtgtctgctgcaattcaaggtcccttgatggaggaaaaggctgattaaataaaaagacactccttagcttgacaaaagggtcctcacaatggggcttccttcactcccctctctccttccatctacataaggaccgagcttacaaaagctgagctggtggtgttttaggtgattctcaattttataaaagttatgtgtccatttgcaagcagagttggcaagagcagctcatgaggacaaacagctttatgactcctccaccgagtggcctcacttaggaaggaactgattaggggctcccagcctctctgtttcctgccctcctgctgtctgctctgggacagtgatagtcagtggtgtctgctcacatttaggatgctatggcaaggtggtatggggatcaggcttcttcctacagtccaagagcaaaaccttggcttagtaaatgatttttcatgagaattaagcagaaaatggtttgtatccagtcacatggtaaaacgataccgagtcctgccaaggtcaaccaggagtgctatatgaatggggtcagcaggtggggagggaaaggagacccctgctcctgtgatctctccggacaaggccctggaggccttgtgtctttttccgtctatcctttacttctgggaggtcaccaaccatcacgcttgaaaaccagccactacacattctaagtgacttactgatggaaaactatctatggtagaagagttcatcagaaccactcagcaggatgagacaaaccagcaactgctcccttgacccactgtcattagaatgcccagcaccctattaccactgctactggcggacgagcgctaccattttgtgtaaaaccagtgacttttagaaaacagcttacaatactttggcactgtaagcctagcaatgtaattaaaacttcacagttccaggttcagaggcagcagctcttgatatcagaaggtgctcgcaggtctctggggtggctcccacactactcacttgaggatgagagccatggtctccttcctgtccttcccctggaacggcagggaccccgtgagcatctcaaactgcagagcaacacagagcacagtgagttcattcatccagatggacccggcttcacggcagagtaccccagcagggcagcctgctaccgtgtccatttcctcatgcaaaatctccatcagtcaattgtagccactggcctacgtgcttggggtacaacagtgactaaaactgcctcgcagagcttgccatttggtgggtgagacgggtaaatgacagatgtggtagataatcacactctgtggcaggccagcaggccccgagtacgacagagaaaagaggcagagcagggtcctgtggtcaggcagtttggacgaacacatcttacacgcggtttaggaacctgtcctgccctggcaggtgttgtggaagggatgagctaggaggaggaggaggagaacagctagctcatgttgaacacccatgcatgcctggatggtgggggctagagtgcttccagcatgagatagacctgaccacagccattagcctctgacgaggacaatatggcacagcaacctctcagatacagctgccgcaccctacatccttattttgttattactggacacctgccaggacggaacttgagataaggaggggatggagcacagccttgtctgagcatgggtttctttcttgcaccaactcccccgggcacatgcagtggtgattacacacactctggaagcagtggcctggaatggtctcatcagagcaaggtgcacagctgaccgcttctcacaaaagaaactagggctgcagcaggaaccaatcttttcataaaataagaccctgaatctaagtggaatgtgcccaaggatcaatcctactcggtgtctttcacgtcagtttaaattacggggaagcaggtgtttccatggtcttattgaattctctctcatctttattttttgctgcgtgtgtctctgcccttttagaattcatcctccagcattcgtcctttgcagttcgaaaatctcaggagatacacaaagtagaaagaccaaaaaaatcacgcagaattccattacccaaagatatccaaacttaacatttgttagttcctcctagtacttttttcaagctgttttttattttgttttaaaaacacagataaggttttgtatactaacttttcacagaataatataaaactttcaatggttatgatgaaatctttgtaatatcacttaacaaacatggatatgacaaaatgtatagtgagtgtatttgttgctgtacacttaggacatttccaattttctgctattgtaagtactactgaaatgtgcacagatgatttcctaagatttattcttatgataggctgctaggagtgaaattataatcttaaagaaatgaatgcatttaaggttttattaatattaccagtctgctttctgaaaacaacattataaaagaaatggaaactcttccaccagttctgacgtttgaagcctgttctgtcacattaaaatgtgctgtccatccggtgcacagagtaagtgagggaactcagagcagacaggctgcaggcaatcaatcaatacaaaagtaataaaaagcaagcggaagggggtccagatgagaactgaaaaagagacaagtgtaattaaacaggaaaggccagaatgctctgactggcagatgagctgtttgtctggtaaaacaggatgaaagtttataagctgatcatacacactgaaatatctctcagaatagaatggtattagcaaagggaactcctttcctattctgctctttcttctttctttcttgagtctattaatagcactatgaaatcccatttccaaggacaagccttctggctacatgaaatgagaaagctgtcatcccatacacaccgtttaatccttgttacacaaatggtgcctgtccagatgcccggatatcatttattttttgctgatggactggtatcttgcatacatttgtttggtgatttctttttcttttctttttttttttttttgagatggagtctcgctgttgcccaggctggagtgcaatggcacaatctcggctcactgcaacctccgcctcctgggttcaagcgattctcctgtctccacctcccgagtagctgggactacaggcgtgagccaccatgcctggctaatttttgtatttttttttttttttttttttagtagagacagggtttcaccatgttggccaggctgaactggaactcctgacctcaagtgatccgcccgccttggcctcccacaatgcttggattataggcgtgagccactgcgcctggtctggtgatttctttttagcttttgaagatgattcccttgtgatcagggtccactgctttgtggttctctctcttcctccccttcttcctccatccatatggtaggaggtccccaaccatctactcagccagagaacacccagcacagcacccatgaatattcaacaactgcttcttggtgatgaaggtgctgctgacggtggggatgatgctggggcggaggtgtggactttgcagcctccaccagccatggggttctgctgcctttcccatccccttatccacccttttctgtggagaagggagatcatttcagtatgattgtctgaatggagctgcccgggaactttccagtgccgaagcattactgactgaggttttgctgatgagtttcttgggacgttatttacagtaagacttttgctgtgttgctgagcagcactgagacttgccaaggcttccggggtgaactgagaaaagccgaggttcatcttggggttcccacagtcaagtacacgcaccgggggagggagggcactccaaaggattctttcccaatcggcaccgagaccaggctgcagacaggcacagaggggctcaaggagatgtagccaaagctccaccgggtgcaggcccgatgcttctgggaaggtaattggacagacataacgcagtgcttctcaactggggtcaccgttgcctgccaggggacatttccggctgtcatgcccgggagccctggtgctacaggcgtccactgagggaggcacagatgctgctaaacatcctatgacacacagggcgccccacaacaaggaagtgtccagtcccgacctcaacagtgctggctgagaagccctgtctaaagggacagctaaggaacctggaaagagtggcggccccggcacaggcaggatgcgcctcatggaggccagtggtactgggggcaggggaaggaggagactctggggagacccttggtgacaggagcctcgatttcaagtttacttggccgatcaccattcttaaaagggcaccaaaagcaagctaacattttaatctgaaaacaggcgaggacaagccctgacctgagatggatgacttgaagtggtagagggcctggctttgcagggtatggaggggctgggtctcggagagctgtgttgatccatgcccatgtgtggaggtccctgtgtgcacagacacatgccctctaatccgagctgctctcgctccgtgtgctgcaccccactccgagtgccaagaatctcagtctcaaaacagccttggaaggtgccgttcctcacaaccgtctacagatgaatggtccagtggcaagcagcagagcctgagctcagaaccatccgtgtttgctatggtggcataaggacacatcacatggcacctgaggcgggatgtccagaacattccgtgcccgtggttaagaaacgggagaaggataaagtggtctcacgaaaccagagtgctcaagagatgctttagatgtttacaaaacagcccaaatatccttctagaaactggctccagcctggcgtagaggagtgctggaaattctacaaatgtcaccacgcagccggccaccaggtttgcacgttcttctccaggtaccagctcctaatttcagacacggaattttattcagggacactgacttcctgcccctggcacaggcatccttccttccaggtctggggagggcacttgtggatgctgctcctcgggaagagatcccagcacacatccacctccaggggacggacggccacccacacatgaggaccactccctcagcacgcggcctccagggtctcagccttcttttaaaacaaggcccctcacacgcacaacggctctgcaccgatccgcttacaaggcttgggtaagatacgacttcaaaggtcacccgaggcccatctcttagctgcaaatgagaattcagaagtcacttctgatgccacccacggacgtgtgggaagcgtggggcctccacagtcaagacctttgcctgtgtgcagccagtcaccacgtgggcgggcggcactaaatgagaatgtgtttctgggactattatgtgatcttgagcccgacacttaggctctttcagctttagttttcatttctgtgcacagaaagaataccgtctttcctgcccggcttggagattgttgggttgagatcaaatgtgaagatggccaggcagccttagcttgtggtcaccacggcaacagccagccctgcctcgggctcgagagtgacacagcagttctggagccggaccccttccccagctgtcacgagacattgaatgcgggacgatcccagcaaacaagtgaacaattcagtaagaaatgtcctgtgcccagggaggcacgtgggaggagagtgcctgctgtgttgacgtgccgggcagcgctgggccaggcctccttcagaagctctcaatatcatcttcttcacactccagggacagggagggtggggactccaggatgggtgaaggctgccgggcactgggtctgggtgtgagtgcctctctgcttccaccctgttgtcttcactccctcatgggtcccttggaggcctggccaggtgcaggcacttttgtctgtgctggggcatcttgggtaaggtgactggtgtttaagaaactccacgtgccaggagacactcacagagacagacaacgacaataaaagatggcagacgttagagcagtggcaagccaggagtgctgagaagacaccgaagccagagccaccagccagagccaccaacccggccagggtcagcaaaggccactgggagtggtgcttctgtcttagggctgatggtggaaggggaccggggggagtttgctggagcaaggcgagcccgacgtggtctcatttcctcttcttctggcccctcgtcgtgtctccatctttggatcattcctcttctgtctcttctgttctcctatttctttttctttcagcttctccatttgtcttttcggtttgcagtgattaagaccagaagaactgggcgtggtggctcacgcctgcaaccctagcacttctggaggccgaggctggcagactgcctgagcttgggggttcaagaccaacctgggcaacacgatgaaaccctgtctctactaaaatgcaaaaaaaattagctgggtgtggcgggtgcctgtagtcgcagctacttgggaggctgaggcaggagaatggcttgaacccaggaggcggaggttgcagtgagctgagattgcaacactgcactccagcctggtgacagaatgagactccatctcaaaaaacaataaaaaattaaaaaataaaaagaaaaaaaagaaaaaaaattaaatatatattttatattatgagataggttttatgatctgttgccttaatagaagaaacagaagactatcaaatctcccctccccctgtccccccagaaacctcacaaaactaagtccagttggttttgacttatatgtggtgttttggctgtgcttttctctgctaagttactcctctccactccagcctggcctcttgttctttttaaacattggttcacctgagagccaggtggcaacattttatgaccttgttcattacacaaaggctggcccgcagtactgctggatgggccacttgtgagcccagagttataggacaggacccagagacagaaggatgccaggagccctttcagggagcctggatgtgcagcgtggccagccctgctctctgggggaatttggggttctcaggagggggtttaagaactggaatctctcctgaagccacagactataagcttggacccatagcccagcgtcagcaaaggcaacatcagacttccctgcaccggcaaaacctgcaccagcgtgggaggtctccacagggctatccccgctgccctcacccaccactcaccagccagggtcacacaggaaacccacacatgtggaagggagtggacctatcgaggcagaaatcacctccaagacggcaaagcaaacctgcctcactgacctatctaaagaaaacctctttcagtggaaggaaagcagaggtggtctcagaggggtgaccgtgggggacttagctctgtggtctccgcatggagaggacctgctccttagccagtgccactgaaggtctgaataatagtaaaaaataaatcagcagcatcatcctcttggctgagctcgcgggccccttgctttgctgcaggcattctctcaagtgtcgtgcctgtgctcacgtgttgaactgcacgactgtctgtgttgtgactcactttacaggcaggaatgaccagggacggaaggggcttccacaggaaggagtagccacaaacgtgatgtgggcatctccgactgcgaactggctttctgggttaggctgtgggcccatctccggagctggtctaatgtgtgtctgcccctcgcggagaggtgagcagcccgtgcgggcacgtggaacacagccagggcctgtgagctcccggggctgaggccggagcctggagagtgctgcagtgacccaagtggcaaaggaccagcgaggccctgggcaccagccgggggttctccaggcgacaccgcaggactcagccctggggttccctagcaaggggacgaggagtagggtgtggtgggaggagaggcggtcaaaactctgaagggaactgggtttggcaggcacacagttctgccacacgccagcggagcaaccttcatcccgtctcctaaagtgctcatggcctcagtttcctcctgtgtgtgatgcacaggccggagggcgggatacccctgaaatgccacgacccgattgtcatccaggtcagattccagagcactcactgcacgcctgctccaccctgaggtcaccagccccctgcccagctgggagagtgggattgggggagggagggagggtcctgtgaagattgggaaaggagcccacacagttcctagggcggagaagacccagtccaaactgggttctgttaagcactctgcctgcgaaaacgcgacagagacaattcacatttccagacgctgatgcaaaaatgcctaactccgtgtacatctcagtttgtaactaagcgcaaggattctgtgtctaaataagaaaaatactttaactcgaaaatcatggcatctcttgtaatcatcacgctaagcccgaagagcacaaagcataaagagggttcgactcctcccacgtctgcgtttctgcgttctcgtttgcatcccagccccactttctgatggtggggatgtgggatggggaggaggctgccaggaaatgcttggcctggacacttgcccagtgtcccaagccctcaggcactgccttcttccgcatttcgggacctctgaaccaacctggggacaggggtccacgtggggaacagccgccatggcacagaagagggtcggggcaggctcaccatgagcacgccgaaggaccaccagtcggcactctgcgtgtgtcctcgccggttcaccacctcgggcgccatgtactcgatcgtcccgcagaaggagtacgctctcttgtcgtggtcaatggcctccttactcaggccgaaatctacatgcaaacacagcacacacactgcctcagtctctgggtgtgttcgggggtccacactcaggcgggcatcagcgtccttctgtgggctctgccccctctccaggtgggcgcagcagagccctgctcagcaaaagcgggaccatgtgagtgcttcccgaagcccgtcagtgcccgaagcccgccggtgcctgaagccgaaatcctcaaagcgtgaggagttccttatgagtgtacacactcaggagcgccttggaacaccacccagacagcaggttgtcagtcagtgacgggaactcccccagacccttttccacaggcacgtggaggtggggtgttgcagggcagagggacctggggtggaaggcaggtgtgtggctgacagctactgggaaaggggctctggctgccggggagccaaggggaaggcagagtgtggcgaacctgccctgccccgacaacacgagggtgtggagagcacagacaggcggaggaggcctggggagcagaggccgagctatgatggaagaacagggatctccaggtgccacagagcaaggaggggcttctgaaggaagtggccccggggctggaaagaacaagagtgcattggctcagggcccccaagtcttggggatgacagagcgtggctaaatagagccaaggcaggcccagccagtgggtagagcagcagtgcccagagaggccatgtccttgcccctgagcctgggaatgggccaccttatgtggcagaagggactgatatggtttagctgagtccccatccaaatctcaccttgaattgtaagaatccccacgtgtcgtgggagggacagagtgggaggtaactgaatcatgggggtgggtttttccagtgctattctcgtgacagtgaataagactcacgagatctgatggttttatacagggcagttctcctgcacatgctctctctttgcctgctgccatgtaagacgtgctttttctcctccttctccttctgccatgattgtgaggcctccccagccaggtggaacagggtgagtccattaaacctctttcctttatgaattacccagccttgggtatgtctttattagcagtgtgagaataggctaacatggggactttgagaacagactaatacagggactttcagaacagactaatacagggactttgagaacagactaatacagggactttgagaacagactaatacagggactttcagaacagactaatacagggactttcagaacagactaacacagggactttgcagatgccattgaggatctggagataggggatgaccctggatttctgggtgtgcccaacaccattgcaagggtcttcaggttaggaagggaggcaagatgcagtcagagagcttggaagatgctgcctgctggcttccaccatgggggacgcagcccagccaaggactgcgggcagcttctactagctggaagaagctaagcaagggagtctcctctagaggcccccaaaaggcaggcagccctgctgacaccttgatttcattcctgggagacttatttcacacttggggcctcctgacctgtcaggtgataagtttgtgtggtttaaagccccgatgttcctggcattttgttgcagatgctatagggaactaatacaaatggggtgtcctgagactagaggagctgttgccagtttgactgaatttgctggtggctgccagggctcagatggaaacagggagggaagtcacgtggccaccaccacggtccagggagtgagaaggaggcagggacagcatcagtgagggcagcagtgcaggccgcactccagcgagactccagatgtctgccctcaggttggcactgggcatctgcaaggcccacattgcaggctacactccagcaagactccagatgtctgcactaaggtcagcactgggcactgggactcctgaactaaacacccagcgacgctgaaggagcccagcaaacagaacgtggcaggggagagggaaaagaaggggccaccgggaagctgcatgggtctggacgttatgaagacatacaatgccataagcagtctgtagctatagaaaattctgccaaatcagagacaagcatctggcaaagggaagggcggtgtaaataagagggcttgggctttgaggtggtccccaaaggtaccagggctgagatgaagccatggagggggcctgccgtcttttacaaacctgtgatcttaatgtgcccctcttcatccaggaggatgctaaaagaaagggagagaaaacagatgctttagaaagagacccagcctgccgacgggcacgcagagctcagaggagagctgcggggcagctgggggcggacgttttcagggagccctgatggagctggcccaggagatccccacggcttgtgcggtgggccttcccatcctgcctcgcttctccacagctcccagctcgagaaagcatttggtgccacacctcctggataaagggatgtgtgttcgtgcagctggaggactgctggctttagatattcgtgggtccccagggaaggtctaagagccctccagactgctgtgcgcaaagcataggtggagagcgtcctgggactgctgtggcctgtggagacccagagcctcgcagatggaatgtttctgcactcgggatgcccttgatgtccaaagacccccttcttctcccatgtatcctcccctgagccctgccctggctctccagacccacccaggtgaggcctgcacaagcgggggccaaggcatcgaggagcttcgggcttcagcaggtacatcttgtgatgagacctgctcccggcttggcacccctgcgggccactgggtccctgtcttgttccctgccaagcccttgtcacgccatgtgccggacgtgacagttgcctttgctcctcccaggtatcctgccgtggggtgaaccctgcatagagaatggaggcagggtccgtaaagggctgggtgcaggcataaatcccttcttccctgaacatcaggcgggagtctgggctgtgataccttgacacacctgtggccctaaactttccccatttatttatttggctgtaattaaatcctgttcttccagatgctgggaggtaccagcctagccctaaagagaccaggaagtgggctggaaagaaacaaaggcaaggcttggaggattaatctgtgatacctttatagaaacctgtgaaaggaaggaaagcctgacttgctacagcacagaggagcccggaggacattatgctcgattaaataagcccgtccccaaacgacaggtattatatgattttacaaatataaaatgtatggtccctagaggggccagagtcacagagatggaaagtggatggcgggtgccgggggctggggagctactgtgcagggggacagagctttagttctgcaagatgaaacagttctggagatggacggtggggatgggggcccagcaatgggaacgtgcttaatgccactgaactgggcacttaaacgtggtgaaaactgtaaaagtcatgtgtatttttctacaattaaaaaaaatctgccacagagttaaaaaaataaccactattttctggaaatgggaaggaaaagttacagcatgtaattaagatgacaatttataatgaacaaggcaaatcttttcatctttgccttttgggcatattcaatctttgcccagaattaagcacctttcaagattaattctctaataattctagttgaacaacacaaccttttccttcaagcttgcaattaaataaggctatttttagctgtaaggatcacgctgaccttcaggagcaatgagaaccggcactcccggcctgagtggatgcacggggagtgtgtctaacacacaggcgtcaacagccagggccgcacgaggaggaggagtggcaacgtccacacagactcacaacacggcactccgacttggagggtaattaataccaggttaacttctgggatgaccttggcaacgacccaaggtgacaggccaggctctgcaatcacctcccaattaaggagaggcgaaaggggactcccagggctcagagcaccacggggttctaggtcagacccactttgaaatggaaatctggccttgtgctgctgctcttgtggggagacagcagctgcggaggctgctctcttcatgggattactctggataaagtcttttttgattctacgttgagcatcccttatctgaaatgcctgaaaccggaagtgtttaggatttggggattttgcaatatttacttatatataatgagatatcttggagatgggccacaagtctgaaatgaaacaaaattcatttatgtttcatatataccttctacacatcacctggagctaatttatagaatattttaaataattttgtgtatgaaaccacgtttgtgttaagtgcttatgtgtggaattttccactggggggtgtcccattggggctcaaaaagttttggattttggagcatttcagattcggatgagggatgctccagctgtatttacacacgtattcaactcacatgtgtgcctgtggcgttccacggactggtggtgaagtcagatcatcaagcacatgggcaaatgcattttgcatcctgcagtggatatgggatgtgacctggtttctgggtaaacccagctgtttcccatagatgacagctgcatctaacaacaccagcttcggagcagggcttgtcttttctcagttccatgcaggtgacagggcaggaatgtggagtagcaactgggacgcgtttgcagaccccagggcccccccttggtcttagctcacaggcacggggctctctggtggtacccaaggccggtcggtcccaccaggccacaggtgatgcctcatctaggggcggctatgggccctggtctgggtgggtggcattaatcggcccctcagggcagggaagagtgagtgatcacctcagggatactgctgaggtcaactcaacctaaaataccatcctccaaatctcttcttttctaagtggatcactcctagttatgtgtcaggtctacaaagaatatgtaaaaacaacaacaacaaaatgaaaatgggaacactattattttggagggactttactgttcaaaaatctagaatagattagcaaaatatcgtagaaataatagcctcacaggtcaccactgccaaggatatacaaatctcagtggactctgggtctgagaattctggggccgttgtcttttaggtaagttcttgggagagctgttctgactggggacctagaggtggggctgacaagtaactgagtagaggttcattgaccacattcctgggacttgctgaagtagatgaaagggcttcctgaatctggaggacagtagggaagagatgagagaggaggagaaactgccctggaggcagccatgtttgagatggtccccagtggccagatgagcctcacccaggagagagggcgggaatgtgggtcagggtcgtgggcgtgcccctccccagctccggcttcccgtgcatcacagacatgcacctgagcctggcctccctcaggcgttatgagtgtcaggtgagaatgggcctgggcatttcctatgcaaatcagcaaggccacacctgcatctgggcacctgatgcctgagccggtcctgccggcacaagagtctccccagcctgctctctgatatgtcctcatttaggaaataaatatctagcagtggctaccaacatgggccaggaaaatacatggagctgatgggcgtggggaagtcagccctagttttttctcacttacttctcaggcttcagatctctgtagatgatccccaggctgtggagatggtctaaagccaaggccagctcagccaggtagaacttgacatcctcctccgtgaacatgacctagtaagaaaaaaacaaaaacaaaaacaaaaaacgtttaacttgttttatggctggtgtgttttaaagaactctgccagagagactgagagtccacactggggtcagtttgctctgtggaacgctatggccccccagagtggtcttctgactcttctcatggaaaagtgagttccctctgcagttccaagatcagtggatggagacgagggcttcctgcacaggtgactcatgccgccttgagagtggggtgctgagattcagcctctcctctctgtgtccttctcacccctgcaaatcatttggctctggagtaggtttctgggtttacattctagcatgagtgctgctcatgtgaattcataacaaatgtaatacaagtaagacgctgagggcttgatgaggtgactgaaaatggggctcaaatatcattctttccccatggattatctatctccactccttgggttgatgcaaactagtagcctacgtaacctgctgtcaacccaaagtgggattagttctaccaaagatcacccacaggtggtacagagttggctatgggtgccccaagctgagggggcgggatggggaggggtttccaggtgttggggttggcagccacattccgggatcccacgtagctgggacagctcagggctgggaggtgaccaggcagggatggcctaagtgtccatgtcccgggggctcactcaggccagccgaaacatgcatgaggcctcggagcccaacagactccaaagccatcgccccataatgactcatccccacccccgacttgttagaatcagcacatagattttgtagacccccttaagaggaagcaaaatcatgaccacaagccattttctatattcgtcaggagaaatcaatgttatggagactacaagtccacatgattactgaattctctccggtaagcagacgtgaaaaatcagcacgcagccagaaggctgcccggcaaacacaaaattagaagggcagccaggggacctgaacggtgagtggcgtcaggccgacagccgggcacccgcttcacacagggggttcttccacagggctggacacgcaggctctgcatcctgacagtgactggtgggtgccagccacccaccggccccccgagtccccgtcctccattccacgcttggccagcgcctttcccggatgtatgtttcttttctagatcggttaaggtgctcagtggactgactgacagcacgttctgctagtggcctggttctttcctctgacttgacatatccacacgtggcccaccatgggttttgtgtacaatttagggctcagaggcaaacctgtctttccactcccctagctcttagtgtaacccccaaggacaatagcaggaagtttctccatagaaagggaacacctcacggtgtgagttctgcaggttcaccggcacagcgatggtccccgtaagatgctggaccccgtacttgctaaatgacgacccaaggtgagttctgcaggttcgccggcacagcgacggtccccataagatgctggaccccatacttgctgaatgaggacccaaggaaaagactttccgcaggttcccagcaactccacgaatctgtggtgcccgccctggacaacttccctcctactccgaaatgaaggccctcgggggaggcacacattcccacgtggggagctgcaggactttttgctgattactgttgtctttttggtcagggggcccaaccacaggcgtgtcatagcagctgctggacaaaactggaccccaaatggactgactccctgtggatgagaggggagtggacaaaccaacagatgataccacatgaggaatgggcagacaccaggctccagcatctttggaaatggccacacagcaggaggcaaaggaaggggccagacgccagttcccaaaggcctttgtgtagagcttggatcaggttctcccggcccactgtttttcctccatgcaaggagccccacagaaacgtgcaccactgtccaagggactgctggacgcagagggacagggcagccatggtctctgggaccctttgcgcccgattcaggagcagctctgccttggtttactgttcatttggggctttgtgcaagacagcggggtctcctgctgaaaagggggaaggtggggaaaagggagtggggggtgtgaaggccactgttgctgtgaaagcacctcggccactcctttgtataagagatgaacaagcaggatcgtcagaacggaaagcccggcactggcactgccatgggcagaatctgccttttgccatcccatgaagcggggtgcttttcacgtcaatcagggccacggggctctcagggtgcagtgaagttgcatcctggagggttcctacctaaggcactggaggtcaaggagaagccctggggtgtgcagtagcggctgtgagacaaaggtggcgtgcgaagaccacacccgatgctcccgaacagccccaatgttcagccggcttagcagtacctccctcttccctccctcttcccaggatggaaagtgagaccctgtgagagtctttcccagccgctcctacccaccgacctgcgccttccatctgcgctagctgggaggtcaacagcgtgacttatggtcccagagctgcaggggcgctgccagggccacctgggacgattgctagggccacttgtgcagcttccttagaaccaggcagcaatgcacacagcacacccaacacacacacacacacacacacccaccccacatcacacatagcacacaccacacataccacatacagcacacacacacaactcatacatacacacaccctacataggcacacaggatgtcaaacacacagacaccccacaccacacaaagcacataccacacataccacatatagcacacacacacccacacacaaacacaccccacacatacacacaccctgcatatgcacacatgcacaaagcacaccacacaccccacacatagcacacaccacgcacaccaaccccacacatgcacacagcatgccaaacacacccccacatatacacatagcacacacaccatcacacacagcacacatcacatacaccacaaatcacacgcctgacatatacacacagcacacatcacacacataccacacacttatcacatgacacatgcacaccccacatgcacacacactcacattcccacacaccatgcacacacaaccccaaacaccacgcacacccccccacacacgcactcaaacacatacacaccccacacatcacgcacatgcactcacacagcccccatgcaaaccccacacatgcacatgcagtctcgcaaccccccaccacacatcatgcacacttgcacacactcacacatgtacacctctcccacacacgcactcttgcacacactcacacatgcacacacccccacacacacacacgcactctcgcacgtgctcacgtcctctcaatgctctccacccctcctcccctcgagtcccagacagaagctcctgcccgccctcctgtgtgatgtggcggctgctcacctctttggagagccgggtgaagaggtcccctccccgcaggaagtccaggatcaggtagagctttccttccgtctgaaaggctgtgggggacagagacccgcattttgacagcttgtcgaatgtcctgtggcaacatcgctctctggcttctccctgctcacggtgctgcttactccgggaggctgagtcacttgagaaacggcaggaccccggctggtgaccagctcagaggggcagcacccggcagagggggtctgacactgtgagcgctgcccctctctcactgtcgttagggggccttgagatttctttcatctttctttcctctcccctccctcccttttttaatcacaaaggaattgaaagatacacggggagaaagatgtgaatatttaagctggtatcgttgctggcttttgtcgtaatgcattagtgagcagcctgaagatggctctggtgggtttggaggacatgtcctttccgtcctatggaagtgccttcttcttacagaactccactctggtaccagggagccccccgcttgccttcctctcttgaggcagttctggtgataggtcagcccagttatttgaacatcaacaatggggctcacgtcctaggtctggtcactgtgagctataactgcagactttctgtttcaggccacaggcaggctacacagctcctgcccacactcagcaagggcctgcctctgttgagcgggcgcatgagcacgggagggtctagagaagcccgtcaccatcgctgctgtgacgatggttgctgcagtggcactggtgaggcaccgcgtggcatcttttttatctacaaaggaagtgtggctggaagggatcccaatatccctgcatactagaaaacgttttattttctaaaagtaaatgctagaagcatcataaatgtgggggttttagaaacatagcccccagctagaaagccctctgccaggactgtgtaaactgagtgtgcattaaatgctccatcctgggcttggcaggcaggtggaggtgctgggtcaccactgaggtgatgtggaggtctgtttaaagctctttgtaggacacccagttctcaatttcttcagaaaagcaccctagcaagtaatgtaaatgacacgtgggatgggacttgacaccagccacttggcagcagcggagggggcagagttttggaaagccagcctctgcagcctcctctgccgggaggtagaggtttgcaactgcgctgcccacggccgagaaggaacagcagggtgtgcccagcttctgcaggcctccttcatcctgtcctcagattcacgcaaatctcactaacacctccccgacacaccaccttgccctttgcaaccaagaacaaactattagttttgttgctgttcccttctgtactttgctcatctggattattaggtgggaaagtttaatgtaataagccatgaatctgcagccaccatctcatcacatcttttttaaatttgaagatttcacttactgcttctctgttgggataaaaaggcagacagcaaatgaagagaagttgtgtggcaaagcagctatgtggcctttggttaattatttgagcctcagaacatgaaaataataagctaccttgaatagaagttttgagggttcaacgaactactatctttaaacatgatattcatttgaaatgaggtgttaccatttctggtttaaagaaattattgggtcatagagtattttattctaaaacaacacaaaaataagtcatagattcaccccaatctaggttaagatcttctaaattatcaatggtatggtaataatttaataatggataccccatctaaaattagatctttgagatgaaaacagggcttcttgctctttcaaagaaaataaatacagaagagattaagtgatcaggatagaaggcaccttcctccccaggcagggcaggactctatggtataggaaagattttcttctttctgatctgttatttctttttcaattttctttgatctggagaaggttgccctgggtcctctttaaagtgtcattttgactctacttaccataatgaagcttcacaatgaaggggtgattcacttctgccaagatgtctctctccatcttcgatctcactcggtcccgaactgcaaagtaaaaagataaaggctttcatgaggcaggaaataagagttctgaggaacactgaacatgaaatactagatataattcccgccaacttttcattaaaaaatttcaaacatatacaaaacttgaaaaagttgtacaataatcctagatttaacaactgcttacgttttaatacatttgctttctctctctcatatatatatatatatatatatatatatatatatatatatatatatatatatatatgcatctctagctctccaaaaaattgtaggcagcacgacatgttactctgaggtgcatgtgcaggtgtctcctaagaataaagacagtctcttagcataactttaacacctactgtgccacataggaaagccaacaatcactccatgaaacatctaacatccaatctatattcagtcctcccctccacgtcgttttcccgacctaggatccagttcaattatattggttgttaaatgtctttgttttgctcctagaagacaatggtcccatacctatttccctcgccctgtattttttcgtggactttttgggaagtccaggtcagttttcgtctgtagaatgttccacattctgggttcgtctgatggttgctcatttgctttctaaaactcttgtatttcttgtaaactggaggcgtgataagattggggctaaatgattttggtcaccaggtgatgcctgtactttagcctgcctcagatcagggggtgcctgctgggctcaccctctctgtgtgatgctaaacgtgatgtgtggttgaggtggcaggtcaccatctctccatggaaaaggtcttcatgtccctttgtaacaagaacctgtgggctgatatctggcatagagtgacctgcgggttccctaacaatccttcatccaatggtgtgagcatacatacgtgatccctgcctgaatcattcagggctaaagaacagccatggtcacatttctgatggaactggaaatcaagaggaagattccttctctccctctccatgaagataaccatggaccatgtactttctgttgaatttagtgtgttacaacagctacatattcttcttagtgctcacactatctcaagtgtggccatctgggaatacagatgtaattagttttgatgcagaaacaaatgaacaaacaaagagcaccacttgagtaaaaacagctttagcattcccctgggcaagctgctacacccagggcagtatccgggacctcacacagccccatgagcgatgggagaaaatttcttcaaacattgctattgggacaaatatgatcagtattgtatcatgggccaggtatttaaatttatccatatttaggacttgtgatacatactgctaaagttttatttaagaaattcttcaccaagaatgctgcaataataaaaagaaaatagaaaattacaaactgggaggatgtggagaacttggaaccatcatgcattgctgatgacagtgtaaaatggtgcagtcactgaggaaaatagcttggtagttccttacaaagaagtagaattaccatgcagcccagcaactctgctcacaggatacacatccaaaaaaactgaaagtatggatttgaacgggttcatccacccatgttcatggcagcattatttacaacagaaaaggaggaagcaacccaagtgtccatcaacagatggatgaacaaaatgtgatgctgtagtaaatacacacacacatacacaaacacacacacacacacaatgggatattattcagctctaaaaaagagtaaaattctaacacacagtatgaatgaaacctcaggacattatgctaagtgaaataagccagacacaagaggacaactattgtaggatcccacttataagagttgcccagagtagccagaatcagagagacagaaagcaggatcgtggtgaacaggagctggaagggggagaatgggaagtcattgtttccacctgggatgatacaaagattttgggtataacattggtgaggacaacattgtgaatgtattgatgtcactgaactgttcacttacaaatggttaaaatgatcaatattatgttatatatgtcttaccacagttaaaaagagaaagtccttcctcattcctgggtccctgagtttcactgtctcaactcctggttttaatactcacacctaggattcaggctgtctgaagtccacctttgtctttggtgttgggacagttttgctttcccgtttggtctgtaatactgtctccgggggcccaggtggtgaccgtggtgtatggccctgcaacccagctcactgtcagtgtcactgtgccctactcttggctttggtttcctcatatacaaaccggatgagatggctccccctcctggggctgcctaagaaacctgtgcagtgatgtgtgtgccacaacaacacggggcccgcccacactgtgccgcttcaggtgtcattgcagtgacacctttattatatgctcagatcccctttttttctttttctttttttctgatctctccttgctgttccactgctctgcccatccctcttctaaccccagacccttgtcatcaccgtggtcctgtgacattccttacagcaggggtgtccaatcttttgacttcctgggccacaccggaaaaactgtcttgagccacacataaaatacactaacactagctatagctgatgagcttcaaaacatcacaaaaaatctcataatcgtttaagaaagtttacgaatttgggttgggctgcattaaaagctatcctgggccccatgtagcccacaagctgtgggttggacaagcttgccttagagtctagacaggcatcgagtaggcacccagcaggcagtgctgtgggcagagctgggggatactagtgtctcccctaaacctcagcacctccttccccagtggtcctcgcagttcctaatcccttgagaccaaaacaccaaggtggagggtgcgggagcgactgcttatcacttctgcccaaggggacacaggaggtccttcttctgcctcaactaacggaatcaggattttattgcttaaaagaccttggggagcatgcaattcaaccccatgttcttacagaagaggaaacatgctcactgcagtaaaaagtattgcttaaagttaggtagctcctggtagcctggaggaaggagacccctgcctgccccgctccactgggtgaaggcctggcgtacgtcccagccagcatgtgagcactgtcctcactggacacaggggcagcatggactgtggcacagaagacaaacgctggggaggaaaagggggaagcaagcaacctgggctgaaggagatttaatgagaggggccatgaatggaaaccactgtcccagtcgttaaagtggagcactgtgttcagaagccaggatagcgcagaacactttcaaagaatacaattttgtacccctggctatgattttctctctagagtaatgaccccggagtttagagattcttttcttcctttctgattgtagtcattgtgtgcaaacattttcagaaggctctcctgcagaatttagtcttgcacccgctcctgtttatcatttgtgagttcatgtcttagtgatctggattctgcgtgctggtcagagtagtttttcttctctatgtaggtgaactggaaaataggccataggatcgcggattgtggggagatgtgggagcaaaggtaggctcggtcttcctagcccttttgcaaatcagacagctgaatggtgaggtcacaattcttgccgcttggcctcaaattccttcctcccccacctcttctcctggcccactcctttcccatcactacttctcagtcttctttgtgccaggtgtttggaatgtgaagaggcaggctctgccctccaggaagtgagagcccagtggggagatgccctgtggtgatggcagcaaggggccaccagagggtgaccagtcccacctcttgtgtgctgggggacctgtgcatgctgggggaactggaaacagcctgggaggttttcacagaggaggggctaagccttacaggggacccgggagcctccaggtgcttgggcaggaggatacaggccaagggatggccctgtagggtggcagctggggtaccctcagggatgccagtgggctggcgcacagagctgcagtgccacactgatgaggcctgcgggcagggacatgggggcctggggagccaagagaccatggacaggactttcacacagcacatgtttagggcctctagatttaagaggtcatgtggaggatgcaatagcaacatggctggaatggacaacgtggctagaatggggcaaaaggatactgctatccagccctgcagagggacagatctggcctggaggagggagaactgagacctcaggacctctcagctgctgagaataaaaagaagggagctgcatcatcctagccctctgcctgggcgactggtggagaaattagccaggagagaagtcaggtggtgggcagggagagaagaggccacctgcattctcggcctgttgagtgctggggacatgcagggctcaggaaaagacttggtttggagctttgctggaaatacagatgcgaacgcccaccccacagcagcagccaagggtgcccaaggaccactggaggatatgtaggatgagagtagaaccatggtgaggacctcggtagggttactgttgttctggggaaggagggagagaggatgcaccatgatgtggtccacagtgggaagacctggaggagacagacagagaaatcaggaaatgtgaaagaagtgtttggtggcagcagatgctcaagacagtccaccaggtggggactgcaggaggccgctggtggagttgcatgactcatggccgattcatcagggacgatgtgatgaggacatcgctcatcccccgggaggggcccgcagctgggtctgtgatgtggtgggtgagtgaagtcagcatctctgtaaccccttggtgtgacttttagaagctctgatatactttcttattaaaacattttatccattcattcttgaaaaaatagttcctgatgtagataaaaagaagagagcttgttttattaaccatgactgcagttatgcaccagagaggacactctgaagggcaaaatctcatatcagcatcggcgtgacgtcattaggatgctctcaacacaagctggagattgccgaatggagctcttgtatctactaccctggctctgcagcagaggagaatgaatgtagggaggaaaagcaaaatgattcacagggaaaatgttacaaagaatgtctctgtgaaaggaaaataaatcctggggcccccacatcactaagctaaagggaaaagtcaagctgggagctgctgagggcaaatctgcctcccattctattcaaagtcacccctctgctcactgagataaatgcagatctgattgcctcctttggagaggctagtcagaaactcagaagaatgcgaccatttgtctctcatctacctatgacccggaagccccttccccgctgaagactggaaagtcttcccacctttgcttcgagttgtccaacctttccggactgaaccaatgttcatcatacatatgttgattgatgtcttatgtctccctagaatgtacaaaaccaaacggtcccctgaccaccttgggcacatgctgtcaggacctcctgaggctgtcacaggtgcatgccctcaaccttggcataaactttttaaattaactgagacctgtctgagattttgggggttcacatctccattgcccacctctcccccgttacagcctccaatagctacagccagtgtgagcaccaaagagtttcagggagttgatgaaagcaaacctggaatctattcactcagcacaaagaccccaaaggaagaaaggacacagtggagtcagaaagatttctctcaaagtaaaagcaaaggcctaggcagaagacacagggctcacgaatgcaggcaggctctgcaggaagccaggggtgggggaggcaggagtgactgcacacagtgggaggggtggggacactgccccttctaggatgattaaacaacaagcctctctctctctgagctgcctgctggcatcaaacaaagttaaactcaacaaggaaaacttctctgtcacacatcacacagccaacggggctgccattgaggacccgtgggctctgccacgccctagactcagaatgcttccacaaggagaaatcctcatgagatgcatgtggccaggcttcctacactgtgccctttatctcagcagagcaggcccaggctcggcagggcccacgggagagcaggccatccgtcattccaatgtgcctcctcttctgggtgaagtccctgttccatctgccaggccctgcatgatctgaagctgagacctggtgaagcagcatggcagagaaaaggggggttcctactccatcttgccatctccttgcaaagcttgatctttgactctgggtaagagcatctaaaaatcctctaaataggactgatgttattgaattcacatccatttggaatgaagaacattgtttagccacatgtctgactttatagcattggtaaggaaaacttggtaagtctggtgaaaaattagagaaagatagatgtcttatattcaaattttgaagggactacctagttacagtaaaaaaaaaaataggtctcctccctatatcttacactaaaataaatcccagatctattaaagaattacttaaaaaacaaaacaaaacaaaacaaaaaaacacaaagctggccaggcacagtggctcatacctgtaatcccaacattttgggaggctgaggtgggtggatcacttgagccgaagagttggagacaagcctaagtgttgggaacaggcccccaaatctggccataaactggccccaaaactggccataaacaaaatctctgcagcactgtgacatgcttgtgatggccttgacagcatggcccacccagggcggaaaaccacttaaggcgttcttttgttttgtttttttttttttttttttttttttttttttgagacggagtctcgctctgtcgcccaggccggactgcggactgcagtggcgcaatctcggctcactgcaagctcctcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggcccacttaaggcattcttaaaccacaaacaacagcatgagcgatctgtgccttaaggacctgttcctgctgcagataactagccagtgccatccttttatttgggcccatccctttatttcccgtaaggaatacttttagtaaatcttatgactgacttgctgtcagtaaatatgtgggtaaatctctgttcgaggctcttagctctgaggctgtgagacccctgatttcccactccacacgctatatttctgtgtgtgtgtctttaattcctctagcgctgctgggttagggtctccaccactgagctggtcttggcacctgagcaacatggtaaaaccctgtctctactaaaaatacaaaaaattagccaggaatggtggtgtgcacctgcagccctagctacttgggaggctgagatgggagaatctcttgagcctgggaagttgaggctgggtgacaggagtaaaacactgcctcaaaaaaaaaaaaaaaaaaaaagcaataacaaattataataaagttgaacacttatctggtgtctggaaggggaatcttttttgttttttaaatataaactatggaagaaataacacagtaaacatagttacaaaatatttacaaattggccattcaaaaagattataaaattaaaaggcaaacaaaaaaatatgattatcttaaacaagcagaaaaaaggtcaaaagccaaaataaatacaatacccaaatactatcattatgcttataataataaacagagaatccagccatgacagtgaatgcaacatattccagattaaacccatcagtgcagggaagacgtttttataagaatgttctgtatggttgactccccaggcacaatgtggcctaacacaagtatatgttgagtttagggtggcagaaaacaggaaaaggatgtgttcattccagggcagggctatattactgctgacaacactgtgtaactgaccatgcctagtttccatatatgaatgcaaggacaaactaaacaagatgtcaagggacaaggacagtcattacaccaagcaatgccctcagcatatgaaatactaggactggaaatggctcttcaagagggactagggaagatgttcaggtctgtgcaaattctagctttgctgggcagagctgcaatccactgacctcaccattgcccaccctaggtggtgtcagtcattcatggcccatatccagggatggaatgagagagctgcaaccatggatctgccaactgacagccatggagtgattcttccactaagaaacagacagtgaaagcaaatgtttcattttctgatgctgagtacgttcaagccgcctctttgacagccagggagtccaaggagttttcatttctaagatctagatgtataaaaaagaaaaccaagtgaagaggtttcttcagaaatgtcagcaacaatttcctgttgggtagttctagactactggagactctggagccaggccatttggcccaggctatagcgtctctgtgatgtttattctctggtacttaacaggttagtctggagttgactggggattgctactatagatgtgaaaagaataaatgttctcggctatcttgagattcgctaataaatggtaggcactggggataagttaaaatttcattgtccttcaaattagccctctatttgtggccaacctgccgcgtttcgggtttggatgatgtagtttccgtggtttactttgctctgttcagcaacctgtgcctactggtaccagctctaactgccatgtgctcttcacctgtcatggccccaagacaatccctggggctgagatggttgtggaggcaccaacaggttcaccccactgtgaagggcacactggtttccttcccaggaaaacacgggaggaagcactttgtgagattatcctggcaggcataggatatatgatatgcaactagagctactttctggaacccctcttcaaggtgcctcttttcaggcagcaatgcaggcattgctttgtgtttctgatttttaaatgatctccaccaatagacattatatgtatattacattatgtagtatattgtggtggttagttttacatgtcaacttgactgggctaagagatgcccagagagctggtgaaccatgatttctgggtgtgtgtgtgagggcgtttctggaagatatcaacatttgaattggtggactgagtaaagatcaccctcccctatatgggcaggcaccatccagcccactgagggccagaatagaacaaaaaagcagtgggagaggaatctgctccctgttgaactgggacatgcatgttttccagccctcggacatcagtgcctggttcttggactgagacttaaaccattgcactcctctccccacaccaagttctcaggacttcgaattcagactgaaacttataccaccagctctcctggttctcaggactttgaatttggactggaacttataccaccagctctcctggttctcgggacttcgaattcagactggaacttataccaccagctctcctggttcttgggactttgaattcggactggaacttatgccaccagctctcctggttctcaggcctttggatttgaactgaatgacaccccagccttcctggttctccagcttgcagacagaagctcctggagcttctcagccttcatacccatgtgagctgattcctgtaacaaatctccctctaagaaatgtatatccatcccgttggttgtgttactctggaaaatcctgaataatacagaatttggtacccaaaagtgggatgcccctataataaaacctaagaatgtagaagtagctttggaaatgggtaatgggtagaggttggaagagttctgagatacagctagaaaaggcctatcttgccatgaacagacctttcaatgtgattctggtgaggactcagaaagaaaaggagagctgtagagaaggcctacatcttcttagggaataactaaggaatcctgaatgctgataggaagtcagtatggaccagccatctccacagaagccggcagcgattctccaaggcaacagaaacatgaccctgcagccaactcagagagcatcagggctgcccacccatgtcaggccaggcacaagagccccagggtagaatgatttaaaagtaggggccactggtgcctgggactgcaagggcactgcctcacatcatgggctgcccaccctccagcactgctgtccctggctgtcccgggtgcagctctgccttgggcagaccctggtgccctgtgagccccagcagttgccttctggagggagcaggtggcaaaggctggcagtgactgtgtggttctcttttccccaccatggggagtgcaggagccttgggggtgtggctgcccttacctaaatttcaaaggctggggtccaggcacagaaccactgtagggccatccaactacactggattgggtcacccaaagctgtgggaggccacccaaagctgtggggccagggacttggagagccaacccctgccctgcaaagctccggggcagaaccgccaactcgttatgtccaaaaggcaggacccctgctccagtgggtctggagggcacagcatctagtcaaagaggattattctggagtcttgaggttccatgttattttctctgttgggttttagacttacttgggacctgttactccttttctttcctatttctcctttcggaaagaaaatgtctgtcctatgctggtcccaccacgggatttctgaggcacagagctcgtgtgttttcataggctcacagctggagggtgactgtggtcaggatgaatcataccttggatctcactaatacagagagatcgcagagatactgacattggggatcagaggaaaccatatgatttggatgagatgttgggctttagacttgagttgatgtgggaatgaagcggaggctatggagatgggatgaatgtgggaaagatatgaattttagggactggggtggaacgccatagactgtgtatgttccccccactaaattcatatgttgaaacctaacccccagtgtgatggttttaggtggggcctccgggaggtgattaggtcagaagggtggagccctcatgcatgagattagtgcccttagaaatgagaccccagagagctcattcatgccttccatcaagtgaggacacagccagaagatggctatgaaccagacagcagccctccccaggcacaaaatctgacacagcctggatcttggacttgtggcagaactgtgagaaaaaaatttctgttgtttagaagccacacaatctatgatgttctgtgatatctgcctgaatgaactaagacacgtatcgtatcatattatagcatactgttctgttctgttctatctaggtgataatacaaaagaaaattaaggttaagataaaattaaattaaatgcaattctgtcagctgctgtgaagatgagcaatggctgtgtaaatgcacctaaggaaaccactgtgttggggacgtagtggatgccgcactgaccgtgcagtgccaatagctctgctgccacaaacccacgggaccttggcttctgcacacacctctgtggggggctgagcatacgcagacggccttggtgacctgaaggcctggcagtcagaggctcgatgatgctttgtggttgatgcagcgcaactggagggattttgaagactgagccgacagacacactttcgcctgagacttaccagcactggagagtgcgggctgtgctagctcggtctcccccactgcgcggccattgcctgagacttcctttctttacccccataaaggctattgagcctgaaattatatcccgagcagtctcccagatgcagaataaaagtccttcttcccacagtatcttttagctttcaaaggtttaattcatagtaaaaaacggacttccacgagccatcgtgtggctaaacttttgggggcaaactttttacagtgaattactccacacataaaggaagagaagaaaaccataaataataagaagcaaagttaaccacactgattaccagaatgggcatgactccccaacaggtgtctttttattcttctatactcaagtattttttaaaagactgatatggttacttaactgacttccttaatagagaatctttgtcagaaaaatcttaagcccattactcttaactacttacactgcagaggtattaaagatgacaagtaatgaaaaaaatctatttcctcctttttgaatatctgtaattcaagaaatgcaactctggtaataaacacatagaggactccaccatacagaggcgggtgtatctgtaataaatcagatgcctgttaggtaagggtgatgtttatctgaaatgcaagagacagagtgagatcgtaccttacaaagggcttgagaaagacagaagtcaaagatggcttaaggaggagacattttcattttgtttgtcatcttatgcaattaaatgggaaatgaatcccttgaagagtaaacaccttaagtaccatgagcagggatgtagcttcttgctgaagaaatgcagggagtctgtcatctggtgaggatgcagctggcccagggaggcctggggaccccaggagttatcttgggataagcataggattctgaccttcaccacctccaaacaatacgcttttgagtaactttgctgccttgtgccttagtttcatcattcgtaaataaagatgatgatttataaaaatataataataataataacagtcctcccctcttaagagagggcaaaattgtgcttagaattttccttacttttttctcccctgggaatctgaaatcatccaaatgggaatcaaatgacataaatgaattagcatattatggaaatacaatctgttcaagctaccagattgatcggagctgagtttctgagtgactcagtgccttctaacgaagcatctcagcataagagaggaaaacaaataaagaggtgctgaaaataacattctggggtttgcagccaggcgggctaactccgaggaggttctatttcaagatgctgtcattgatacctgtctatgcgggtcactacacacagctctgcattcccagtgcctctgcagtgatcccatcttacaggacgtgctccactgcttacaggaaggacagagggggctttgacatgttggcaagctcggactgtgctgcctaggcccattccagcatctcctgactgccgtgggtgccatgagagtgacccaccacacagctgccaaaaacacacaccagcataaccatcagtgacttgacttgcttcaacagagagattctgctggaatgattttattttctcctttacaaacaactgaacacagcttatttccttccaggaagggaatgcatatctcctctaggctgagaaagttgacttgcagggaaaatgcttgaaaactagttaggcatgaaaacccaggtgcagtcctatcagaaaaatcatcattaccaagaaatatttcacgtaagcagctcattcgacactgcggagagcgcctaccgagacgaaggaattccacactgcaagccctcctgcagaagggcgcacctgtgttctccgtgcaggcaccggccatctttagtcatgaacatgatcacaggcctttcatattgtaactggaggtattacagctgaaccaagacatcattctttctaaccaggtggcatctaacttcctccccacatccctattcagcagaactaaataaaacctcaaccaggaaagtcctaacacagctccaaagccaagcagtctttgtggagaaaagggctgaaggtgaacacagcttacactttccaagcctttgcttgagccggcagcactctgcacactctaacaagggagagcctcacgtcggcaatgatgtggggtagttatctgttaatacaacctatcccactttcagcagggggacactgaggccaggagaggcaccccaagatgacacagctcgtggggttagagctggactcagctccagggtctggacttggtgttcctggcccctgtatcagggattctccatgttggcagtgccctagagacaccggcggaggtagctttcatcaattctcgcgctcagaccaaccaacttagagtctcccagaggggtccgaggcatcagcatcttgtgaaagtcccccaggccattccagcttgcagctgaggatgagaactactgctccatacaatacagcccatctcttaaggtgcatgaccaaccctgtttgatgaagatgaggcttggttcattcttggtctcacggttgggaacacgtttctttgcaacacattcttttaaatcaagttcccttacaatacaaagtggggatattaccctttggaattcattttatgtggaatgcattatatagaacggttacctgtaataactccatgttgagtcatgaatatggaagctttgtcaagttaaaggagtcgagcacatttaaggcatccttaagtactggggcgacaggcagcaccgccgggtcagagggagaggagcaaggttgcaagcgcaccccagcagtgtggccccctcagcagctgagcagatgacctccctcggaagtgacccaccccctctctaaaggaaggagacgggtgcccaacgctccaaacttgtttggagatcaaatggagccgtcggaagccattatcctccgaggtgagctggaaggaatcccactgacaaccctcacttccaggcacaggacaatcagccacggtttggagaaacaagctggagtttcaaaatgacttctgcaggtctcccgcctcctttcatttttctttttcaaaacatttgactattcacatgcctggcatcttccctggacggccgcctgggctttcggggttttgctgtcagcaggtggagagcatccctgcggctgttaccatgcgttccttctttctccttgacattcttcaggatgattaatgatctcacaaatcagggatattatgagggtggagaacgggttaggagatacttgaacaacttgggctaatggaacgcagaggtgttagagctgagacaaacttggaggtccctttgagtcaactctcttctttcacagatgaggaagaaacaagaaactaaggttttgggccagcaggtgtccttgcccaggctaagtgctagttagtaccagttagtgctagttagtgccaggcctcctctccacataactccgctgcatcatggttagatccagggacctaacctacttcgaagtatgcaaagtattatttgcaaagcttttctatttttctcttcagaaaatagattccaatgaaatttttgggaaaaaaaaatctactttttagtgatggatcattacggaaagccgaaacagtataagatgtaaaacaatgattagttttaaagctgacttttaaggaacacaaggaaacaaaaatgtttctattcttctatgtttatatggctttttttttttttttttttttttggacagggtcttgctctgtcacccaggctggagtgcagtggcacaatcacagctcactgaagccttgagatcttgggcttaagcaatcctcccacctcagcctcccaagtagctgggaatacaggtgtgcgccaccatacccagttaatttttgactttttaaatttttcgtagagatggggtcttaacatgttgcctaagtctcgaactcctgggctcaagcaatcttcccacctctgccccctaaagtgctgggattacaggtgtgactaccacatccagccacatggctcattttcatagcataaaaataattttagctactcaagcacattgttccaaaatattttaaaaataactttacattacaaaaaaattagagatatttcatttctgttgaaaacttgcagtaacagagtatagggaagaagacaacagctagccccaatcctgtaagtcagcccttcactttggcatgtttgcttctggcacaatgtccatctcatgtgtgtacacacaaatacacacacctcactactgctcaagtcactcttaaatttaacaataccatgattattctgtacacagagttttatgtccagcctattccacataaccatggatcaggagccgtttctcaaggacactgtggactggattataaacagccgtggatacttgcattagggagagtgaagtcatcgagatggagcgttctgcactttagctaagaggccaaggtcagccctgagggagtccaggcttagcgacaacttaaacagggtgcagcttcccgctcctccattccactgtattcctacagagcagagcaggcaggcacagattccagctgcattcccactttgcctccctttccttcagtggcgggggagggtgaggccaactttgaagggaaagaaggaaccgttacgcttgaaggagaaaaggagctcttccgggtcactcctggtgccctggagaggtgaacatggaaccgcctgatggacagtaggacagtgtgtggccaaggacaggctggagagcttcccgcatccacttgcctttgtcttaaaccacaggaagatgcctcatctgtgtttgagagcaaatctcaatgcctcgaggatgaaagagtgggttttaggaaaggaacgtattatctagcagctgttcattttaagaataacagctttttggagatataattcacattccatatgatttgcccatttaaagtgtacaattcaatggtttttaggatattcacagagttgtgtaccatcggtgggttttaaagattttaatcacccaaaagcagctccagacctgtctgcactcagttcccacctctctcaccccccagcctaggaaaccactcatctacttcctgtctctagggtctgcctctcctggacggtcatatgagtagaatcttaacccgtgcggcttggtgcctggctgttcccgctaagtacactcttcccaggcttcacccatgttggagtgggcaccagtactttattcctttctattgcccaatatcattccgttgaatagatagacactttatttttccatttcccagatagtggacatttgagctctttcccttttttggctactgtgaattggctggtgctgccatgaacattcctgtgctagtttctgtgtagacagctgtgttcatttctcttggtgaaccgcctaggagtggaccagtgaggtcgcatggtaatctctggtcaacctttcgagaaactgcaagaacagttcactgtgttggcattcagatgatcctgcactaacaaatgtctaatttaacttcctattttgaagagatagctgtaactgaagagacatagaccaatggaacagaacagagccctcagaaataataccacacatctacaaccatctgatctttgacaaacctgacaaaaacaagaaatggggaaaggattccctatttaataaatggtgctgggaaaactggctagccatatatagaaagctgaaactggatcccttccttacaccttatacaaaaattaattcaagatggattaaagacttaaatgttagacctaaaaccataaaaaccctagaagaaaacctaggcaataccattcaggacataggcatgggcaagaacttcatgtctaaaacaccaaaagcaatggcaacaaaagccaaaattaacaaatgggatctaattaaactaaagagcttccacacagcaaaagaaactaccatcagagtcaacaggcaacctacagaatgggagaaaagttttgcaatctccccatctgacaaagggctaatatccagaatctacaaagaacttaaacaaatttacaagaaaaaaatcaaacaaccccatcaaaaagtgggcaaaggatatgaacagacacctctcaaaagaatacatttatgcagccaaaagacacatgaaaaaatgctcatcatcactggccatcagagaaatgcaaatcaaaaccacaatgagataccatctcacagcagttagaatggtgatcattaaaaagtcaggaaacaacaggtgctggagaggatgtggagaaataggaacacttttacactgttggtgggactgtaaactagtttaaccattgtggaagacagtgtggcgattcctcaaggatctagaactagaaataccatttgacccagccatcccattactgggtatatacccaaaggattataaatcatgctgctataaagacacatgcacatgcatgtttattgtggcactattcaccatagcaaagacttggaaccaacccaaatgtccatcaatgatagactggattaagaaaatgtggcacatatacaccatggaatactatgcagccataaaaaaggatgagttcatatggtttgtagggacatggatgaagctggaagccatcattctgagcaaactattgcaaggacagaaaaccaaacaccacatgttttcactcataggtgggaattgaacaacgagaacccttggacacaggatggggaacatcacacactggggcctgtggtggggtggagggatgggggagggatagcattaggagatgtacctaatgtaaatgatgagttactgggtgcagcacaccagcatggcacatgtatacatatgtaacaaacctgcacgttgtgcacgtgtaccctagcacttaaagcattaaaaaaaaaagttcactctaaaaagcatgggttaaattacgttacaattgataacactgaactaaaaacttgagtgcctacaataaactagaatgtctcacctaagacttttgtgtacgtaagaattactgggacatcttgtttgaaaagtcatatatctaggccttgtttctacaagatgatgattcagtagatcaggagtggggccaggatctgtgtttgtaacagtcctctccccgcccccaaacacacagacaattctaatcaggtctaaccaaagtggtcaacttctgcattttcttaccattggttgtactgataaatgtcaaccagatttctctcccctatagaattttcaccagaagtcccacggaccttctaactcacttggaagagctcttttcctcctttgtatacttaagtggtttaaagtctgtacatatttggtctatgcattttttgtccttcttgttggtgacaggtccttcccaacatatatctcatttcctcagctagaaggcaagtgacctgaaggcagagaatgatatatttgtactgctcccctgcctgtagttgctggggacactgttgcaagacctaaaaattcaagtgccgccttcacatctcagagcctcatggggccccaaggcctctgcatgagctccctgctctgccaagtgtgcccccctcccagagagaaagtctccctaccctgcaggtttccccataagctggaccagctgcccccatccagcacccaccctaaaaggcttcagttccctgccagcccacagaatcattccaacaagccagccacaccttctgcaggaaccaggggccacgtgaccctcccgttcctaggaagcctgcctctcaccgtctcggcacctaagtgctgcccccgtgacgccctgtgtggcacggggtgccctcctccccagggggtcagtttatgtaactaataagctgctgtcagttcatctgtccagtgcccggcgctgtgtgttcaatcgcctaatgctgtttagggcagggggaagttccctctctcaccaacacagtgaataggaggtgatcagaacagatacggtaggtgcccagctagtgacgggcttaaagactgtgagcctggaacggagattttggatcacattctgactctaacgctgcactaggggctcatccctcacttgcaggatgggcgtgcagaggagctgggcagaaatcggtatttctaatgcccagtcactgggtcaacaaaggaaaacaacccaacccaaccatgagtcacgttgtatttaaaaccgagtgaggccgtcggcctgccggtatcgaggctggtttgtcaggccccatccagcccaacagcctgctcgcagcctgctgctctgctttcccaatgccgctccacggcagaacatatgtgggagaatggtatttacgcaatacagctcttctctgacaattgtggaaactctgcagggatattttaaatattcatggaaatgtttatactgtttattatcaatcagagagtaatgtgctcatttagagacattttcagaaatcgtgaacattaaatggaatgaatatttcctcaaataacggagtagaaattgcagttacctgtctctgaagcagccggcccttccgaagctcttaccttttagggtggctttcttaaggaccttcatggcgtagagctgcccagcgtcggaccccttcaccttcctcaccaggaacaccttagcaagagaaaacggaacatcagaaacccgtaagacttcaaactcgctttccatattggatttgacaaggggatacacaaggaagtttagagcattttcaataaaacaagtacactggtgagaatttaaaattttctccaacgtcaaggctgccggaaaatgctctaagttcctatagctctgcggcgaacatcactatgtgcctgtatgaagaagcgtcatttgtttttggtatcattaactttgcattttatgccagaaataataccgccccttgttttgaagaccagctgtttagaaaaacaaacaggagttttaagggagatcctttggtttgagtatccctctgtaaatccttactgagagaccacgctgaaaggtattaccaatcacacaaaacaggctctatccgattttcaagaaaagctactttctcttacttcaactgtcttcacccaaattttagctgtgagtagcttaagagttcctttctaactggatcttaaatacacttacggatatttggcaatgctttctgaaatacattttgatgtgtatcactgagaaaaacaacaaaaaaaggtaattgagagcttgagtttaaatttgtattagtgattttttaacaaacttagtaaacaaaactggagttcctttgtataaaaaaaaaaacttccatgcaaattaagaaaatagtacttgattttcctaaaagtgttttccaatagatgcaaatatctgcttgcatgatggagatgacacaggcacacggtgcactggtgtggctgcccatgcagtatggctggagggccgaggtagggtggctccttcccaaaacgtctcctttactaagcctcaaaaagccagaaagaccagccactatagatgttctagttccatggaaactccaggtggcccaagtgagcatccgtgtggagcagcagcctcacctgccatgggcagagggacatggctgggacctttgcactcttggctcccccccaagactggaggggcaacgtctagacacttaccgagtgcaggggctctaggagcaggggctgctagggcagcccaactggagggagaccaaccagcgtctattctagaggcacaaataaagagggaccgggaagacgcaaggtcccagcacaggcatgtggattcacggagttgctgtatcagtgtcacgctctcaccatgtgcccctgaagtgattccggaccccactgctgccctgccatctgtcccgatcactgtcattattgaatcacagcccctccccaggtggggactcttctagatgacgcccatgggaaagcaccccagcacccctacccggggtgcaggacggtacagcatcatcctgtgtgatgaaatgctgcctctcggacccgattaggtcccaagaagtcacaggcaattagaaagaggcttccctcttcccctgggttatagactataccatcaccgacagttaatattcatctctgggagatgtgtggagtgtgagagagagagagagagagtgtgtgtgtgtgtgtgtgtgtccccaaagctggataaacaagcttgtggtgaagccctggggcgatagctggggcatcacccttacgcacactgtggtgggagacacaggcacaagcccttctccgggctcaggatcccatggctcttgctggcagacccactgtagccctggaagttactgcacatggaaggactctgcctcagggtgttccctctgtgcagtgggcgagcttcctgacaggcaggtagagatgtgaaggcagtggtctgaggacaggatttttacagagagaaaaacattagtgcttaactcttgagatcttctgctttgaatcacgggaaagtcacatgccatgcacagttttagcttccatctgatgcaactcctttcatttctccagcccgtccgtgtgcctaatgtccctaggttgacttgatgagtggtgctgtggagatcaggaccagccaggacagtgcagggaggaggcaggcgcagcccaggagtccaggagctgggcaaggctgcgtgagcgtcccggtgccggagaggccgcactggcagagaggaacctgggtcccaaaaaagtcggagggggtgtggaacaagggacagttgtgtttgtggcagggacgccacatttccccggcatcctgcaggtaagttgggcagtgacaccagcaagggcaggggtgtgccttcctggcctaggcaatgaagagcaggtgcaaaacgttccagctgccactccctgctgtggcaactgaggacacctggtgcaggacaaaccgggcagcctggtcactgagtcactgtgtggaggatggaagccttgggtggttgctccagcccatggtggactttggtagggtgacagatgaatctatccattccattgcggcgaagctgacatgttagctcccaaaataaggcattcttataatcagaaaacaaagggccaggttcagtggctcacacctgtaatccagcacattgggaggctgagacagaaggatctcttgaggccaagaatttgcaaccagcctgggcagcatagcaaaaccccaggtctagtaaaaataaaaataaaaattagggctgggtgcggtggctcacgcctgtaatcccagcactttgggaggccgaggcgggcggatcacgaggtcaggagattgagaccattctggttaacatggtgaaactccgtctctactaaaaatacaaaaaattagccaggcgctgtggcaggcgcctgtagtctcagctactcgagaggctgaggcaggagaatggtgtgaacccgggaggcggagcttgcagtgagccgagattcagccactgcagtccggcctgggcgaaacagcgagactctgtctcaaaaaaaaaaaaaaaaaaaaaaaaagaaagaaaaaacaaaaattagttgagtgtggtggttggtggtgcgtgcctgtaggcccagctatccgggaggctgaggcaggaggatcgcttgagcccaggagtttgcaaacaacaagctccctctttcaaaatgggaggaccctgaagaaaaaggaagcaaggtacatgacggatttgtgtttggacggtgcagccttcacaatatcctgagtgggtccgtactttcaatacctctgcactcaacccctaacccataagaagtacgaccgtataaactcaaagagcagaggaagccccattccactcaagtctgaactggagaccaagtccacatggggcagctgccagttaagatttggtttaaatgatgtcaagttttgcataggtcttgacacatgaaacttttctctctcgtatgttaggccttaaagatgagatgactgatggtcgtggctaatgttcatacttatctgttttgaagagagaaccatacttttgctttttaaaagaatggaaaaaactccatcctaccaatgtctgccaagcttctctgtggggccaggtactgcgaattcctgcagcaggtgctgcctgactcgcaagcacaggacccagtggaggggaacggcaccttgagacgagcagcaaaatacagcaaaaatgcaaaaatgattttggtaacgagtgtggcaacttgctggtctgcgacagggatcttgacccttgggtgccgtgcagttccctctccctctctgctgtcattcttgtcactgaagatcaattttaatgtagtggaataagctccaaaacaacactgtaacctcgagctaacgcaggcactgtgtctttaatactcaacccagtgggcgctgtgtgtgccccctcatttcatttttagaactgcctctccagcagcttggcgtgctgcattgcaaagatgctgtgagaaccgcgacctggcaacaggtgcgatgtcactctgaactgcctcatgatgtcatggatcaccgtgatctgctgattctctcagcagaattctcagctctctctcagaactggagggtttctattgggctgcaaaatccttcaagcaggagctaaatgcccatgtgcacttccagggacttttgagtaacagccacccccaaaaggaagacatttaaagacatgttcttatcatgctaccagcaaagtcagagaaagcaaggatttttaaaaaactttggtttggttcctttttcgaatgcaggaatcataacctacagttcattctccagaatattttaaaggaaaagaggtttcctatcctactcctggcacttatgcgaataggggagctccaggagcaggtgaggaggtgggaccagggcaaagccactttcccagccccggggtggttcccacacctccctcctctaagctcgcagggaacactgggtctgcacccctcctttcaacactgaacaagcttcaccatctttcattgctttcctgattcaagctttaaattgcttttcattttgaggataaggctgttttctgtgcttttctctggtcccaagcaccacccatggccctgctctctagatagcgatgaaatcatgatggcttcgccttgcaggactgagctcagagctcatagacgcttcccgctggtggtgagtgcagcttctcccacaggaacaagcttattccggctgaccaggtgaagagcagcggcttcggagagcctaagcggctcacacaggcaggcaatgggacaagtcactcggatggctcctggtgcagtctgaggtcaggagctggcaccagtgcaaaaagtctaaagggaagaaactgcatgtcatccatttctgcatctccaatgtcatcattaaataagagagaaagaatggagtggctcagtgacaggcaactatgagccctgttgaaggactcggctcccaggcaaggcctgtcccgggacactgcgtccagattcacaccaggtctttgctctttggagcggaggcaggaggtggaaacctgaagaacaggtgctttctgcagaatgagaacattcagtgttgtccttctgtccctggtaggtgcaaaagggaagatgactcttgcataaggttgtgttatttgcatgtagagaggaggaatacagtaacgtggggcattagaacacacggcttctccccctcgtcatcagttttgcttaaattaaaaaaactcaccacaaacaaacctatgtggacaaatacaatttgtatctgtgactctctagtgacgatattagctccaaccttccctggaaatgtctgagcaacgcttttgagaatagtatctcttctttccagagtccagctcgcattaatccacgaagcggacctaagcctcccttcccacgccagccccagcctggacctcctgccccgcccctcacaccagctctggacaggcattactggagctggcccattccgtaatccctggaggtcagacacccatgggcgctgccactgcctcatccttctctttcccctacctactactgttcttgaaactttacgttttaattcctcatataataaagacacaagtaaagataaaattagaagtggtgaaaggctgggaaggaaagggacagagtgttatgagcattatcattccaacgggattctgccaaacaccatgatttcacttgttttccaaaacatgtttttttaaagcaaaattaaaattcaaaatttgaaatctgaacgagggagctggaaaagcctttctcctttcatctttaataccccagttctgtgaggaggacattggtaagattcactctgtaacagaattggtcaaccaaagccctccagacacttcctgggcctccgccatgggatgtattccagcgctccttccctccagataaagacgattcggctgattctgtgcttccacaggtggaatctgttctcaagaaacaatgcatgggcaacacccttgaaaggtggaaaaaggaaagaatgcttgcttgtctctgttttcaaatcatggagaaaattattctcctctctcttttttctctacatttctaattaatagtgaggcattccactgtcacattacgcaggctctgccttctgtgattttgtgctttttggtaatggctattaacatcgtgagaaactgaaatcttcatccccctatttcataaacaccatatcaactagccatattaaatagacatttttgtaggcccaaaatattgctggtaatttcctatggtttaatctaacgtataaaaattttacaaacaatccagttcatgcggactgtaggattatccagaacaccgatgtactattcattccatccagttcatgcggactgtaggattatccagaacactaatgtactattcattctacacttaaattaacagcagccacatgcattttggcacaaagtcatgtgaagaatgcaaagatttggtaaatgtctacataccacacaaaaatagttactttaaagagccaggctgttctgcttacatgtaaggaacggttggcttcatggtttatttcaggcccttatgttctagaaatcaagttgtcagagcctatatatttctaacagctaacccaaggaggcagagaaatcagcattgtgctggagtaagtcacgtgtcatcataattgaaaagcgttattgacatcttgttgtatgtggacgtggcattaaatgaagagccaactatttctcatttcctgaaagaaattagcttttattgctgcaatttgaaggtgacaaaaaagggaaatgaacaattccactgcacaaatacatcttaggcacctgctgggtgggattcgtgccctatttactccatggaacaactgtataaagtaggttttatcctttccatttagtgggtggggaagctgaggcttcatgaggcaatcgtgcagggtgaggaggggagccggctgcagaccctagccttcctggctcctgtgcccaatccagaggaatggattcttttcttttctttattctttttttccttgttctcttatttttttctttctttggggaaaacagctgctagaatgcactttcaaagatacattggctcaggtcaataaccttcctcaccttggtgatgatttaccaagagccaagggaggctctagagagaaggcaaaagtgcatgtgacggctccaacggcattttgttctcacctggcacagcccagccctgtgccactggaattctggctgtgcaaagtgagaccccggttctgaactgtccaggttcccgtgatcgcagccctgcaggtgaggaccgcctgcaattttcatccaggggggctctgtccaggtgtcctttgtgttcaggaatgagactcaagagacagccagggctgaacttacctttccataggatccttgtcctaaaaccttcagcagctcaaactgggaaggatctgccttctcaaagccctccttcacatgatggctgatgtctatctccttcacgacgccttcttcctgcaagagagcggcacgggtgagaaacacaccgcgaggagtccctcagagccgctcacagcttcctcctcccctgagtttaccacgagctgggtctgttacagattttagcgctggagtttgaaagtggagacaccatttagttgtgtttttttcttttttttttcttaagacggagtctcactctgtctcccaggctggagtgcagtggctggatctcggctcactgcaacctccacctcccaggttcaagtgattctcttgcctcagcctcctgccaccatgcccacctaatttttgtatttttgtatttttaatagagacgagatttcaccatgttggccaggatggtctcgatctcctgacctcgcgatccacctgcctcggcctcccaaagtgctggggttacaggcgtgagccaccccgcccggcccatttagttttatggaatcaacttggtgatgtgtgtggttattgtgtgcaccctgtgggccttcatggtttcttttctccatggacttttgtcatttggtcttaccaaggcctccgaaaaatctaagggtactctcaatgaaatccattctgctctttaacagtctgggcagaagttctggtacgatgaatatagcaactatggaacaaaatgacagcaaaagcatattgacgggttcctagatggagaagtggtctggaaaatgcagacggcttgtcctccttctccttctgattcacgctatccctggtatgtttgtcaaagctaatgtaaagaacacgtcattgccatcctatagattatatttcagaagaagcagtcaggtaagatttgccaccagcccagaaagcaagatttccctgtaggagaaagagtctataagtgaaaacactgacagaaaacactacaaattttcatcccagagcttcctgtccccagagtcacatgacttcccttgtaaaggggtaggccatctgcccaagtgccaggccctggaaatggaacactggaaaggaggtgtttctcccaacatgagacattcgagcccaactgttccttgaatttatctctgcatttctctgagatttctgttccactatctatacattcgtacacccctttctacagttttagctcggggtgaggggctgaaaaacttcagaaactgctggctaaaatgcgcatccaaaaacagcaaccaggaattgtatgcatagtgtgctctgggaaccaggggcctctcattcctcattgcttcttttcatgaagaaactgtgaagtggagattttctcctgagactcagattacacattaatagctggaagtgatagaggtgggcttctcatcaaggactgacttcgaagccaagtacttccaccctctgttttactctaagagtgaagacttccaaatgaaatcacaatagcaataacgtacatgacgatgtttgaaaaattcagtttctcaaaacggttacttataaatcttgctattttacctccatgtcacaaatagaggcacatgtaaaagcagataaggtgtctgagccgtggaaactcacagcggattagaggcctatgcagttatccatggcttttccattctcagttaaaggaaacactttcgtctccatatcttcaaggatgatttgctatttttgtaaaaacagtggtttttttttgtttgtttgggaaaacaatgagtatagccaaaattgactctgtttaatccatcctgaagttcatatgagtgcagttggaagatacagaattacaattttgttgcttcataattacttcttgaatgagtaagtaaaaatgctagaggcacagcccagccaatgggcattatatttagatgctaatttgtgaggggacatcacattttaagcccttcctcccttcacagcacaggcttactagaattgcaggaccatgctagccacccgagactgtgcagcttttgtggtgaaatctcctggtttatggaaagggacagaaaaaaatgaggccctcagggatccacgtgtgtcactgcctgtgagaaccactaccttccacgcggctgctggaggtggcttcctgcacaaaaaacaaaggcaggagcccaagttcaaaaaaattcatcatggaaacatgtatgctatcttttcccgtcattgacctacgaaaggaagaaagaaattgcagacgatttgtcatttaaagaacaacaaaatactcctcttctgttactaaaacactgtcctcgcaatgggtccattaacatcctctacctacaggactagcacgcgcatgagtcatccaaaccccagcctccctcccaaaatagctcccatcatgcagctgtgttaatgcgacgcccacactatgaaaaaaggaatcaccaccaaagcacacccttctgtgacttcattttggtaacgagagcatggcaacggccacactgcagaacagaaagtaaaattcaacaccgcccagaggtgtggggcaggcgaggcacgagctggccagggaggcttcacactgcagccaccaccctttcctggggcacgtttcccagcccttgtgtatgtttcctaaagatttccagttccttcctttttcttcagcagctctttgtggagggtctgagacccacagctgtggtgaatgagctcatgcagtcccatgggtcctggtccccttcactgcctttgtgggacatgcctttgtgggactaggctctgaagcgagagtgacagcatccgggctacttggatgccacctggccatggacgctggcacctcagaattcccatgggtgttcccctgctcccagtcagcccgttttttaggctggcttcacgccttcctcagcacttccaaattgccatcccctgttgcctcccgcctccccggtccatgccacacccccacctccgttgcagaagttcaccttctttagtcatttctgtaacgtttcgaatcaaagccttcgacgcagatatctcataacatttcaaattttgtgcagattctttctgtcaaagtattgagagcaaatgtacctgaagtacacacataatttcatctcctaaaatgacatgaaaaacgccagctttcttccctaataatattgcgatagagttcacttctcatttcaaatcagtaaggtttttaaccgcaaagcatctgaggcgtcaatggaaaaaaatccccaagagcatcacctttcagacttcagagttctgccttcacagtgacattttagcttgaacttgctggaggatgcttaactttctttttcactttccccaaaacgaaaacaaaacaaaacaaacaaagatctggtgttccatggactcggcgcgcactctggggtctgtgtgaataggaaacagccagatgaagccccagcaccatactcccgggcactgctgataacgaccctctctggacagccctggtttctggatcccttcatgacaaccaccctaaggggcaactagcatgaaaatgttactcacatttcattttgaaatatgtgccttttctgttttatgaagcaggtaattttatctagagcttgatgaggatttgcatgcaatgccttaggaagatcaagtctgttcctgaatcggctgcatccatggcaggagcatgtggtttccagcacagctactgtaaacagtatttttaaagctaacttgagagctttgggaggaggagctgggacggtgatcaggtgctagctccataagcaacaattccaaacattttgtaacgtaagaaagaaaaactagaggtataaactgtttaaatgatgtttgaatgtgacaaattgtgacaaggaatttttaaaattcctgcagaactgcactcaaaattccaatgactgcaggaagtcccgggcaggtatttcagcagctgctgggagcggctgggaagtgggagtgacagggagaaagatgagggcggttggccactggctctgcatgcctctctctgggccaaagtcgccttcttaggtcatttcctctgctctgaatcacctgctcttcatgtcattaaagggataatatttataaaaagtgcaaattaaaagttgtggaatattaatgataaggacataggaaacaaaataggcaagggttcacctcatttccaaaaaaggagagaggtcattctataaatcgcagattcacatgtaggatattaatttccagaataataacagaatatattattacacaggtggtttatgaaaatgtggaaaagaacgtatctccaactcacaggtcccatcaagccagcactgttctgctgctgacggcatgaactcatgagcaggtggacaagagcctggctttgagggcagctttggtggagtccctcctgaatcccaggtgacaaagaggctggcatcatataaacgcttaatgacagagtaccacatcgcaagtcattctctcaaggcacagaacccggacacacctgcccaggaacagtatcgtgtcctggaggttctgaacgtatgaatgttctatgttgcccacctgcttcagaatcaccccaaggaacttgttaaaatgcagattccaggccctgggcaaggccttcttggtctggaatctctaaacttggcttcgtctagaatctgactttcattatctcaccaaaggtgcccttctcaagccatccaaatcttacccattgctaaatcgagtggctaaatttccatcctccatagcactgggcatggctattcactccctctcacttgaaacactctcttcacctggattccagtacatcctactcccctgggttcgctcccacctccccctctttctgtgtctgccaaggtcacctttcccctgggcacagtccctggccttttgtctccatgtagttacccccttggaacctcgtcctgtctccgggctttataaaccatgtgaataaacactgacaactctcaaatctcaatctccagcaggggctgctcccagaggtccagttctagaggcccatccatcacaggcaactgtcctgagtgtgtgcacgtgtgtgtgcgcatgtgtacatgtggaatgcacatacgtgagtgtgtgtgagacaggtcttgttctggctttttctcacattgggatggagctccttaaagtcccagctttatgcaggaagtggggcaagaggtctgcctggggccagccctgggatttgtcaccagttcccctgccctgtgaggctgtaaacagccaagctcaaattcaccaggttgtcacctggcctccaggagaaagctggctttaactgtctccttccttgggttccctgctctaacacagggtttggcctctgcgtattccttactccccagctcactcacacttttaaacattcttaaagggatacttgatccaggactttcggttgtatttcacatgagggctagccacatgtagtctaccacgccgctagaatggaagctcaggaatgcttttaaagggagagaagattcactaaatggctttttagcctcttccggaaaagaaagacagccgcagacttgctgagaagagtagaggggagtctgtgcaggaacagcccccggagagcgagctccatctgcggcacgactcctgatagctcgtgggtcctcggcctttggttaccaggaaagctggctgcaccagtgaacacatgccacccatgacaaaaatcctccagtaggccgtttttgtaattactaaaacgaaataaaaataactagacatttgaaccaaagactcttaagaaccagaaggaacctcccatgtagcaggttgggcatcttactattcaagggacgagaattcagatcatctgaggcccaggacccatgctcctggcaaagctgcttccattccaaccagggcctaggacgtttagagtggtaacggctcgcgaactctggggccttctctgccctttaaactgccctttctgcatctccgcaaatgtgtctgcttttgctggtgtgagcaaatgtgaaatgaaatgatgggaccagctgcatttgtccaatcaattccttaggaaaccatttctacaacaagtttcccttccatttctaaaaagctaaatataagtgagccatttagtacagcagaacgagtaccctcaagaatggaaatcaggctggtgacatgggcgcttgctggaatctaggtgaaacaaagatggcttaatttaagatgaataaatctgctacaaaatcataggaggaagggaagcaggagaaggaaagagaaaggaaaataccgggtgccatgtcaagatcgcagatagaagctctgaaatttcaggagtgtgagcctatctacttgatagagggctgctcagcgagacaaggtctccatttcaaccctggtcattttcagagtttgaactgcatctattcgatacaatgctcaaatggatgccgcagaatccgcggagggaaagcaatgtgcaggaacagggctgggctctgttttctcatccatcctagaatatcactttttctttttctgaccaatgaaagtgatttagcttccaagagtggtcactgcagtcaccgcatgcacagtgacaatctaggagtgggctggctgctcgggctcctttcctctttggggagaagtctccgttaagctactcactgaagctcctcggaactgaggctgggctaatgtaaggttcctagaacacagcagcactgagtggacagagactatgggaagaaaggaggagaagcagcaaaaccagccttggcatttctctccttttttttctctttctatccaaacttgcctttctgcctccccaccccgtccctgttcattttagtgactgaggagagaggaacctcccaaggatgtttcctctctggttttaattaagccctgccacttcgccactgtttctgccttcgccttcattgcctgttgttcccgtggattattttctcttcccttcttctcagccctcagtctgctggtatttttataaatcacagtcaaggcaaattggactctgaaagttgtgcttataaacggtgactgacagatggagcgccgccacttttgcaggggcctccttcccacagaaaagacgtgcaaagagtggagagccagggcttcctgcacacacatgggctcccagtcctgacatcggccattctgtcggtgtgctcattctgataaatcctccaatccttaacctccctgggaaacgtcagtgtgaagtcctcacggaagcctggggtgttggtgtctgacacggtgttttaggtatggctccgtgaccccttccacttcatcttgaaaattatcttcaatgatttgctttataaagactcattactagcatcggggaatgagacggtagctactgactgacatgagtgtattaagatgcacaggaacgatctccgagaagcctcacactcggggcaggtggaacacgaatgcagattaggtcaagccacagtgtttcctcgtggaacagctttagatgggaccatttccggtctgggcagtgggatgagtgcccaaaggggctgaatacatctgtattatttagcacaactttaaaataacgccaggtaaaaacccggtgacagtgataccaggacgcatgcctggtgtgcacccaatgggacattatttatgctagtgtgtcaccctgactgggaaaactttttttttttttttgtctctgagatatatagtatgaaactgcactaagagatgagagaaaactgataacacgggatttaaaatcacaagtggaaaaacctacatcatcataaactacatcatcagtataaccaagaaaactacagtcatatcccagtgagacctattgggataaatttcctatttctttagcagaaaagggaaaatagaaattctacaactatcatcttctcccagactcaattatcgatgtgtccaatgtgatctcctcattctttttcaaaagcaacatattggtgaatgtttggtcaatacctctaccagaataagttgatggctgcgatgtttccattaagaagaataaaaaatgctgagtcaactaggatgtaaagaaaacgcacatcccaagagtgcccagctgttgggaacgctgagctggtgggctcttctcacacaaagttagtttcttttcttttttttctttgagacagggtcttactttgtcacccagactggagtgcagtggcatgatcttggctcactgcagcctcgacctcctgggctcaagcgatccttccacctcagccctgcaagtagacaaaattagtttctatttcaagtgtactgagcaaaatcgcaaggctatattgatcagaccgttcagatacccagcagagggacgcttgctggggtaagagaggccggtgacgtgcgtcctcctctccagcagctgaaatgggagtgtgcacggggccaactcactctacaatgctgcaacaccaccgacttagaggaaggaaggcagtttgggctctgcaaggaaaggctgcttaagtaatggatttttaaaaaatggtccaccaaatccatggcaatcagtatcacagctgatggggtgatggggaaagtctcatccccaaaatggttctgaaaggtcggcagctgagttggcagctgagtgcccgctctccggcagtggtgctggtgcccaactggtcatgcacggtgtttgtgatctggatgagagctggcagagcaaaactgttaggctgcagatcaggatgaattattcaaattgataacatcttagcaaatggagaggatgtgctagaagatcagaagaggccattccggcaggcagagtgatggcggcagccgcttaacccatggcacgtgtgcagcacgaggtcatgttttcaaaaaaacagtaattgtgccttatatggaactttatattaattgtgatagagagtagtcagctgcaatgcaggaaaggatggaaagagtaactgagtccgtgttttagaaaaagaaataccactgtgagtggaaacgcacctgccctatggggcagactggcgggccctgaacagaaagcctgcttctattctgtacaaattccatggtcgaccaataggcataacgtgcacaccttctgacccagggacctcactcctcagaattcatcaaaaacatttacacatagaaagctgtaacattatttataacagtgaagaaataagaaacaattgaaacgtccagcaagtggggaagaataaggaaaatgatgatctatccaccaaatgaaagtttacgtaggctttcagagtgattgcgctttttcccattactccaaaaagatgaaatacttacatataaagtaacaaaacaagtatagtatctgtgtgtcaaaaattacggaacatattattggaagaaatcaaagatctaaataaatggagagacatgtcatgttgacagctcagaagagccaacatggtaaagatgttaagtgttcacaaatgcacctgtaggtataatctcccatcaaaatctgagcaagcatttttttaagtatagagaagtttattctaaaatttcatggaaaagcaaaagacctgtaatacccaattttgaaaaaacactaaagtgggaggaatcactctacagatggtaaggtttgctacatagctacagtaatcaagatggtgtgctattggtgaaggggtagacacacagatcaatggaatggaatagaggacccaggaatagaagcattcaaatacacccagctgcttttggaaaagcaattcaatagaggaaaggcagcctttttgacgaatgatgctggagcactggactttcataggcaaagaaaaaaagacatttaacctaaattccatctcttatacaataattaactgaaaatggatcacagacataaatataaaacataaactacaaaacttctagaagaaaacataggggaaaattgtccaaacttagggctagggaaaaattcttagacatgacacccaaaccatgattcatcaaagaaaaaagtgataaatcaaacttcatcaaaatttaaagcttttgctttgcaaagactctgtgaaggagatgaaaagacaagctatagagtgggagaaaatgtttaaaccacacatccaacaaaggttctgcatccataatgtataaggaattctccaaagtcaatagtaaaacaaaacaatccattagaaaatgggggagacaagcagatatttcaccactgaagatacacagatgacaaataagcacatgagaatatactcaatatcattagtcatcagagaagtggagagccgcaataaagtatcagtacatacccatcagaattgctaaaataaaaaaatagtgataaacatcaaacatcggtgaggatgcagagaaactggaccttgtacgttgctggtgtaaatataaaatgttccagccattgtagaaaacagtctggccagtgtcttacaaaacaaaacatcccagcaaacgtattccagggcatttatctcagagaaatgaaaactaagctcacacaaaaacctgtactcaaatgttcatagcagctttatttgtgatgcaaaaactcgaacagcccaaatggtcttcaatgaatgaatggttcaacaagctgcagtacatcacatcatggaatactatacacaaatgcaaaggaacaaactactgttagtcacaagttgtatggatctccagaaaattacgctcagtgaaaaaaagcaaatctcaaaggattatacaatgtatgattccatttacatattttttgaaatgcaaaattatagaggtgaacagtttagtggttgccagaggtgagggatggttggtgttgggggggtgtgtgtgtccataaaagggtaccatgggggatatctgtggcgatgggacagttctgtatcttcatcaggatggtattgccacagattacacatgtgatatatttgcagagaactcatatacacacacacgagtacacgtaaaactggtaaaatacgaataaggtctgttgattgtaccaaatgtgaaattcctcgttttcatactgccctgtggttgtacaaggtggagcccggctgaagcacaaaggacctctgccacgtgttttgcagcttcctgtgactctataatcatttaaaaattttaaaaatggtaaaaagtgatttttaagtctatttgccaatattgaaagagctttgttataagatttaaagaaagcagaaaaataaacgtcatgtatatgatgattaccgtgacatttttacaaggtaggaaaaatatttatggaaaatacgtcaagatattagaagtgatagtattagaaaatataaatgattaattttctcccctttgttttctgaatttcctatacagaaatagaaaactggccaagtttctatacaaggacatttaaaatgataaactatgcgacattccctctgtttactcactgctatcctattcagctgcactgaactataatggaaagttcaggcaaaattaactgtgagttttcaaaagcaaataagatcaaacaacttgctgcaagggaaaaaaaaatggaagccaatggaaaacaatttggatatcatttctggatcaaagaataaacctattaattggtaaaaaaaaagaaggactcaatatttttaaagctattaacattttttatactcaacacacagattcctcccgtgcatgaacatggaatgtccaatcagggtacagatggcgaacatggacgcctgcaatatggacggcaacatgcacttcccagcactgcgggcagtcagggaggcagttcacagattttttcctgggaggtgggtgtctctaggggtgggtggcaacaatttactggaaactgacaaacaaaagaacttgttttaaagtgaaattagggttgggcgcgatggctcacgcctgtaatcccagcactttgggaggccaaggcggtcagatcacaaggtcaggagatcgacaccatcctggctaacacggtgaaaccccgtctctactaaaatacaaaaaattagccaggcgtggtggcgggcgcctgtagtcccagctactcgggaggctgaggcagcggaatcgcttgaacctgggaggcggaggttgcagtgagccgagatcacgacactccagcctggcaacagagccggactctatctcaaaaaaaaaaaaaaaaagaacgtgaaattaggtactactctctgtaacactaattagataactgagttaagtgtgatacatttatttcttttacattaagtagttttctagacataaatatgaagggttcaatttttttttctttcaaagtccttaggattaactcaagcaaaaccagcgaccatctcttttgtaatgtatgtgtgtgttggactgatgctcccctaatctttgaaggaaggttcaatgtgaatggtattctccaatgcataaatgagataattggggcaatggaagagaactacttctgcaatactctctggtcctaactactttttcagtttcctgctaaaagtagatcattccggatctccttgagagaggatttccaatgtggccagtggagtttcagaagacatgtggcatgtggcagcccctgctctgtgtgctatttcctatcctgacgattcttacgaatggaagccctacgaaaaacaatcaacactccagaattaggtttcaatgatgtcagaggtaacgtgcagatcatcatttagcagtttccaaaactgttgaaaagatgaaacttttggacaaaaacctcattcaaaggagttcattaaatagccatccttctttcttttctttttaaactaacctagttattgcattctaaaagattatgaagcattttgttaaaaaaaaaattagatatggtgcaaagtttagaaacggcctcaccagcccaccaggcacctgatcaccctccatccctgagcctgcagaatggtgagagcaagaaggacttggcacagaacaataacttgaatggaattaagctgactgctgaaatgcaaacatgcggtaggctttgccaatatgagctacaaattacggatttccgaacagtcttgggcacagatagggtatttcaagtgaggcgacaaactgaagtcgttgacacagcacaatgcccttgcagaccgccttccgacacagcttaattctatcagcgtttccattgtcattcgcaagcagcacagactgacaggctgaagacccacacctagtggatttcacccgcctagagatccttgttacccagtgctgctccaaagcagctccctgaccccatgaacacttacaggggaactcaggggctgtgcatggattaaatacagtctcaattctcaatttcacaggtctttgaccccccacaggacaggccacattttgtactaatgcctgcttatcccctcctacctcgcaaagcgtctggcaccatccttcctcagtctttgttcaaggaatcgatgaaaacttgtgaaatggtttagagcggtgcttggcggtccccaggaggccctgctcaaatgccaggctgcagaatcacccagtggcatggcctcacccacatgatgacagccaatccctctgtgtggcgaaagatgtgggcttgagaactttctacactccagaagccattactggcacaatatataagtgttcaagatcaaaagaaattgtattataaaagttttttttttaaatctaccctagcttgaggtttggtaaaatgccttggccacatcccccaactgcaggtgtcctgttctgcatctggaccacacgccttgcctgggagagacttcagtgatggaggagacaatcccaaaaggtttctgaagctctcacagtcacatgccaaaaagtccactatttattttagaaaaaaggatttggaaacttggttaggaaacccatgcatcgaggatgctatttccgaattgctaagtaaaaagtttatcatttcctatgcacaaaaacgaccagctctttttcagtggcatagcagggatgggccgataaccacgctggtccctggaggctaatgtgggctgtatcctggcaatggccacaggtgtgcaatggctctctacggattctgcagtctagctttgacattgatctactaggttttagtaacagcttgacatctgaatggtttattatcattagcatatgaacacacacttatataatattgctgaatgtaaaattctcaaggtaggctcaactcaaaccctggaggcagcatgtgtcttagccacttactcatttttggtttttgtttttatttttgaaacagggtctcactctgttgcctgggctggagtgcagtggtgcaaacacccctcgctgcatctttgacctccctgggctcaagagatcccccaccacagcctcccgagtagctggggcaacaggtaagtgacaccatgcccggctaattttctttgtatttttttgtagagatggtggtctcactatgttgcccaggcaggtctcaaactcctgagctcaagcagtctgcccaccacggactcccaaaatgctggggttataggtgtgagccaccatgcccagcctccacttactcatgtttagtcccacttttttttttttttccttaaactccttaatgcaagaaaatgcttgggaaagaaacaggagtcatttaaaaaaaaaaaaaaaggcacccactcgtggtgttcccaagtagcaaactgactgggcagagtgggaaggactcagagacaactcactgacccgccccgccagccctctttctctgctggctctgacgtgggccagtcagccctgactcaatgctcacatattatcacacgtgcggctcatcccattgttagaggataccattgctgagccaaacacagggcactgctttaaacagacttggctaatttctgcacccattacaagctgatacgttaaaaaaagaaagccagcctactatcatctgttttcaaatgtttccaaattgctcttctttctcagaatgacagctttggaacattagcgcaaatccccaccgagatttgcatccgtattcttggatcttattcagaacttagccctgctgaaaaatacacagttaggtcaaagtctgttcatgggaaactagtatgcgtatttcagaaggagctctcacctacaggctaccccgaggcagtggctggaaactgcaccaaaccctgtgtgtgtatctgtctatctgtctgtccaggcaagaacatttggaattttctagtgcagttcttggtgctgccatcactgaagcaactgatgcagttcgtaagttcagctttctgctacttcttcccacagagtgacatatttttcttattagacttagagcttttcaaataatgatgacctgagaagcgactgctacccctttcccagaagtaagagatctgcaaaattttgctcgttcgtgagcattttagcttctgtttcaagtcttaagactaacatattcccagactgtcaggccagttttatgaagctgaatgtgatataaagcttaacctgcctccttttgttgtaaacattggatgcaaagaagaattaaccatggaactagaagctgctggctgaataaaaatcccacgggaatttctgttccctttctattcctcttcccagctccggatgtgcatcctgtgtggggacagagagaaacattcagggacaaaacctaagtcacgaggtctgatgcgatgtgagaactcgcggctggcacgcgggtggccatgggggggtgggggtcccactccagcacaggactccatcctcctccactgcagcctgaaagcagggggcaaaaccaacctgctgtctgaaagggttttgtttttttgtttttttctaagcaaacaagtctgaccttccatccctaggaaaggcctacttatgatgagaattctgatgtcaatgtgaggagacactgcccagaccagcaactccacagcaagtcagaaatacagagattgcccaccgcatgaaaaatgtctccagttttacaaaggtcaattggtaatttacaaaacctgattttgagatgactttaggaaattgttgcttctatactttttctctacagagctagaatactgttcaagcgacagcagaaaacatcagttccctaaacccaatgtaaaaattgatgatttctctagcaatttgggctcaaagacactgcaatagcttgaaccaggaacatacatcctaagcaggtaaatctgttttcttcccaggtacgtggtaggttttacaatgggaaagggactcctccaagtcacggttatttgtgcatctcttcataagtgacaggggtgagaagaattgcacgctggcttctggacaggaatacagttctaagcagcattcatcaggccgcactctggcccacttccttgttgtgaaaagtcacatagctctagacactgaccacctgcacccctattgttctgggctctccgaccttggagccataaagcttttgtttaaggatcacttaagatgtttttcagaccctgaattccagcaaccagtttgaagacccccacagaggaatggcattggtgtagaatatagcttcttcctctccctgtcccacgaagtcaccctgtactcttccacaaatcaacaatctccacgctgcagccactccaaaagccacaatcctgagcccaaattcctcggggaggtggatttgaggttttctcccatcgcctcgttcagggatgctacgattgagcctctttctctgctgcaacccagtatctcggtgtactgactcctgtgtgcatcgggcaaagaacctattacgcttacatttcccagtcacctttcatgtttgaggtttcatcattctgaaaggtgacacagaatcatcatggaacaagagcatccttctccctacccagataggtccttcatctgggcgtcatcagagaggtgggctgctgtcacctcacttataggtaaaaatatactttaggcagactgtggggaaaaggaaggagactagaggatgctgctctaggaaggatggcccagggtggaggtgatggggaatcctagagtgacagttgctaagtggggtatctgggggaaaacagttggggcagtgagctcaggactggagtgaaagggccacggctagaagccctggggtaagaagatgcaatttctgattatttctcctgtaatccaggggttatccatatgcacttatctggagctggtctttggggagcagtgaatagcctgttcctggaccctctttctctcttctgcaaagtcctggatgggcaggaaatcaggtggctctctcctgtgcaagagtccttgttccaggccctacctgttggggttctctgctcgggttcagacagagcctcacccactgggtgcaaattcactcacaccaactcctcagctccacaggcgactgactgtagatgttactacattttcatttttcttggcttgtaagtccctaatgacttttccccctactacctgacatgttagaaatggtcattcccatagccactgaaagatacccatgttaatctccacctctgagtcaactggccttgtaagcacactaacccttcatcacagaagaaagtgaattatgtgagtgggttgtggttgggaaccacttactcctgagaagacagcagaatcccaccactaacctataggaatgaagatgaccaagtcatgctggaatagactcaagagtacagaggtgggcaactggcacacccaaaggaacacaggacataatacaaaccttcctttcccaccacaataataaaaccccaaagagaatgtaatgttactgtttctctgtggagcagaatccctctgagtccagctgtctgaatcgggcgtcgttattctaggtaggccacccacagccttccagtaagctccaccagaaacccaaacaaaacacaacaaaaaaaacttgtcagggcagtctttgtaaaagtacaatcccctaatgaacattttctattgtttcacccaggcagatttagaagcccgctagaggctggtatgctgggcgtggactcagtgtgtagctggtgtccagtgttctggccaagtccacgagttctcaggcaagtgccaagaaacctgcatgccagcaaccagaccacggggcattagccggggctgactcatcacatcccgcctcgccaaacacgttttctcttcctgttacccagtgccaagtggctgtgctgaacaagagggcacaaagtagaacatgccctccccctctctgctaagttcctccctgatctacggcaggcagttcccacccagccaacaggcagaggcagctgcagcctgagtgcgcagagggtagctcctgccggggtgaggaccgtgggcgcggagcatgcttcccaagaacagcccgcagggaagacgcccaaaacctaaatcgacataaacacggtcctggccaccacgtcccccacagactcaatggtcaggtggccggggtcactctgaaaatgaactgttctcccactgagctgtgcctcaacccaaattaacctgaagttctgtttacagggattgagagaaatgaatggattgaattatgctaatatcttcccttcccataatcctaattgagtgatatggtctggccttagagtttctctggcacctttgtcaaatgacagaaaaatcagcttttgtgtttttgtgtctgttattaaaaaatgttttaatgaagtattataccacataatagatatatagaaaagtccaggcaacttacagaaataatacagataaattacaagaaagttgttattcccaggcaaatatccagagttcaaaatgaaactcgaaatccttctagtctctatatacagactttcctcactctgtgaaccctcactatcctaatattttccataacaacttgcaaaacattttagccccagttcaccatccaaatagaaagcctgttacaccagtgtatgtcagggttcttcagaaaaacaaaaccagtaggtgatatgtgtgtatgtgtgtgggtgtgggtgtgtatagagatgtatatgtatatacagaggggtgtgtgtgtgtgtgtatatatgtatgtgtatatataggtgtgtatgtatgtgtatatataggtgtgtatgtatgtgtctatagatttgtatgtgtatatatataggggtgtgtacatatatatgtatgtatatataaagatgtgtatgtgtgtattacatctatgtatgtggggagagagagagagagagagagaatgaatcagcccccacacatatagaagctgacgagtcccaaggtctccagttagcaggctagagacccaggaagaactgatgttttagttcaagtccaaaggcaggaaaacaccaatgtcacagctcaagctgtcaggcaggaggcgtccctcttccttgggacagggccagcccctttgctctgttcagactttggctggtggaggaggcctacccgtatctagggggcaactgcctcactcagtccagtgactcagatgttaaaaccatccacaaacaccctcacagacatacccagaataagggttaactaaatatctgtgcatgtgtggccaagttgacacatgacattaatctgcatcccaagcagtgtgtgcccagggcaacactcaaggctgggctggggcagggggagggtgagaggcaagcggtgtctcagccattctccaacaggatggcgaccataagtggggcggtaaatgtgcttataacatcactgttggtggccccatgctgttaacggaaaaggttttccaggaaagtggcaaaccgtgagaagtagtgagggatccgagaggcctaataaagcccacaccgtggagaaagtctacagtcacggagcatcacaagtgctggctggacacgtgaacccatgatgacacacaagctctgacatccttgctatgaaggtaaattcagtcttgaggaaacatttggtgtttcaagtgctttatgtgaggcagaaattcttgaaagattatattggagtttcagagtttttgtgtatttgtgtattttgtggttttgtgcttttgagtgggttgagctaggaaaatgtaattttttgccatttaaaataaaggcatgtgggctcctgatattcataaacttgctatgctccatctcttcatgaggattagatctgggttaagaaggaggctttggacctggaatatgacacaccggaactactgtatcattctgtagtgggcagtgtgggcaaggattcagtagaggaaaagagacatggaatatgacacaccagaactaccgtatcattctgtagtgggcagtgtgggaagggattcagtagaggaaaagagttctgcattttctttctcaatgcacagggatagaggcatgtaacaggagaaaatacatgggtaggatgcatgacatacgaattttgtcagtgttgcctcatccttcaagtgtgcaccagccaaacacgcaaaccttccgacacttcctgaatgccaaaatcatcacatcagagccaagccaaatgaggcagaaaccaccatgctaagtgatgaatgcttctcttattaaggattagttaataatgaccatgctgtaaattactgtatcatatgtccaaagacatccccagtggactggtgagtaagtttcagtaacttgtatgagtaaaaacgataagcagggcctcctaaactctcccctatccagaatccgaattgagtaatatggtctggccttagagtttcactgtcacctttgttgaatgaaagaaaaatcagcttttgtgtttttatgtctgtgttattaaaaaaaagttttaataacatgttataccatatattagatgtacagaaaagtctaggcaacctaaggaaataatagagatatattacaagaaagtcaagttatccccagacaaatatcaagaggcctcttaaaatgttaccaaaaagagaaaaatctatgccacaactaaagatccacatttttacaagaactctcagcacctttcttctaatggcatttaagaagaaaccaggaaaacatacacatgtgaacttacaaagatgcaaaccgcatgaccttccctgacactagcactatgacatcaaaatcagcatgatttagactgagatgtgagtctagtgggcatctcataccacacactgtcaggacagtaccagacacagcagacacaccagaccacacctactgctcataggccatggaaagaagccaccaatgaataagctgggcatgcatttctggccctctgtgttctgcaggggaagggttctatcaccaatgggcccagttcctgggattccaagcacatatttcaatgcgcttacatgaaatactggtttttatttcaaagaacaactagtcttcatatttcttttaaggtcttaacaagtaccttgcaatacaataaataataaccaaacacaatgaaggcagacatgaagataaattatcattccaatgaggcttacaattgttttcctgacagtgaatgttctcaagcacagtgccagaatgcagcataaagaacaatgacacattccatacatttcgcttaagatatgtgatcagaattcagaggagaccagggtcttaatatgcttagggggcttctgaggaaggaaaatcacaaaacacacacccattgtgacgggaaatcacagcagaaaaaagagaaatggggtggtcgcgaaactccaaggccccgcttggtgggaggggagggagggcaggcaccagcaggtggagggggtggcctgggcagaggatgcaggtgcaacgtgaccaagtgaacaggaggactggcttcctacccctgaatctgcacccctcttacaacactcttgctttttcttttattcttccctaacgcttccccaagcatacaccaaaagaaatgctatcaatggtcacttattctcatgcaagtggctcattccacggtccttttggggcgtatttcttagcccaacatggtgtttttttttttccctgagactaatcccattcactcatatgtgcattggtaatccacacccctactaaataaagcaagctttttgcaagtattgatcagagaaaagcgttcaacttatccaccattaaaacaaaaaactcagggctgtttccagtagcaagaacaatcatataaacgaccttcctccatgttggaggtgtgtttcctgggtgcacttgtgcacacacactccccctggagccctacacacctcattcaggagaccctggaaggccagcgggcaggagccctgacctgcaaatgtgttgtcatctccacccatttcaagaccttccctccatccttggaggatgagaccctgtgcccagctcaaggtccctgctttgtccccgataccctgaacacttggtcttgctccttcctcccctccaccattcttcagcttgtcccccttcccaggcctgctcgttccccgccaatgggttccctccctcctataaagaagaaaatctgttgagcatggttcatcgttgactgctgctctgtgcccctactgccaccccctccccattgctgagcccactctgggagtcaccctcgactctctcatctgcttgactctgtggggggagtcctgggtcagtgcttacctgtgacagtttctagcaggcaagacggctgaaggggtattaggaactaggctgcttgactcttgctttcaagttgtagtcacagttgacatgtaccctgccccaaagccttggaaaagtctgtttacaccaggagtgtccaatcttttggctttcctgggccacactggaagaagaagaattggaagaagaagaagacgatgggctgcgggttggacaagcctggtttacacagagatttttgagagggaggctctggagcaatcacagagaagcaactggctttcataccaaacagcatgagggaggagagagcggccaccagaagccaaggtcataaaagtgagggcgtactgagcacgcatatgtcaggcactgtgcaaagcattttgcaaacattatgtcattcaatcttcaaagcaggcggagagggaggcattgctggctcatgtttagagatctggggagggaggaacacagtcacccgaaactataagccctggatattttcagagtccttagagaaggaattagacttcctacaggatacaggacacgcagcttgaggcaaatagatttcaaagcaaaatccaccatctgagaggcacactccaagcagcaccacttactcactttgcatctctaggagagctgcttagtctcctgggcctctgtaaaatggcgtgatcacagtacctacctcgtggagttaatgcagagatggcattaaccagtgttggtgatcagacactacctattatttatattattgttagtatcacccatgtatacatacaagtctctaagtatgcatttctatgtgcatacatacatagcacacgtagaatcaatgaatgtaatgaccatctctggctctctgttgagagaaacatgaaaatttataatccctgccctcaaggagttcagactctggtgacaaaggaataaactaaataggtagactgccaagcacaataaaattcattcccaaactggtcctaagcacctactaagagcccggctgctactaagccttgagtatgtcaaagtatgaccctttctctgcctcaggctcaacctggcgggaaagacaaacccgttacccataaccttccaacattccaagaaacagcctcagaagaggtttatcccaggtgctggaagtctccaggtgggacacaccaagttaatccaagatgctgagctggtggatgggacagcatggccacgatgggggctgggggctttgcagacgaggtgtcttagttgagccctgaaggctacttggacttccagaagttgggggtgcagggggcctgggatgtgtgggcaggatgactggggcagaagcaggggtacaaggacaggcgccccggcgggacagactgagaaggcggccgagccagaccgaggaacagcgcaaaaggtaacatccaagtcacaacaggagtccagagggtcctgagtgtgggaaacacaagctcttctagcttttagtccttggagtcccttccagtgtgtggaagagatccagcctgcaatgactggagggtgggagtggacgaagtttattctggagacaacaaggggtcctggtggcttttccggggtagtggagacaccgccacgtctgtgtctctggagaaggaagatggagaaggcatcctccggtgggatggggtggagctgggagaggccccagcgggaagcactcggaggagcgggggccaacccggaatcagcctctgttccttcttttccgcagctcacctgttcccggcttttcctcccagtctcctgggctcgccgccagcggtgggatccctcttcctgcacagaaccgcctcttccttcctcctggtgacagatgccccctgccacccccaggggctgcggctcccccagatgcccagcctcagcctcctgagtgctgtgcctgcccccactccatctgagcggctgaccagtcaccagactcacccccacccgccctctcccctccacacagggtagcccccaactccagccagagggagccaagacctcccaccccaggcagatcttgtgggcaaggtatctgcttaaagacattgatggattttatgaagaaaatatttaagccaatttaaatatttcagcaattgataagtaactcagcttttatgggctggacctttagggtattgtttgtaagatgtatatgattttcatatctatatcagtgcttataatattgtttgcatgaaaaaaaagtttctcatgtttgccatccatttacaaatgagctttacctatttgtaaattacgggctttcaacacgcagctggacgtggcaggaaagaggagacgattactccgtgtctcagcatgaagaaatggcagatgtcagatgtcagcgctgccaatgtttcagcactgcggttccttgctcactgagtaggaacagtttgcagaaatactggacaacctgctgtggataataaactatgtcccaggctctgtgtttcctcaggaatatatttacttagagaagcggcctattaacatttcccgggaaaatgcaaaatccattttgtgaagcagtgaggctgagttttcatagttctttcctcctccaggtgtcttcactccaagcttgtcacccgcatcattcgatcaagagtgcccagaacatcgcatgtgtcaaatccttaccgtttctgcctaattggcagttacagcctcggcccacctgtttccagggttcccagtgtcagtcggacactggaggggcctccctctccccaccagtctctggggcagattccccctcagcctaaacattctgcactgcagagggcctgccactcacaagcagcttctgtgccgctcttccaaattaccctgaagacattccctgtccgccccacgcctcccctttattctctttctcatctccaatgttaaagagtttctgaagcaaatgacaatgacagttgacagatttcagtctgaatttcccttttctagggccctcttctaggcatctatcttgcacttgctctttaatgtgaagctttttgactatttctgttgtaggagctctcattcagacgctgtaaaaacagctgttttccaaatacacaaataacgcagtctagaaaaactgggaactttctatgggggaaagtccttgctcatcctcccgagccacggatcaaggtcgagggctgcagcgtgtccctgcggcagcatcacctttctgagagtcctcaggaagcatcctcagtggccagatcccatttcaagggccctgtgcttcagggagcgggcaggagctttaggacatgtgatcccttatatgtctgagccgtcatctgtgggccatgaatgtgtttttaaaatggtcattttaattacccttatgaggtgttcacgtggttccccattcagagtctacagccaggagggaataaggcagacaccaagagccacttggcgaagtggagatggctgggctgaaagtcactcctgcatcttcctgttgagtctggcttgaaattcctgggagaaaagagcaggctggggccagtgctcggcctctgctatgcaaccagaggctctccaacttttccccatcccaagtgatttaagtcaccgccaattccaaaccattaaactcacactggagagaggcccgttgtttaagctgagatggtgctgacagcgaggcggtgggggctggctttaacgaagccctgagcttgttcttctgcggtgtgcttcagccatttctccagcttccctcgggactgactgagctcatcagaccccgggatccaaagcctgtgctgggatgcaggggtccgccctccctggcacctggctgcaggctttgctggtgtggctggcctgggccccggctgcctctgcctacagtgccatccacgctagggaacagctgtccccacaagaaccatgtggtccatgtctgggcagtgaccgcctcacttgcagccaaccccacactcttcagtggtgccgaggtcctgtggcagactcagccaatcccagtgtggacttgactcggtcttggacaccgggggccagtgagctagctgttgggccagtggggctcagcctgatactggacagagcctggacctggggcctgtggctggggaggggtgctcctgtgtgggccaacaggacggccgatggcctggaagacagtgtgaccgagctatcagctagcactcgggactccacatggatgcagaggtcaccgctggccatttcaggagacactacgcctaggagctactgcagccagcactgccaggcagcgacatcacaggaggacatttctaacaaaacaaaaagcatcttcccatcttcgtggacaactgccatgtggttctgataaccacttttcaggagaagagacacatgaaacttgggatagaaataaagaatgggaagagtgtcatggaaacctagatgaaaatgtaggaattaatcttcaaagttcagtgtgaggtgtgtgacagcagggaacatcctagggtgtacagaaagggaacagacctactcccgggctcctgggacgtgatggccttggctgggcgcaggctgctactgcaggggaggccatgttcctcttcatgattgtaccacatggggaagagcctacatcggtgtccttgccagaatatgccagaacatgcctggaaatcccaggctgctccttggcatctccaaagggccccttcacaggcgtaggcagtgtatcaggcagggacacctgagccctgccagccatgtctgaatgagggatggatggctaccacctcagtcacctcaataacctcactgttggtgccacaggtctgcccatccaccacatcaccagaggttctgtctccagatgattctgaagcaccaggctcaggcttccaggcagcagagctctgcacaggtgcagggggtggccctctcccaagctccatgcgatgctatggtccctggaagtccatgctgggtctgcggagcctgtcttgcacaggcccatgggtctctcacacctccccacccttgcctggaatctccccaagcctcttaagggaagcaattctgtccactcctggccctgaggtctctcagccaggagctacccttgctagaggggcggggatgagctctgagccagtccctgacagccccactcctgcacctgacaggctcagggaagctgggtgattggctggagatcacacagcccacgcaaagctgaaggtctcatctcccacactgttctgtgcctgtggcaggatcacagaaagcagagctggcaacagggattttccctcggacacagtgacttccataaaccctacattacatcgtcgcaggtgcaaatgtgaactaaaggagcttcttagcccaaagagttgcaaatacgctgaaaacagcttccagaatgggtcacatgaattaatggcaaaaaacaatccatgatgagccactgaggtaacccaggaagacatcacaaacacagaggccttcgctgcccttccgcagaacaccctgcttgctacccacaaaagcaccctttaatcggccatgagtcacatccatggtggcaaatcggatgttctttcctaagtgggatttgagaaatccaaatccttgacatgtgcttggccgtgagcctgcagccctgcctgtcctcccatgcagaccacatacttcgactcaaccttgtgattcactttccacacatccctacacacccatggttaatagggagacagtaacccagaggttcacgtgagtcactaaaaaaccagaaggaaaaatgagtggccacgtgagagcagctgtcagggaggagcaaacacccaaagttttgattaatttcccagggatctaatttaacataagaagtagacatggacagattaactatgggcacatgacaacacatcacggtaccaggtttctaagaaaaatgtttgcccaggggactagcttaaaacagagagtagtaaatcggcagcggactggtttgcttatagcccaatgtgcatttcactgtatcactgaactgagctggggtttcgaacagagctgggattgagataaatcacagcacatgctcggccctcagtctaaactggaaaacctgttcggaggaaacccatgcccttcccatggaacgagctgaattacctagaccagcaggagacaagaggttccatctctccccagcgatccgtgctaagcttacgtttcccaagggcctgtcagaaaaatggattagagaaacctatttccctctgaatctaaaagccagctcacctggggaaagagcacaccaccaaagtccaagggcacgccagtgcagcctctgcgcctggcagctcctcctcctgggaaacatcctgtctcaggtctaggatggaagaggaaatacctccaccgccagccccagaatcggcccttggacatcctgctctcgtaaccaagagaaaaggggacactggatgcccaccacaggcctcagctttcttggggtgacaggaatctttaagaatttcatgaaatcttggcattttcttcctggaaaaacacacacatgcacatccacataaaatctgtcacagactgtctggaattcctgagacccatccacagaagccatgttaagaaagcctgttctcagaggactgcattaaaagaaaattgaatccaaaatctattacttggccaggcgcggtgactcacgcctattatcccagcactttgggaggcttaggcaggcggatcacctgagatcaggaattcgagaccagcctggccaacatggcaaaactctgtctctactaaagatacaaaaaaaattagccggtcgtggtggcaggcacctgtagtcccagctactcaggaggcttgaggcaggagaattgcttgaacctgggaggcagaggttgcggagagccgagattgcgccatcgcactctaagcctgcacaacaagagcaaaactccatctcagaaaaaaaaaaaaaaaaaaaaaaaaaaaaaaaaaaaaaaaagcaaaattttttactggctaccatgttttggggctgaaacacataagacttcggagaccccactaaccaggcagagccctgccctggaggtgactgtgcttgtccctgcatagctagtgaccagcacaggcccaaagccatctctgaatgtatgtggcataattactgaaactagaaaacaaacatgcaaatcacaagtgcgttttgtgcaaataatgtgatattttaaatcagaaaatctgggtatcaatctagactctgcttcttcctgatttcatgattttgaacaagtacttttttttcctcttttaccaaatactgtagttgaaagtgtattaaaaattaagcttacattaataaacgtatacaaaagattatattctggatttaataacaaagaagggtattgggaaaaaaacaagtctgtaagtaaaaaaatgcaagtttactctaagttaatgggtacagacacaagcatgtcccgtataattattccctttccattggattcctccccaaggactggcacaatcttcaacccacaggggctgagaccccgcaggggccttgagactggccctggtttggcccattctgctcctcccgtcttccatggcgggttttcttctgagcgacctctccacagggaggcaccgagggctgggcgtcacgtgaggttagcgctgttcctgccctggccgctttccaagtgatgtttactcccatttcattcggctcccttgcagcatctcagatgtttgcatggtatgtgtctctttctgtagaagaaccttctgggtggtttgggaaaggccctggcctgtcatcggatgcctctgccctcgctgggtccctgctggggccgccctggaaatctccaggccaggcattctcaccaccctcttgccttctccctggacctgctctcatgaggggtctttctggtcactcccaggactcctctatgggcaggggccacatcgtaggctgctgcacggaccacagacaaggtcaccttgggagctgtggacttctgtgtccttgtgatccctctgggaactatacttactctgcacggtgattcgggacagcaaggatggcagaacacttctcaaaggacacccccctcgggaataggacatctccctgtactgacttggtgccgattccttgcaaagcgtcttcccctcgtccttcaggactgctggccagcactgaaacttacatcccaattctacagtcccaggagaaaagcctcactctgtactttcaacccctgccattgcgctgaggatcacaagattcacagaagagatgtcttattttcactttgcaggtcttaaaactctgaactaaagtactgtctagacaattatcacttgaaagaaagttcagcaagtcacacatataaatccaagggagaggctgtccagtatgagggtgacaaagggacacgttcccacaaaagaagcctactgagtacctgtcacctcttgcagcaaccccaagggtgtaacagcaactacgtggtctcagacccaggagcttcctgccatagctccagaccctcggggagcagcactgaaaaatggcagcaccccggtatggagaaacatgggcagtcaccgcctcctcaaagagaggcacaagatgggtcagcaatgggccctggctccccttccactgtcctgcatgccccgaagctgtttctgacagctgcacccactccccacagtcagatgttagggtcaccaatgacaacgcattgatttctgtttcatgtgtttcacctgcaaaaacaaaaacccttaaacttaggatataagaaattgccaccaatacttaaaactcttggacatttcagcaaatgaagtaagcacagaaatagaaataagaactacaaatatagctctaaggcagtatgcttgtatattcagcataaactaaaataaatacagcagatctaataatacagggtttagatacaaaaagaaatacacacataaattccatgcttataaatcaaaattagcatgacagtgagtgccacagggaaaccagacaacattcaaagatttactcctaaatatttaatagtgaatattaaaatattaaaaataacaactaaagggtatacagaaaagcaaagggaaacattacagagacacaaaggtagatctgaataagtagacaggtaggctgggaagactgagtatgttaattctcttcactgtaatagtgtttaacccagtttaaatccaaattttaagaggcctttttaggaatttaaaaatggcaaactttttctaaactttacacgaaataataaagaatagcataggaattctgggaaaataaaggcgtgagagagaagtcgcactgccagatgctaaaccatgctgtgaatctgcactgtcacaacagtgcggtgaggacgcaccccaggaccgatgaggccggccccgcatgcccagcaggcctgggagaccgaagcactccacacaggaaacagtaagcgcgggaccaacccataagggataccggggaaactgccatgaaattcatcaggtgaaaaatcgagtccttctccagttgccatcagataccaaaacatcttctatcggcttaaggttaaacgctgacacacacaacacagagaactagaagaaagaccagcaaagaggttgctgcttcccgaacagcaaagaactcaccctaaaagcaacagcagaaagacaatgatttagctacacaaaaacgtctgaactttaaaagctcgtaagcaaaatgaaaaagccaatgacaaacagaaaatattgagaaccacaaaatagtgtgtgcttgggcgtgtgtgtgcatgaatgcacgcacatgcgcgttctagcactccaaaataaacagtggtcaaaggaatgaaatgcacagttacatggggggaaatttaaaatccaagaaatatattctttaaagtagtctcattagtaatcaaagaaataaaattagataggtgagagacttttttttttttttgcctatctagttaattaaaatgttgagaataaaaatatctaacatttgccacgttgagcgtggtgacgacttgctgacaaatgccagtgtgagcgcagcttgaacggcctctggaaagcaatctggtgcatttgtatcaaaaatcataatcttgaaacaactgacttcctttttagaatttttggaaaaaaatcagagccagggacaaatacttctgtgtaaacgtgccatgttggcattatttatagtgaagaacagtggggggaataaaacccttacatcttctatattgtcttaataaaggcaaacaacagaatattatatataaaataaaatgcattcataatatttaataacacgagaacatacactataatactcagtttcattttaaacacaaaattctatgttcagaattttattaattttatagcaaaactcctacatagatataaattcaagaaagaaccaaaatgtccccagatattaaatatgtgtatctgagtggtgggattgattagggattctaattttctttccagttctctaattggaatatctgatacaatgtcttccatatattagctacccaataaatattgagaagaagaatgaaacgatttcaaacttccaacataaacatgaacgattactaattctaagaaaagagtgaaagcatgttataaaacaaacactaataaacagatattggtttaggaaggtggctggtggcctctcaggctggctaagccaagggatgtttacttttgtcaatttctgcagaaaccacacaagtggctggtgacgtatttagctctttcctcacagtaaccctcctgaggactctaggatgatgttctcacatagctctcattgccggctgctttccctgcctgttgccctgtggcagagccctagttatgggcttacagctcctccacgctccactggtcatatggcctggggataggggaccagggtggctgaacctggaccagcaaggccccctttcctcctgcctgtgacccctcactgagggtccttgggggacacaagcaaagaggaacatagcccacacggagcccgcgtcactagcaacggcacacgtgtctctaccctcatgcagggtgtgagacagagcagctcccacgtcctctgctccccttgaatctgcacgttcgggtctacccctgcctgctgaagaagaaaacaggggaaatgcaggaatgcagctcatgaggttgggcccagggagcccctgcgtggtcagagggagcggagcacaggaaaggaagagaaaggagaggctcctctgcatgcccagccccaccccacaccatgaggacagtgtgcctggggttcccggggtgcccagaagctctcgggagccctccttcactgacaggagggatggcccggtgcagggagggcaggagggtgagatctttggtctgtgggaagccacatcagatgcagaaagtccatttcaaagacaacactgaccctgcacaaatccagctcctctgccctgtcacgagaagggcactccatcagggcaggcgctcaccacctctggttagagcttccagaacctcgtgttatgaagcacattcagggacgggcagcaccctcgtgcaaactcagggaaaacagagggtccactgctgcacctaggttgaagaggatggcagggtctgcagggggatttttatctttttctacgtaaaggacagaagacccagcgcacgtgttctgatgcaggaagacgtactgctgtctatgtaaagtacagatcaacagcaaacccaggaataaattcctgctgaggaaggcatccaggtgcctccctgcagaatgtgcccctgggtcaggctgcagctgactttttacaaagtgagctcgccactgcaaagccccatgggttttgtcacactgactctgtggctccggcctcaccggcctttgctgcacttactcccattgactgccagggtcgtgaccgtaaacaccgaggttctcttccagagcctggtggcataagcttgcagcctcgagtccattggctgcgtggtgaaacagtctgggaacttcccagttttgaaaaaagttagagatggaacttcccagttttgaaaaaagttagagagaacttttaaatagttaatagagcattcagagagaagaaagagctcctcacgcatgtgaaggtgtgtcagatgcagcaaatccatttcaaagggaacgccgacccacaaagagcagccacgcaggatctttaaaaggactctcagtcctaacagctcacaataaaccatctctacgcggtccactcaagacacactcaggccctgccgtggtcattctctctctacagcacacagagggcaatggcaccactccttgctcttatcctgagtcctggcgtgctgaccgaggccaggtgcaagagggttttttaattttttaaattctttaaaaaaacattctggattcaggaggtccatgtgcaggtttgttacgtgggtctattgcatgacgctgtggcctggggtatgggtggccccgtcacccgggtactgagcacagtacccagtaggtagtttttaagttcacatgcccctccttccctcctccccagcagcccccagcgtctgttgttcccatctttatgtccatgtgtattcaatgctgagcttccagttttaagtgagaacatgcatttggttttctgtccctgaattaatttgcttgggataatgacctccagctgcacagatgtggctgcaaaggacatgatttcattctttttatggctgtgtagtattctatcacgtatatgtaccacattttctttgtccaatccaccattaatgagcacctaagttgattccacgtctgtgctattgtgaacgttgttgcagtgaaaatacaagtgcatgtgtctttttggtagaatgatttattttcctttggatatatacccagtaatggaattggtgtggtagttctattttaagttctgcaagagtattttaaataaaaagttatataaagataggagtaagatggaaacaggaaacatacaaatgattgcagaaaaaccaggttaattcatcaggtagcttgaaaagcgggactttctgaagcagtaaaatatctgactaggttctatataaatgaaacttgtattacctacaaatagagtagacttagtaagacaccaagaaccaccaggaagagctaccaaggatctacttttgtcaacagataagaatgattttaaatgaacaaatcgagaaagatggaacaaataatttaaaaatttccctggtctgccccactgctcccagataatttcaggtatctggcagaagaaactgactgccccaaccatgataggcacagccaccaacaaaactagacatgcaaaacgcctggctcttttaacacagcttttgtttacgaacgccatacaacttctcagagcacattggaggaaagattttcaacacataaaaactttgaataactacaatgattcatgtgatttttttgtctttgcattcaaaagtcagaagcataacacgaggctatgtgtgatccgggctcagggagtacgggggagcgctcagaagtgtacggagaactattttcagcgctggcttttgctggagtccagacctgccaaatcgagcacgagagggcaccttttgccaagatggaagcactatgaaatccaaggttgctcatttccggttcattgtgtttatcgtgtgaggctttccagaagggaaaaaagccagcttctattttaaatgacgatccactgatgagcagatgggtttggtgttgctttttgtttattctctctacatctgaaaatatttcaacattttaacttcacagaagtataatgatttttctttccttttttacatgctttcattattaaacgttttacctcaggagagttaagacctcagaacaacacctcccactgagctgaatggaaggacactaatgggtccactgcctctttatcaatgggaaccatctctctaaacacagaatttcctccatggattggtttggaagaataaaattttcaggtgtaaaggagctcaccaagatagcaatctattcatttcacatgaaaaaaaaattccaaagatgagaatgaatgacttgaggtcccaaataaagcaaaataggtgatatggtttggttctgtgtccccacccaaatctcatcttgaattgtactcccataattcccatgtgttgtaggagggacctggtgggagataatttgaatcatagaggtggtttcccccttgctattctcgtgatagtgagtaagtctcaggagatgtgatgggtttatcaggggcttctgcctttgcttctttctcattatctcttgccaccaccatgtaagaagtaccttacacctcctgccatgattctgaggcctccccagccatgtggaactgtaagtccaattaaacctccctttcttcccagtcttggatatgtctttatcagcagcatgaaaatggactaatacagtaaattggtaccagtagagtaaggcattgctgaaaacatacacgaaaatgtggaagtgactttggaacttggtaacaggcagaggctggaacagtctgaagggctcagaagaagacaggaaaacgtgggaaagtttggaacttcctagagacttgctgaatggctttgaccaaaatgctgataatgacgtagacaataaagttcagactgaggtggtctcagatggagatgaggaacttgttgggaactggagcaaaggtgactcttactatgttttagcacagagactgggcagcattttgcccctgccctagagatttgtggaagtgtgaacttaagagagatgagttcaggtatctggcggaagaactttctaagcaacaaagcattcaagaggtgacttgggtgctgttgaaggcattcagttttataaaggaagcaaagcataaaggttcagaaaatttgcagcctgacaatgtgataggaaagaaaaacccattttctgaggggaaattcaagccggttgaggaaatttgcataagtaatgagaagttgaatgttaatccccgagacaatggggaaaatgtctccagggcatgtcagaggtcttcatggcatcccctcccattgcaggcctggaggcctaggagaaaatggtttcctgggctgggtccagggtcccagagctgtgtgcagcctagggacttggtgccctgcatctcagccactccagctgtgactaaaaggggccaaggtacagctcgggctgttgcttcagagggtggaagccctaagccttggcagcttccatgtggtgttgagcctgtgagtgcacagaagtcaagaactgggggttctgaaaccacctagattgcagaagatgtatggaaaacgcctggatgcccaggcaaaagtttgctgcaggggcggggccctcatggagaacctctgccagggcagtgcagaagggaaatgtggggttggaacccccacacagagtccttactgtggcactgcctggtggagctgtgagaagaaggccaccatcctccagaccccagaatggtagatccaacgacagcttgcactgtgtgcctggaaaagcctcagacactcaacaccagcccatgaaagcagctgagaaggaggctgtaccctgcaaagccacaggggtggagctgcccaagaccatgggaacccacctcttgcatcagcatgacccggaagtgagatgtggagtcaatggagatcattttggagctctaaagtttgactgccccactggattttggacttgcatgggccctataacccctttgttttggccaatttctcccctttggaacaataactgtacccccattgtatctaggaagtaactagcttgcttttcatttttcaggctcatagatggaagggacttgccttgtctcagatgagactttgaactgtggacttttgggttaatgctgaaataagttaagactttgggggactgctgtgaaggcatgattggttttgaaatgtgaggacatgaaatttggaggggcctgggcggaatgatatagtttggttctgcatctccatccaaatctcatcttgaattgtactgccataattcccttgtgttgggagagggacctgatgggagataatttgaatcatgggggcagtttcccacatactgttctcatgatagtgaatatgtctcaggagatctgatgggtttatcaggggtttccgcttttgcttctttctcattttctcttgctgccaccatataagaaatgttttttgcctcctgccatgattctgaggcctccccagccatgaggaactgtaagtccaattaaacctctttttcttcccagtcttggggatgtctttatcaggagcatgaaaacagactaatacaacaggattggaacccaggtttcctgaccctcaagatgctgggcaacgtgttccttccctcagaagccacgtgccgtagactcctccatctgtgccctggactgggggctgtcctgctgctgcacacctacatgtactgtccttgagcttataattgggtggccctaggaagtagtgggatagtaggagcagttaagaggcctcaatgctggaggtgaacaggtgggatttgggtccgggcatcattatgtaggagctgggtgaccaggggcaagcaccttagccctccggcactttgctgttcacttttgcaaagcagagatgagtgctttggccttagggctgtgaagtttaacagtgttaaataatgcagaagaaagcaagcatcccacagatactactgatgacaataacacagctctttctttaacaaatgatggcttaaaaactaatcctggccagcatgctccaatctagagagcgaggttttgtaaacctgatcctcaggtgacagcagtgtctggaccagcagggctgctcacaggagtcaccgtgccaggatcactgtgctggagcaggcctactcaatcagagtgtctgggctcagctccgaggtcttccaccatgcgcctcgtgcattttctacacagagaaaagtgtcaattggcccaggatattgatgggatctgtgcagagatatgtgagggacaggaacgtcacagcttagaaacgcagtttatgagattctgcatttaaaacccaccttgactcaactgcactcagagagaccaaaaagcctctgcattctatatttcacatttagtgagaaggcccaggttagaaggaaacagtaagtctgatgtcgagcagcatggaaaacggaggatcagtggatcatgaaaaacaagccggaatgagaaggcgtgtcagtcaagacagccccgagccaccgcctggccgtatctgccaaaggggtttgtgatcttagacaagtatccgtttatgctgtttagaaaacaatctatagttgtattctattttctgcattcagctttttttgagtgccattatgataaaatgtcatgttattataaaatttgaagttataataaaatccaggttgagatgggcccaacaggtgcgacctgcattctgtacagaatgctacagaattcttggctgctcgggcccttcctggagtggtgctggcctgtcgcccacaggccatctggggaggaagaaatgtatgcaagaatgtcatgcttccagaggtttcggtggtggcaattctactgcaattattaaagatacattgttacactggctagttacaagtgggttatatttaaacaaaatttggagaaaaatgttaaataaaaaatgtttccaagcacaaaattgtttttggagaagatgaacatcctacgtcaccatgaaactggtgtattcaagattcaggccattaggaaacgccatgtgtcatgttacaagaaggaagcagcctgtgaaaagtgtcaaccgctcctttggcagaagaagaccagtgttgtggtatttaatgtcgctaaatttcacgatttgacattttctacattttcctttttctaagatctaaagatcacattattgaaattttatctctaaagaatggacctcttaaatagtcctcttttatgattatgcaaataactcacatactgttttgagaagaaaaaaaagacaactaaataatctgaggatagttcctctgttatcccagccaaaaagaatagggaatgcatagtgacaacaccttcctaactgcgacctttagaatcacggcacttcatcaagttcagcattgaacatgcttaaagggccgtctttctatgactcagcccggaggttctggagttgttgcccccatcacagtgggctttgggcccccgggcctgccccttggttctaatgatcagggaggtcctcccttatgtgcccactgaacttccagtctcaggctgactcacacaggacacactgtgaaaagctggagaggaaagggcccaagtgacacagtcacccgatggctctcagggacctgagggccggcaaaggtagaacaggtgtccactaagcctggagcgtagcctcaaacccactgtgccaacacaccctgacttcagccatagtcccgtgcatatccaaaggtctgaaggaaacttcagaggtgtccagtcttttggcttccctgggccaccctggaagaagcagcattgtcttgggccacacataaaatccgctaacactcatgatagctgatgagctttaagaaaagaaaggtgagtgcataaacctcataatgttttaagaaagtttacaaatttgtgttgggcgacattcaaagcccctgggccacgggttggacaagcttgctctggattgtacccagtccatgcctgtcattgtatgtgatcaaactaagcaaaaagacctgattttcagtctaccccacccccaacccctgaccccctcagtgggtccccagtgaggacggatgagaccagaagtcccaatgagcccagtgtgccttgtgtccctgggggaaccagacccgattggacacggactggattttcatgcgtagggggcggaggaaagggaggacattaaatctttaagtggttaaagacacaaaacccacaggaatgatttctaatgaacagaaaaagggctgaggaatttttcttttcttttcttttctttttttgagacgaagtctcattctgttgcccaggctggaatgcagtggcgcaatctcggctcactgcaacctctgcctcccaggttcaagcgattctcctgcctcagcttcccaagtagctgggactacagacacaccaccacgcccagctaatttttgtaatttttagtagataggggttttgccaggctggtctcgaactcctgacctcagatgatctgcccgcctcggcctcccaaagggctgggtttataggcttgagccactgtgtctggccagggctgaggaatttaatattgcacatacatattgtctatgattctttatgtgaaaatccactcaaacatccactctgcttttgacagcatcagcctttctcatgacaaaaccttcccctcagggcctatgcggagaatgccgacagcacctgggctccagcgccttctggggcctaggcctctctacacccacctggatgcgcaggtcaaagtgctttgcttctcagggagggaactgacgccccgctcagcccttccttctcctacgctccactgtcctgagggacttgatgtccaagtgctcaggtgggttcggcattttccacaaacccaaggaccaggcatggcagcctgttgaggccaccgagaggccggcttcgagtatgcggggcagtgggtgggtatttcgctgtgtccattttccttatattcactttctatttgaatgacagagaattatacccagaaacagactagtttagatttgaaagcccttggaaatcaccacttcaaatgaagacccaccctgggcgagatggggagggaacacccgctgggcaggagggcacggggagagggccggatggggtggaatgcccactgggcaggtgggctgggcaggagggcacaggaagagggtgagatggggtgggacgcccactcggcaggtgggctgggcaggagggcacggggagagggcgggatggggtggaatgcccactgggcaggtgggctgggcaggagggcacagggagagggtgagatagggtgggacgcccactgggcaggtgggctgggcaggagggcacagggagaggtgagatggggtgggacgtccactgggcaggtgggctgggcaggagggcccagggagagatgagatggggtgggacgcccactgggcaggtgggctgggcaggagggcccagggagaggtgagatggggtgggacgcccactgggcaggtgggctgggcaggagggcacagggagaggtgagatggggtgagatgcccatgggcaggtggggtgagcaggagggcacagagagggtgagcacagtggccactgaaagccgctgagccgtccatggagatctgaactgttgagctggcttccggtggcatgcactttttgaaataaagccttttcatttgaccatgaatgtgttcaacaaaaccaaacttcttgggagagtgaacatgtgttaaatgaccatatactaacccatcacgctgactgttcacagctgctcaccaccatgacctcattagttgggcggagatgaatatgcagccattttacgatcacaaattacattccacaactgaaatgtagcatggagctctgagagatttttcataaatcacaagttttatagtatgcaatgaatttttatcaaattcataacatagatgcatacatcttattttggaaaatgaaatggcatttattttctccacagaaaaagtgccaaaaaatgggcagtaataaaatttccattattcaagaggttagatatgatttccatcttgactgaaaaagccagaacgctttgaaagaacttcttttaggggttcttatgtaagaattgctattatgcatccaatgtgcagaggaagaaaaaacaaaacacaaaaaaacctcttgaataataaaagctatggaataaagcagtataataggttggttttaaaacttaaatatttttggtaacttgatgtggataataatttgaagatttaagaaaaataactcactatattttttaccttccacattttctcctactttaaaattcactcactttgtcttgacttggtcgttgactgcttttattcataattcacttgggataaacagacttgaagcatatacacgataattatttcaatatcaattctaataaagacaaagcagtttggtaagttttactcgcattcgcatacttttcaaggtatcatattacacataattagatcctagaaacaaccaaattgctacttgtgagctaaaagtgctgaattcttgcttgtttagaaagcacactgcctcatccaaggccctgatgtccagctcaccctagggtctagcactctgcaccctgtaggacttgcaccagagatcacggccttcttggggcaaaccacagcactgtcgctgtgatctgcggaaacggctccctccactttgcctcctgtgagtcttggtgattaaattgttgagcaacttcaaagcacagaggcgaaaaccaatgggaagaagcagctggtggtggagagcttaagcatcctgcgcaccttctctgagctctggccaggccgtgctgaaacactgcggaagtcatgtctacaccagggttccccacccactgtccagaggtgacaaaggagagacgctcctgataaatgtcttcacgtgacagtttgtcattaaaaaccgaagctaagcccactgaattcctgagtgcttattaaagcgccaatggccaaaagagacaagactcacaagactgtggctttctcctctggatggcagaagacgtatctcacttggcttgtttcagtccaggaggcatcacgccaaaggaagtactatgccacaggaagaaatgtgcaaactggctggttctcacgtttttctacagcattttacttccatgggttctatctaatggtaacataggttagagcaaaacacagtcaacacagttgctttagctcaagtaatttcatcaccttaccccatagtgatagtgaccctctaagggtcaacaaaaaggcgcatcttaaaatgtattttatagctctggtaggccaggtgtgcaacgaaacaaggttaataaatttaaaatgccttggtgtgttttgctcctttcttagtctgcctgagctgccataacaaagtactatggattgggtggcttacaaaacagacatttatttcccatagttctggaagctggaagtccaagaccaaggtgccagccatttggtcctggtgagggcccaattcctggctcacaggcagctgcttcttgcagcgccctttcgtggtggagcaagagctctggtctctcttcctcttcctctgaggacactactcccatcgaatcagggccccaggcttaggacctcacttcaccttcattacttccttacaggccctttctccacatagaatcacactgggggttggagcttccaaatgtgaacatggagggatacaattgagtccattaacattccatcccttatttgtagtaacagcatgaccatactcagtgatgacagggacactctaaatgtcaacatttacatcttacaacactttttatagctctattaggccagttatgtcatgacatcacaattaataaatgaaaaatgcctgggcattctggggatactcagcagctctccagatgttaaggaaactcagtataccccaatctggtcatttctatctgtgattgtgatcttttgcactttattttatagtaattttaactgaaatttttaacggaaacaaaggagctacgctgtcatgccaagttttcagtaaatacgttgaggagctgtgagctcagaaagcgttccaatagaattcatttctcatggagagaccatgattgatctatttgaaatgcaatattggtccagaaactcagaaacatttggtggaactcagggtttacaataacaacattagctaaagattcaatctggacctattttaagatcccgagggggtggcacattggtgtgtcattcccaagatgtctcaaaacacacagcagatttctgctgtagcaactagtgtgagaaaacccgagagcttcttggtcatctttgcacctctgagtgctgagcacacgtgtggtgacgatgttgctacaacgatgtggggtgcaggaagctcgagtttcaaaagaagatcataagtaacacatttttccttctagccagaatgccctgaaatacatgaaaaaagatgcagctctggctacgtgaaaaagaggtagtgagtgactcggggctgggaaacgaagccgtcctcgctgggatggactttcagtctcacatcttcagcaactttagcttcttcattatgactttttttctcttgaagattaaggaatcgaggattgctgacatgtctgtattgattagttatggttctccactatgtttactgccatcctaattacagaacctaattttcacatttacttataattgtgtgcaattgtccaggctgatcttttaaggttaaagagaaaatctcaaacatgacatcaaacaagtctttttttttttttttttttttccttattttacagctttattactgatttccctctaaaaagagactcaagtgtggagctgactcatctatagattaaggaatcacaaagtaccatagtcacttaacaaatgcaaaaaaaaaaaaaagcaattgttttacctttcaactgctgatgttatgtacaatctatcacaaaaagcatagctgtgcattcatgagctgattatatcaacctctagaattttagaaacgagcacatctaagcatatggatactctcttaccttacaaagtaaaagcattttctattttaaaatttttatttctgtgtaaaacaaagaattcctagaggtcaaataatataccaaacttaaagcactattaagtcatgaaacaaagaagattctgaggtagaagtcaagcaatataatccacagtttcaggtattcccagcaaccatcgcatttcgcaagtaagatctattttttttaaagtctcaacttccaaaaaatcaataatccattctgtaaaatcagatgtaaaactatgaccaacagaagacacccaaacttttctcatggtaacagagtaaatgcttttactaaaagctgccaacatttctatcagtagtaaccgtaaggaggccgctggttgtaaccataatgtccatattgctggggatagtaaggttcttgtctgtgttgcgggtagttgttaccccaggatcgtccatgccactgattggatcgattgtcacttggccacccccatctgttgtccctgcctctgaactgtctgttgtcttgcaaccgattgcctctgtttctttggttcccaccagctctgctattccattcctcaacaattggaggagactcaggagggcgtttcaggtattcctgatactccttgtcattttctgtgaatctactagcaaacatctcttcaaaatttggaacagcttcggcagtgtcagtcattctgaaaatcccaaaggtttgaggcagctgtattgcttaatgtttaggttgtttaaatccgccaagggctatgtctatccagctcaggccgaaccccgccggcgagacactgagaagcccaggagaggtggcctctggtccactacaccgtggaactccagaccactccagttctccaatgtaaccgagcgccttcctctccaaacaagtcttttaataaggcccatgaactagtccatatatataccagaggaggaaagaaaaagaatgaccacagtttattctgaagacatgacaaaggtaacacacatcagttatacacaaagtcaaatttcagcattacctccagggcagagggagccaacagctttcagaaatctctgctcctgccatagactggggctcccctcagctgcctcccagtggggactacattacccagccctccttgcaggcaggtgtggtcatgtgactagccctggccaatggagtgtgtctggatggtgtaccttaaagaagcaggtgcttctttcatagtctctttccccccacagctaactgcaggcccttagggctggtggagctacaaagaagaagcctgggtcccccaaatccccatgtggaagcaaagtggccagtcatcaggaaccctgacattagactaacacataaggaagaaataatttttcttttatgaactcagggaaatattttcctgaaacacaagagtgcacagtccagagaccctgggtcagagccctacaggcccaagaaaggcttggttggacactggcatgggacagagggaggcaagaaagatgagataagcacagactagagattcgtatctgcttttcataagtacaagagaaatgtaccatcaaaatcagttctaatcaccgtcactctaattgtgtggcatcagacaagctcctcacccgtccttggcctcagttccctcctatgtagaatgagggggtcctacctggattagtggttgtgagaaataaatgaacccacgcatgtaaaactcccagaacagtacctggcatagagtgggttctcaaaaataacactttagttcttcctgaatatctcatgcagtgatataacatctttcttgaacgagtctgccctttttgaagtctgccattggaaaaaaaaaagcaaaccagcataaaataaatattatatatatatatacacacacaaaaatgtaaaatatataagtggattcagaagtagaagatgaagggcccacgtctctgaaaagccacagctgaaggcgctgaaactagccgtctggcctcactagcacagtgggtagagtctgacttcctgctggctgctgtcattcatggcaggactttccgggactgtgcgctctctgccctgtggggaagaaccccgaggaggtgagagtgagaccctgcgccctcctcactcactcaggttccagccacaacagtgaatttattttgttttttatctgtttggcttatcacatctgaatgcaaaatatgcagcataaaatgaatgaaaattgagaccccagtgatggttagagaattctcgtatcatgaactaaaagtgaacttctttccaagaaacaggggaccttcgttttgctccccaatgtacacactgtgctggggtctgaagtaaacaaggcaggagctcagctccatcccagggccctcaccctccactgctccctgagtgtggtttaaaaagaggaacaaggacctccacaaagtcagcttcacattcagcaggtggacagcagaatcaaatctctgcaaagaaacagcctatgagtgtgtgcagctgctcacaggcctaaattataatttccaggtggggccagcgagttgctgcaggggtggctttctgcagaaaaaatgaggggtggctgaactggattccacaggccctagccacacagagcatcatgcacctgaactgggggtcttaggggactcctcttgggcacacgacatccctttgctgcctcctttccacagggaccctgcgctgggaacttgcagcacgtcgctgagacaccagaatctggggaaattctgcctgtccccaacctctcgctctggctgattttgccatctaatttgtagccttgcatgtacataattcctatttgtacagaaaaacaatcaaaggtggaactagatcgtctgatctcaactccagaatgtgggctttattgctgccctgtaacctggggctgctactctgccctgatgatggacacagggttcccggaagctcagggcccgaagagagtccagctgggcagtcgcacatgacagacagggtgcggcagccaatggccctccgtgctcactgtcaacccggccagcagaggccatgcataggtggccaggtgcgactacctgtgttccagcaagtagatggaaaaggaacactgtcgctttctcagggctgacttccaaattggggggaggaggagtgggtggttaagggcatctaggaggtgggtggcaagggagtgcccccgcagaaaaggaggaagaagctctaagcccttgatgagtcagagctgaaattagtaacattggggttgccactactctttcaaaatttaagtcttttataaaagagccccaggctttctggaaacaggtggtcagattgaaataaaaatgatggctatggggccagtctcctcctaccaccagcaaaagccaaaagtgaatttatgtttcacagccagtgtggagaaagcgtctgctcaacagctcaacaggaaaccacggtgcattccagggcccctcctggggttcctttgctcattttcacataaagaaagaaaaaggatgggaagtattaatctgcagcactaagtatgcacttttgtgagcacttgttctaaattattgccattacatatccacactggaattgaaaaataacccagctcaattcatcggccaaagacacccagcctccatggtcagagtatcttctatgcccgacaggagggactgtacccttagaattgaaatcagttgaaatcagtcatgcttcatggaaggctgcataaacaatgtcattctacccttaggtattttaccctcattaagtcgcagaaaataagagcctaaagggaaactgggaaattgaactttcagcttttactatcagctccaatagagactgttggtagaaatgggcgcacatcacctgtgtctccagcatctctgcatgaaaaacagagcgtggtctatcagtcttacagaagactctcacccagtgctttggcccaaacaaatcagatttgttggaaacattttcaaaatttctaactcctagatttgatatacaacataaactaaactgtggcatgaacagaatggagagagacttgggatcttaccgggagacaagatcatacccaccaacccaacaaatgaggccacaggcatgcaagtgagatacacagaaaacaagaacaggaagggccagaggaagaagggcccctgggcagcttgattggggtgctcagaggaggaggcaagggaactggggggaatacagacggtgctgtggagagggcattcaaggtgaaataaaacagctcaagcaaagacacaggggctggaattggcaagcatcatcgggatgataaagactaaatctatttgattagagcagccttctggttttgcttcttttgttgttttgcttatactttttgcttaaaacttggacatagtgggaaatagaatcagaacagtaaattactagttcctacatcagtaggctttgaggagcaagaacctactaaacgctgataagaatcagtcattagggtctggcagatacagcatccacgtaagattaagttcacagattcccagtgtgaactccgtgtcagactctgctttaggaggagacagatcctatttcagggctgggcacacctaaagatggagcctggcgaggagcatgacttagggtgagaaccatgccatcagcctgccccagaagaatccagacatgcagcagcacaattgaaatcctcattgaggacttcaggtcgttgcactgtactatacaggggattcgtgtggaatgagttgattgctgctgctcttgccccacaacacacacacgcacgtgcataactgaaagcacgtctatgttaatgggctttcctgcagtaaccttcttactatctctactcatttcccgttgcatcatgtataccttaaacatacacaataaaactcattttaaaaaattaaaaaaaaaacctcattgaggcagtgagtataatcaacactaacggataagtgatggccccaggcaaagagcataaataagggaacggaagagatcatcaaagacacgacttagagtaaggccttgctggatttaaaaacagattaaaaccaacccacacaaacctttgcaagtaaaatggatctgcctgccatgtcacagtcaatgaagagtcaaatctgagcattatttaattacaagcatcacaaaagcagaaaaacaggttgtctcggtctgactttagaattctcttctacatattaaatgccagaagatgccagagagcaatgttcactgagcatcaggtacaaaaaggttgcagcccaggcatttcacagtcgcccaggcactcttcatagatgcaggtgatggaaaaggccagcgtgcaaggactcagcaaacacaccctccacgggaggccctgggggcacctcggaaagatgttaccatcattcaacgcgaccaacagtgccacactggagtgccttctgggatgagcagaatgcctttagaccagtcacagtgtggctgcttccgtccaaatggcgctcggcatgggcatggtttgatgtgtgccccccacccctgaaaaaagacgtgttgcatgtcttgacttggaaacatgtgacttgacttggaaacaggatcactgcaaatgtgattagttaaaacgagatcacagaggaggcgagtggccctaatccaagatgactggatgaccacctaatccaagatgacttctaaaaaggccactggaaagcagacacacaccaagaaggcggccctgagatgatggaggcagccaaggagtgcctggggccaccagaaaccagaaggggcaaggaaggatcctcccagggcgttggagagagcttggtcttgcccaggtatagtctcggaaatccaccctccaggactgtgagagcataaactcctgtcggttaatcccacctgttcgaggtagtttcttacagtagccccagaaaactaacccagcatttagtttttactaaaatctcatcagtgtacccaccatggccaccttcaagcctgtgtgtattacacactgagttccacaagacagaaggctgtggacaacagcccccaaacccaagccggcccacactgatggcactggctgggcccactgtacctgcagaagacagaagcatctgcaatacagaaatcactcagagcttagacaatgagaaaatgatggacgttctgtttaaaaaataatcaccagccagggcgcagcagtgaaccagaaagttctcagaagtcctgaaaagtgggcaagagatgggcctggcttgtagagaaagtgacttcaccaaataccagcagaaagagaaagacttctcgagggaactagagagtcacatattataaatagtagcgagggtcatggagaaatcaacaggataatgaattctctgctctatgtggagtcctggcctgctgagagcttctgatgggtgcacctcagattaaaaccagggaactcacctgcggggaagagggccccggtgtggtgctgtgaggggctgacaagcccggcctgtcctctggatttacaggggactacttattcacccaatctatgggctaggcagaatctgtgaatctcactttacataagggaactaggaggtgagaacttactagttattcttataactaataagtgaggagctggaatgtgaacccagaagcccagagtcagtgttggtgaccattctgctgtaatgcctgatacgtgaggggaagaaatcagaatgtgaatcagcgcctgtccttatatcaggcccggattgatgagagggacagaagcacagaaagggacgggggagggcaggcagggcagccaccgcacagaactgtactacagcgcttcacttccaggagagcactcctacctgcccacctgcggtctgcccttacattctacagggcaacggctcttggctatgtctactgtgactcaaagaacaggccttcggggaaacagatcatgccagcgatctatcctaattatattcctaattatattccttatgaatcaataacaaaaggatcattagacatcggagaccaaaaacatcagcacaaaaggttgaaggaaagtatgtttgaaactcgaattcaacatcaagctgagacagttctcacaggaacaggacaaacagacgtgttagtcactcaagacctcagagctcaccactgatgcaacctcgacagacaccagtgagcaaaagagcagttcaggagaaaggcgcaggacacagcagaaagaagctttccgatgcagtgtgagcaccaaagaaggcggcatgaagtcaaaggagaattcaggggcccttaaatcccaatcaaatccccaacatatacttttggattctaagcgtttggaagaaaaattctttataggtaataccagagctaaaagagaaacagaacagaatacaacagaacaaaatagaatagaatgaaatagaagagaatggaatggaatggaatagaataaaacagaaaagaagactatataaaaacagaacatttgacaaaagtagtatttcagattgtgggtaaatagctagttctaaaaccatatgctggctcacactacagtcaactggaattattgtgatcaagtgttaacagagtaaaattataatatagccagcacagtacaggcaaccaggtccacaaatctcagaatggtatcgatttttcttatgcaggtacaacagcaaagagataatttataaaggaaataatttatagatttggttacattaaaattgacgtgcgtcaaaacattccattaaaaaatgtaaacacaaactggttttcggaaaaaaaaaacttgcaaaaggcaagagctcttaatatataaagagctcttacgaatcagtaaggaagacaaatagttcaattaaaatggcaaaagatctaaacaggtgattaacacaatcaataaacatatgaacaaacttcaaactcactaatacttaaaatgtatatttttaatgtgtcaaacttctataaatgataaaatgatatcaaaaattctgagaatataggagagtaaaaatctcagataactcaggtaacactatcacaaatgtaaatgcacagaactattctgttcatgccattgacctaacaattccattcccgacaatttaccctaagagaataaaagtgcacggacaattctgtgttcaagaccgttcatcataggggttttagtaatataaaaatcgaaatgaatttaatattaaaatatatgattaactaaatacagcttactttatttgatgtgtgaccattatacttgtatgtgtggaatatttaatggtggcggtaaaattctgaaaatgtcttggtaagtgatatgaaacagtttctagaaggtgattcaaatttttaaagaactgcacatatgtatacatgaagaaagaatcagaggaaatcaaaaatttaacaagggtcattctaaagtagaaaatgttaaataatttgagtttttaaaaatttatttccctcataattttcacaataaaatgtgttattttagtaagcagatcaaatatcttattaaaaaaattgtcacgtgaaaaaacaaaacaaaaaacttgtctgtccaaacacattttcttttttttttcttttttgagacggagtctcgctctgtcgcccaggctggagtgcagtggcgcaatctcggctcactgcaagctctgcctcccgggttcacgccattctcctgcctcagcctccccagtagctgggactacaggcgcctgccacgatgcccagctaattttttgtatttttagtagagacggagcttcactgtgttagccaggatggtctcgatctcctgacctcgtgatccgcccgcctcggcctcccaaagtgctgggattacaggcgtgagccactgcgcccagcccaaacacacagatttttcaaagatctgtcctaaactatcactttcatagtgcttttctgctataaggttctcagaacaccaaagttctttccatccagtatttactgagatgcaaagaaacaaaagaagtaaaaagataaaagaggcaaaataacataatggaaggagatctggaaactgggtctgggattctaacattagtcttgaaattaactggttctgtgacctaagccaaagttcttggtcttggttttctcacccaaataaacaaagaagttgaaatgaataatttttttttgtttttttttgagacagagtctcattctgtcatccaggctggagtgtgatggcaggatctcagctcactgcaacctctacctcccaagttcaagcgattttcatgtttcagcctcctgagtagctgggattacaggcacataccaccacgtccggctaatgttttgtattttagtagagactgggtttcgtcatgctggccacgctggtctcgaactcctgacctcaagtgatctgcctgcctcggcctcccaaagtgttgggattacaggcatgagccaccgtgcccagccaaaacgaataaactttgaatgcaattttgtaccctaaagctctatgatgctatttcataattcccaaaaagccaagttcaacgacagcaaagctgcccagggaagcggttgtatcctccacccgcacagactgcggctgtccactgggacttcaatccccagatatgcttgtgattggaagccctttttcctctctgaaatttcaaaaggtgctgcagtcacagctggttctattttgccactgacaggcagacacatatttttatgcattagtaaccttaggaatctcagcccctcagtgatgtgagtcaaacaaacacatttcatgtttctaaggagagaatccagtctaatgttaaatgatcttaaggaagtcattctgtccttacatgatctaccagtcaaggaagacaggcagaaagatataaaagaataaggatgggtacacataaaactacttggaggaaaactcccttcaatgtattaccaataaaggaatggggttccctcatcagtcagtcctgagccaagcaaatccaagcctggtcagaggccaagacctctgaaagagaatggcttttagaacttattgtaatagtatccaaccagttttttaaagcttaaaataagatacacaaggtttggatatggaaatctttgaagagtcattggtatcttatctcacagaaagggaaaggctttcaatgggtttaaaatatgtgacttgcactgtgatgccaggcaaactgcactcactagagttgatgtgcaggaggtttggaaggcggggcggcctccagacaggggtcacaggccatggggaagataggcggtaaggtccacgtgatgatcaaggaaggaggtcggtttgagtttatggtcaataatactctgtgtgatgattaatactgactgtcaactttactggattgaaggatgcaaagtattgttcctgggtgtgtctgtgagggtgctgccgaaggaggttaacattcaactcggtgaactgggagaggcagacccaccctcaatctgggtgggcaccatctcatcagctgccagtgaagctagaataaagcaggcaggagaagatggaagagcagacttgctgagtcttctggtcttcatctttctcctgtactagatgcctcctaccctcgatcatcagactccaagttcttcagtctttggaatctaagacttacaccagtggtttgccaggggctctcgggccttcgctcacagactgaaggctgcactgtagtcttccctaattttgaggttttgggactcagactgatccaccactggcttccttgctcctcaacttgcagatggcctatagtgggactttaccttgtgatggtgtgagtcaattctccttaataaactccctttcacatatacatctatcctattagtcctgtccctctacagaaccctgactaatacactctgtgaggaaacactgggcctgaatatgggagacaaacagggtggggggtttccaccactgaaatctttactgtgggaccagcagagctgtcccaccgtggatggacaagctatgtaggggtgagggggatttcgaggggactgtggtgattcaccacagatgcgccagttgggagctgcagagagaggcctgggtgatgggcacatgtgatgtcaggcacagtcatgggaacagatggagaaaggacacggggaggggccacagatgctgagaaccagcccatggtgttcacccacgaaaacgagaccaagtgagatggagagaaaggaaaagaaacaagatagtgcacgccatgggaggcaagagaggggcacaggtggctggggacataggctacgggataagtcgaaagaatggagtctctagagggcagagctggtggcgaggcaccccgtgaggccccaaaggacacagcccccgaggacgaatgggactcaacaggtggagacagctcatctctgaggaggtggcagtcactgaagggagaaaaaaaggacaagagacaaatgtgaagccaacacctggcagccaggccatgggggccatttgagcatctctacaggacacagagctggggaaaaggacggcagtggagcgggtgctgggctgcagggtggaggaggaactggcttcagaaggaggaagagcatctcttcttctgggaaaaaaggtaggaggattggaataaagatagaggagacatttaacacataaagaaaacgtaagccattttggaaacaatcgttctggaatgcaatgatcatggagctgataacatgcaagattgcagctctaatagacactgtaggcaagccaaaattttcatgaatttttcatggatttaactagtagcctcaaaatgaccatttcatattattaaacatcaagagacaagaaatatccaatgggtgacggcatcatcgagaagagaatagaaacagatttccggagtccacgggctggtgagatgctctagagagcaggactctgctctctggtgtgccagccccagccgggcaccgtgctattgttggttttcatcacccagttcctgtcagaaccactgcagtcatgccacagacagagcttttgtgcaaatggtattttcttccctattaaaatgttctactctgttcccatctaaatgggtccaggagcagtcccagagacacctgcaaattgcacagaggcatggtttgatttcacatgctcctgatgaccataattgttgctattattttccttactatttcacctctcaggcagaaagtaaacaaaacacttctcaggagagagcggggagaaaggaagagaagacattgtggggccaaattggagcacaggacggcatttgttgaaccgttctgatttcctttgatgctttccctccctgctgttcaggataatgccttgttctcctccctaacttggtgtggaaggaatccctccaaaaggcaatgggggcagacagaccacgcttttattttcttataggcatttatgttcttacaggaatggtttagagaggcttatggatgaattaaatggtttgcaaaattaagactggattctctaccaagtagataggcagggacaataaaggaataaaaagccacatttggagctaatggcattgcaaaaccaattctggatggagaagttggaatcagatgaccctctgaacttgaagacatttggtgaaacagcctggagtctgcccatcatgcactgagtcacgggtggttggtgtgggtagacgctctaaacattttggctctaagcgcctctgtttatacaacattctttcccgttgcgtcaggaataggaagcctgttttctctgagataatggagtcaggaagagaaatcatgtcccaactctggtagattttgtggcagtccaggaaacaacaaggcttttctttgtataagcacacagcaccgctctttcctacctcccttctttcctgcctccatccttgtattccacagctgatcaggactcagctcatccccatcagacacggctcactctcaagtggtcctccaggtggggttgaaacagtggggtgtccgatgcccaggcagggcccagcccggcctgtctcaggggttactgctgcttgtccaggtctgtaactattgtcccaggttcggtgatcaaaatctctccagataaatttcatcctaagaaataattaaagaatccagagcaggagtcacctggtgcgtgccatatgtaaacaaccactcttgaggatgtttgaagaagcactggattggtatcaaggactgaaagcaggtagaggtttttagaaaggtaaattctgctaactacagacagggagattggaaattagcttgacaacgtcttagggaggaagcagtgatcaacaataatcaggagagtcatatgaaatatgtgctgatttccttctctcctctgatgaggttaccagatgggtaggtgtggggaaaatggtaaacagtgtctctggttttcaggaagaatttaacaaggttttctcattatatacaccgaataaaatgaagaaatgatgactggcagattaatagctgcctcaaccaaagggaagtaattaagcaatccatgtcaaccaagaaggcagttctgagggcaccctcctggctagctccattcagccttctcattagcgccaggggaagcacgaagcttcatgacacggggaagacagcaggtcacttgcaggatgatgggatatgtatctctaaaaataccaaccaacagacgcatgaatttaagaacaaaataagagacataaatgcaacatcttactcttattaaacaaaaaacaaataagctgtagggggaggggccagattagcaggagtgttagcccaatatgcgctcagtaatgtgaggatcgtgttaagtgctgggagaaacgacacaggcttctgtgtgcatcttcccaaggcaggtctccttcccactccatctccatcctccatgcgtcactctcaaggcctagagcagaagccaccatctccctgagccctgcctgatcacctccctagagtagctccttccgtcatgatccaagggacacccagcctcccctcctccgtatatgggtgagggtggtaagtttgtttgtttgtttgtttgtttgttttgagacagagtcttgctccatagctgaggctggagtgcagtggtgccatcatagctcactgcagcctcgaactcttgggcccaaacaatcctcctgcctcagcttcccaaataggtgcacctactataggtgcaccaccacgcctggctaatttatttttgtttttagtacagacaaggtctcactatgtttcccagaccagtctcaggagctcacgtgatcttctggcctcagcctcccaacatgctgggatgacaggcacgagccatcatgcctggccaaggttactgtttggcatctggcttcccaagtggaccatgggctccaagggcagagacgatgtctgtcttattctcagatgtttagccaggcaatgcctggcaccttgtagaaactcaatcaaggcttgctcagtgaagataaatgaatgagtcaccaccatcagatgtgattttcttccgatctaaattcacctggtttccctgtttgacacactgtcttgggaatttggaaatatcccttattcctgatgggttttgagatcctttagtgcaggaagtccacctgattatctttgaataagaacctacgagagtctaaaaactggttgcataaacaaatgggagaagaaaacactaattcttttaacatacaagttgttgcacttgccctattttcaggactaaataatatagctgcatgtagcgtatttgaagtaaaatgaaatttcagatgtgtagaaatcagtgaaagaagctcattgcacaaagtgaatagaaatggaaaatggaatatgcatgcattttgaaattggtcttatcaaaatcagtaggaaattaaattttaaactcagtcattcttattatattatccctattgaaattcatcttgcttttgcctgtaggcagggagcaatttattaaaatactctgcatatccaatatttcttaaacaaacaaacaaaatctcttatactcagctcaaaaagatggtgacagatgaaggaagaattagaagtgttaaaaaaagaagaaaaagaaaaaacaactaaccacgtggcctatcttagaacctgactgatgattccattcagataatatttcttgggcacccacaggccacaagccacatgacattagatagagaaaatgatagaaatcaagccatatttctctacttgcaagcaagttatatactagcagatacatacaatacacaaaatgctcttaaatccaaataaatcacattttcatgatgcaaatactgacagcttaaatcgacatagcactccattggttacaaagcacttctacctaaaacatcttatttaatttgaaagtaagttaatctagttaggttaaagagttgtgtcaatcgcaagttgtctccaaaagctacctggagcataaagaaccaagaagagctacgacaatattgagaaaacccgataagataaaggtaggagagacttgctgtattagctatcaagacttcttttaaactgatggttaataggacagtgtggttttgacataggttagacacatgaaacagaatagagccagaaatactccatccttatagggaattgtgtgaattcagaagtgcttgcaggtaaatggagaaaggatgaacaacacaataaggggcactaaaaaaattggttatcttatttaaaaagcagaaaacaaaactagttccattctttacactacacaaagaatgcaagtcattaaagaccaaagcgttaaaattaaaactttaaaaattttagataacagatcacttttacaacttcagagtgaggatagacttcttaattaagacacagaaagcatataatgtaaagaaaaggatgaatcaattcagctgcataaaaatttaaaacttctgtataaaaaagtttaaaagattggccacaaacttgatagcatttacaatgcatgtaactgatgaagagttattatacagaatatgtaaagaactcttataaattaactaaaagaggcagagaaaaggagaacaggaacactgtatagatggggaacgcaaagagaactatcaatgcccctgacatgtgaagggagtctgaccacactggccatcgggcagtgcgtgttccggccacggtgggacaccatctcacacacagccgatgggctgcgactcagtgcctgatgtcctaccaacagcaaggagggagagaatgagaactcacatctactgttggtgggaatgcatcttatacgacgactttggaggaaatttggtaacatttactatagttgaagatcgtgtgctccatgacccagcaatctcactcccaggtatatacccgagagaacctcccccaacacctgcccctacggtgctcaagggatggatgcacaagatcattcatggcagcactgctctcagaaacaccagaaggaaacaacaagcatccagccccagggcaactgacacaggactgttggcacagtcagatgaaataccacgcagaagcaaacataggaaccaagcgctacccatcagcatggatacagctcatgaatgcaacctggaacaagacgcattcatgcatacacgagatgactccatttatatgacacgtaaactgcaaaaaacaatacagtgtttaggatacacacaataaaacaggaagaaatatacaggagtggtagacctcaaatccagggaaatcgtagcctccaggtgggagggagaaggatgagactgggggaccataaatggtgttcaactgtatcgataacttcttgatttcttaagctgaatttatgggtgcaaaggtgtttcttaacagtattttgattcctaaatatgtctgaaatatttcctaagacaaatttgaaaagggctcaagtcaatatttctgttcactgagtagaggaagttttctgcaagccaatggtctatccacagtgagaatctggagagagagagaggtgttggtcaggggcacctaggaacccattctgctttcaccctctggatgagttcattcaaagactaagagacctaaacatttggaaatgtaaacattcacttacatctgcatctgttaagtgttaagttctgacatgagcttagtctaaaagggatctgggcgggatatcaagaaccaaacatcacagatccagaaagagccttccctctgctacttccctgtctgcggtctctgcgtgacacaagttatggtttctaagggacagggaagcttggctgagatcactgcacctgctctcggcttgtgtgggccatggctctttcaaaaaagatcgtgctgcttagcataattaaaccaggaactcagcgcagcctcagagtgcgtggggtggggcagagctctgggaggccgagtggtgacttcctccagtccagcatccaccagccacacgggagatggtgtgggatgtgggatctgaaaggcttcatttggcctcataaatgggattagcatgggggcagctaccgaccagtcaccttctggagtcgagggcgcccaggtaaagggctttggcatggaagtgcaggttgctgaaggagtcatgggaggggacatgacagaagatgcttccacctgggcaacacctgtcattgggagggcatcgtgaacatggctggcacattccgggtgatctaaggctcaagttagacaaagttaacaggcacaggaaggatactgaatattgcgaggttgcagaagggaggccagggaatggctgtggcccaggtgtatcaaataaatgcccccgtactgttgtttgcgataacaagtcaggggtgttagaggagccaaagaccccctcagcacccaccaaacgggcaatcgaggttgttttaggcagaaactggattgccgcaaagctgacatgttggaaggggtgagatgagagctaagaacttctccaactcgtcctaacgtgtccctcctagaagtcacgaagagaaaagggcgagactatgaaacaaagtgtgtaaaggtggaaagaagtaaaaataaaattaagaagagttccatcctgattaaccctccatggaaaagctccagagaaggtgcctctgccaattgaaagtttttcactgtgagcaactctacgtaaaatgcatctggaccagcacattcccctgtggacagctctgcatggagatgtgacggggacaaatgatctgggaaatcattgttttcgtatcagtgtttgtaagtttcagagtttacttgaatgggaacataacagctcactaataaaaaatgaggaatgtcttactttttttaaaaaacgtttccccaaataggtttgcttatatgatctatttgggggtttggaatgagtatgtggaaaactgaaaaaaaaaaaattcagaaattaataaagacataaactccatgttttataatgcccagagtggtgcgtgcttccccgctggggtaactgaagttgccggagctgggttcactggggatcgtaagggagcttcccgggcggggccatccccagctgggggaggtggcatccaggcacctcatatgccgtgcctcgggccttacctgagcatcagagtttttaaaagtccttctgtcatgggcttgctgtaagaagtcaacataaatatggacagtgctcagaacatggggcgcctgatgtctggagcagcaaactgtgatcaaacactcatatttccacagcaaaataatgatccacactaatggaggtaaagaaggagaagactacgagccttcctcacccaacgcagacctaccagggctctgtgcgccagtgccacaggcatcccttgggtggtcacgtagcctaaaatacgaatgagactaaatatagggatgtgaaagttctgcttgacacttaaatgtgcttattaagacttaatccaattatattatcgggattgatatctataagtctctaatagacattcctatttaagttttaaaatatcatgcttcccacagctggcccctcaggccctcccgttccagggcttcactgcgaccacgtggcactcttcactgggaatatccctcttgcctctcctagaactgcctccaaccagattctggcgggagatgatgcaacctgcaaccaagtcacctgcacaggggccctggcccccaagggccttgggtgttgccagtagatccatgttcattttatcaacgacattctacccctctaaagccacattgtgtttgcaatctacaacaggtagatgacatcaagtcttacagcatttacaataatttcaagacaatgactcttatctccttaattagattacgagctccttaaaaggcatcccttgggtggtcacgtagcctaaaatacgaatgagactaaatatagggatgtgaaagttctgcttgatgcttaaatgtgcttattaagacttaatccaattatgttatcgggattgatatctataagtctctaatagacattcctatttaagttttaaaatatcatgcttcctatctaggcacgtaaaatgccatgtgacattagaacaaaaaattagcatgtagaatgattagcatgtgaaatatgatattagaacaataaattaacatgtagagtatgatttaatgtgaaagggccacgtgaggtggcattttagatagaaatgcactcacgcacacacacaagcacagatacacctccctccacacattcaactgagatctttcaaaggtgacatcaaaataaaaatagcacacaaattttatggaaaagagcaaatcaaaagattgttttctgtagtgataagacctgaaatgaaaacacatgaccagtggtggagacataaaggcattacgctgcccagaggcgcagcaaccaaaatagaaagctctttactttgcaggttgatgtgatttagcctaaggcactaaatcagcacctgttatcagatcacggtccttgggtcctgatttccttctgccagcaaagcaccttgatgagtgtctacaagagggcaaaggcagcataatgccgcccatggtaggactgcggggctgcacacattaggctctttgacgcttttattacagctacagcccaaggatgcagttccaactcctgcccttatgaaaataaaatggtgcacaccatacaagactatttaaatagaccagacttcagccatctgcaccccacttcttttgagacccacaaggtcggagtgcttgcacgagaggtaaaatgatttccctggaaacacgctcacctgtgcaccatgagagacccaaagctgaatagccctcttgccttccttgctcgattacacaagaaaagcaaaagcaaaaagcacctggcatggtgaatttaattctgcaaaaatatatcctgaatacaactccctattggaaatgtgaatatctaagcagcgttgtgtaggcctttcaaagcgactgcaaattatggtggaataatatggttaacacagaagttatggcatttttgctgtaaacaataccatcaagaaaatgaaaatacaacccactacggggaaaagtatttgcaaataatatgcctgagaaggcacttgtatctagaatatatacataattcttataactcaacaataaaaagataaatcacccaatttttaaaaatgggctagtgacctgatgtgacatttctccaaaaacatacagccaataaaaacatgagaagatgctctacatcatttgtcatcagaggaatgcaaatcaaaaccataaggaggcaccacttcatacccaccaggatggctgtattcaaaaggtgaacaataacaagtggggaaaaaatggatctcggctgggcatggtggctcacgcctgtaatcccagtactttgggaggccaagatgggcagatcacctgaggtcaggagtttgagaccagccttgaccaacagggtgaaatcctgtctctactaaaaatgcaaaaagtagctgggtgtgctggcaggtgcctataatcccagctactagggagactgaggcagaagaattgcttgaacccgggatgcagaggttgcagtgagccgagattgtgccattgcactccagcctgggcaacaagaggaaaactccgtcaaaaaaaaaaaaaaaaaaagctccatctatcactgctgggtgggaatgtacaatgttgcaatcactttggaaaatggtctagaagttcctcaaaagctcagacatagagttgccatcccagatccagcaattccactcccaggtataaacccaggagaaataaaaacatatgtccacacaaaaacctgtacaaaaatgttcacagcaccattagtcacaacagccaaaaagtagggacaacccaaatgtctatcaacttactaatggattaaaaaaatgtagtatatccatgcagtggaatattacttggcaatagagagaaatacctgctacaacacgaacgaaccttgaatacatgaggctaagtgaaagaagccagccacaaaaccccacattgtatgattccgtttatatgaaatacccagaataggcaactctacggagacagaaagtggatgtagggctgcagggggtcgtggaggggaaaagggggacagggttctgttctgaaggacgaaaacattacagatgtggtaacagttgcacaaccttgtgaatacacttaaaacatggaattgtacattttaaatgggtgaattgtatggtatgtgaattagatctcaaagctgtatgcaaaaacagaaacaaaatgttatggcattcagggcaatttgaagcaaaacaaatactgagatggttcttcagaagggactttcctttagccgggcaccaggtggcatgtacctgtggtcccagctattcaggaggctgaggcaggaggatcacttaagcccaggaggtggaagcagcagtgagccatgatcgtgcccctgcacttctgccagagcgagaaggcaaaaccttgtctcagaaagaaaaaaaaaaaaaagagagagagagactgtcttggtgccttttattatagtgcatcttgaagaatggaggggagtgccttcttccacacatctagctttcattctgagtccatactcaggacagatttggaatttttcacaaagactcccaggaggcaatggcttagtgtatgataagtaatttcctcaggatatttgcttcctggcaacaaaataaaatttagaatgcaaacaatatggtatattttgaaacagagtcccccagagggtagacaacgcttctcttagccactgtatagaacagtctagaagttggataaccttatttgtatggtagtaaccaatatctctatattcatgtgaattcaatccaatttggtgctacaaaaattaaaaatgcttgactcaaaattcttacatctaacctgactcaacaatccatcggcgcatgaaaaaaaaaattcccctttaagaatttctagttattgaattcaggattgtttatctctgagagggagacaaaatcagaagtaagtttggagtctcagggaaaacataacaagttgattattgtttaagtctaaaaggcaccaaagcacttgtccctgggtaccactcagatgcaggcaacattcagttaaagtgcctcatggctttttttcctatgaggcctacagaatggtccctcacaagttttctatttctgttctgcttcaaagaaagactttctcaacttttttagggctccagtcctggcccatcgtggatggtgagatattctttagatgtttgttctgtttttttttaagttgatatatatttaggcccaaagtcatgtttattcacaaatccaaacaaccggcaagctaaggctaattttttcatgtagaatatttatgaaagaaaacaatgaataaacaacttaagattggggatttactctgaagggcactttccggaacatgtcataggctcagccccagttcaaccccatctccactgcggtttggaaaattgtcaggcctgagagagagcaaggggttctgtttactccactctaggattaaggaatggaaatatagggagagccaagtaaggaggttgtgactcagttcctccccctggataaatgtctgcacagactttagacttctggttttcaaactggggttcaataggaccctgagttcagtggagtgggaggtactacagagatgaagcagatgcccctaaaaagtggctctttctgcataagatgtttaaaaaactgggttccgggtgtgagataaatggcagaaccttgatttagatctactttcggggttgttacagaaagatctgttgggctgtctggggtgagattagatgattctcattatttttctatggttaaaattgctatagctaccatggtgtattgcaaagtttggtacttatatcaatgactcaggagcactgagacactgatatactgaattatcaaaagtttaattttttttttttttttttgagacagagttttgctcttgttgcccaggctggagtgcagtcttggctcaccgtaatctccgcctcctgggttcaagcaattctcctgactcggcctcctgagtagctgggattacaggcgcatgccaccactcccagctaatttttgtatttttagtagagacggggcttcaccatgttggtcaggctggtctcgaactcctgacctcagctgatctgcccgcctcgtcctcctaaagtgctgagattacaggcgtgagccaccgtgcctggcgtaaaagtttaattttatttagacaagttttagtgtcaagtatattttattaatctgtaattactcgaaaatgggaaatttacaaactggaatactcaggcaattggaaaacatctccctacacttatttgaagatttaaaaaatgtattagcttcggactagttattcttgttctcttttacatatttttctaatcattcctactcattttctcatcttgatttttttctctcctcctatctcctcattatatctcttgctatttagttcaacatgagatcttttacaaccaaatagcttgctagaaacagcaatgcttcatggtaaacagcgtgagggaaagatgttctgaaatggttatataagcacgtgtggcatcaactacaacgtgaggcacgtcatttgatcaatgtataaatagcaagtcgtaaatgattctttccactcctgagcagcctggcagtagcacagaaggtaaatgcaaatggccttccgctcctttcccgtgaataaggagataatcccaccaacataggccttggcagcaggaagcgcagcaggaaattcatgtgaatttctgaattctgagagaactagttacccatcggctgtagcaaaaatcaagaacaaaattcaaaggaaagaattcatgatggttaatacagataaaacctatgcaactgggttacacacttcatgaggccaaacacttaaatatgcatttagcataaaatgtgtttctgccgagggccatggaggcctccaaaaatgctactttcacccagggcccctcaggagtctttaccttctccgttgtttcctatattaataacaaattccttctactaatttatcaaaacataatcactgcagttaaaaggcagcgctgccaaatatttgaccataaaatcatatggaaagtagtggtaaagaaataatgttaccatgttttcataaaattcatcctaccaacaaatatatgcatatacaattattacatttattatagagttataacagaatagtttttaaaactggaaagccacatgtaataaataatatacctttcctaaaatcagtacttatttctgtctttcttttttgaatcctcacttctttaaattactatctgcatattctggattttagcctgggagagtattatgagaatgagaagtacaaagaaaaagaacaaaagtatccttaaacctactaaataccctgaaaggataaaaagaatgattgcagacagataatatatttatttttttcaacgaatgaaataaatttaatcctatttatcccagtttactatctcaaatagactggtaaaactgaaaaagcatttctactatgttttgaagcaaatttaaaagtattattatattttccaaatatacatcctattaagacatgcccatatttttcacatatagccatttagcataatttcaacaagtccaaagctgctaaatataccatatgtgcccatttattctaatgaaccaataacacaaatacattaccagattcatgcccctctgctcagaaagtatcactagcctgtagctgctgaaaagctgttccatctcagtcacccactccaccatcatccgacatgacctatcctgctcctggccagaggaccttttcaacattggattccaattcctcatctaggcaaaaggtatataacatacttatcctcaggcaagcttcttgtacagagtgaatgagataaaatatgtgtgtcacaacgcctttatctgtgtcagagaaaatccaaatcaaactggcttaaacaatgaaagaaattgcttggctcatataactgaaatatctcaaggtaatgtggacttcaagctcaggctgatcagggctccaatctcatttctctgtggatttcccagctctttcctctcgtgtgttggcaccatccttaagctgggtaacttatggtcacagatggctgcaaaaccgcaagtcaggactccacgtttccatgtttctccacagccactgggcagggatctcaggttacatcctatttgaccatcttgggccacattctcaaccctgagctcatccctgtgaccaggaaagtgccatgggtagggcacacacgcccaggatgcagatctccctggggccaaacaaacttaaaaacaaaaagtttctctaaaaacaaggtaggcttggctttctccaactgcctcatcctctaattgcacagaagaaatactgtgaatgaataaggcatccaacccattctccaacacccctttcccaggcctgtttgttctttttcctcttatttttcctccgtcgtccaacatcaagatgcaagggccgcaatctgagtgtgagggccagggaactcactgaccatctgggggggctctaggaaaagcctggaagagactctctgtgggaagctcaggggagtcaagccccttgacgaggtgtgtgatgtgggcaggtgtgatggaagaaaagagactgggacttgtcctttctggcttctcagtggtctgctcagagacgtttatcctccttgcagctggtgcatgagtgaaactctgaatttgtagttttccttaggagaaagatggcatgcacccctgggtcacctggcaaagctataacacacggtggctcctgcagacccctggctcccctcgcgggcttgcaaccaggcactcttcctctctccctccatgacagaccagggcgaggaaaggagaaatgatgagctctgagctggggccttgctgcccgactgcctccactaatcctgctcatctgaccgaggtcagacactgctttgcagagcccgtgggctgtgctccatttatcactctgtccgggcgtctgttgttacccatgctcgggtaggaaaatgctgagtgaaggtaacaggactgtgcagttgggaagctcatctcctcttacatttggatgttttcccaagtggccactgccaaatttactccacatcagcctctctctctccatgcccttgacctgtcctcctccctctggccctgcgcactacgtcccacttgtttcttgactcttctccactcttccccttctcttgtctttcttcttcctgcctcttctctcccctctcctcctgccctttaattattgtttaaaagacagatgcttgagcagtgtttcccggacctcccagagaaagctgacccagaggacacggagctatccatttgggtggacttttcagggcctttccctgtatttcaagtccttagttaaaagcacgtgtctgaattttctaagttaaggggggaggtttgatttagtgatcagaaaaatttccagtcctgaaacatgcctgcttttacctggaatccttcactttcagtggcatttgcagtttgacatgaatgcttccggtgctgcatttcatagacctgctgatttgtagctcagcctgtcgccaccattcaggcggctggggtgcaagagctaggagcagtgctgctgaaagtctttaagacttcagtgaagcaaacagattgcagtataacgagaaacatggagttttttcaaaacaattttgtctactgctgaaatttgcaaaacacgtcaccgaaggagtctcaggttgatcctgtacagaggagagctctgacctgcctcactaacccacaccctgagctactcaccctgcttcacggtcacgcctgtttctaaaaggtagctcaggctgaagatctaggagtcatctttgatttttctgtcatgtatagtgtgtccaggctatctgcaaggcctgtccaccctggtgtcggatggcagctccgagagcttgctagctcagtttcttctctgccagccttcaatctaattgcacgcatcacccaaaggatccttttaaattgagatatgatcccatcactcccttatgtgaaacattagggctttccacggccttcaggacacagtcgggctttccacggccttcaggacacagtcgggcttttcacggccttcaggacacagtcgggctttccacggccttcaggacacagtcgggctttccacggccttcaggacacagtcgggctttccatggccttcaggacacagattcctccccaaggccccaagagctttgggctctcacagcccaccccatcttccccgtctttctggggacactgacttctggcaggtgccagatgaggccaaagcccagtcagctcaggaaccaggcttgagccacatctcccccagaaactctgccccacaccctctaggggccaatcacctctttcattcagccctgcggagatgtctccctggactgccctctcaaacactgtcctcctctgccactcatggctccctgccatgccttacaatttgtgtatgtttgagatcagtacatttttctatgtagacttgatttgtagacagatatagatgcagccgagcttcctacgcctgtcggaggctgaacatctggctctggaatgccatgtggacatctagtgaacacctcgagccctctatcgtaatacctcgagcccccattcccagaaggacactgggacacagctgtgctgcccggcccgcttcctacccaggccccgagggcaggtgttcaccttctgtgaccaggccctgccctgccctggcccctgcccgtgtccctcccacactgaggccacagccctgcctgcgtcctgtctgctgcatcttctacaacatgctatcttcctcaaagctgaactgaccagaatattcgctttgtcttgctgctgtgacaaattccacaaattcagtggtttgaaacacagggttttccctcccagttgtggagatcggaagttcgggatccattttgctggtgttggcaaggccggtccctccggtgactccatgtccagccctgggggccacctgcgttccttgctcctgacccttcctccacccctgtaacctctgcctccctgtcacaccctttcccgcttctgcaatcagacctcctctgcctcctctcacgaggactcttgtgattacatttagggcctccccagattatccaggaacatcacgccatctccaggtccttaacttgatcgcacctacaaagcccattttgccacatatgggaacagctccaggttccaggcttaggctgtggctttctcgaggagacattatccagccttccacacccaccaagaacaccaggggtctacacctgagcacctgcgtcagggctggatgtggggctcagccggatgaagcccaggtcccgactagtcctactttatttcctgccattgaaatcccagcaggatgtggccgcattgttcattagcaccttttttcagaagttcagttctgataattaacattccctctcagctgactcatctgactgggaaacaagcatagatagatgttccactgggggctgagccatgcgactcccgcaccacacaccagaaagaacatcgtgtctcacactcccaggctggccttccagccaccgtggactccctgtgcacagtattttggtcacaggtcacaaaagcaaaaaggaaacgtagaggaagaagatgtagaataaagggaggagtaagaaaagcatttctgaagatgattgaagatatcggaggggatgcctttttctttttaatgaaaggaagcagtggacaaaggccaggctgacctgcccagtcacatcggaaggacctgctgaccccctggggccccagagatgcccggcctttcccgcttgaaacacaaacctgcggcgcacaggccaacggtgcccacacaccgtgtgctcgctccgctcataccaggtaggaaacagcaaaagcaagagctgggtgcaggtgctggaatgagataccgatggtctccgggacctctctccttatccccgctctatcctgtcctggaccatcttgaacatcagagagggagagcacacccccccaggatgggcgctctgtcccctgtgctgcctgtggggtctagacaccattgaggacttgcccactcagcgcaggactcccgcccactctttgccctttgtgaacaaggggatggatctgctgcatttgggagacatctccctgcatacacaggcctcactgcagtcattctcattcaatggaattcagcctaaatgacgacgctttttagacacccaatccctgtaacagcagtccctgcgctaggcctctaccgtgtctcttgccgtaccctgccacccactgtgtgtgggtgcagggacgcagcctcagtggggagaaggtgccagtcagaccacaccccggctgacctgccatgccacctgagagccccccagcactctggagtttcatttattacgggtcagaccctgtaaggcagatgttatactaattttacagagaagaaaattgagcctcaagaagttcccattggtgaccttgccaaagtcatatgagtgccacatagcagagccagaattcacaacatgggggctacctccaaagccccaaccccgacgcatggatcacaggcaacagctcccctcaccagctgcaggagaaatcaccaccaccactaacgggacccgccctgctcaccagcagcagctctcatgcctgcctgaggccatgtcaaccgagtcgctcctgtccagcaacacgtgttcacatacatgacggtacagttgcggacagctccggtaggtgcatggcgcaccttctacagcctagggacagccaggctcaagagagggagatgaacatgcagaacccccgaccctgactccggaaaatggctccaaaggctctcagctgcaggtccatccttcccatccatcctccctctgccaggccagagcccaggcccacagctctgagctgcatgtgggtgtcaggccagctggggagcagggcctgatggccacatgtgggtgtggcaggatttttgccctagagacctgggctcacacaggggcagtgagcccactgtggtgcccatggggggctgcccagcaggagccacagtgctgacctagcccagagccaccaaggcccctgacaacaggtgcctgactctcctaatctaaggtgcgccaaggcccctaacacccaagaggaagaggaacaaatgaatgtgggagaaagaactgagcccagaaggttcatgggtccaggtacaggagagcccttgacagaagcccggctctgcctgacagaaggtgccgggcgcccgctccatcgtgggccgaaggcagtcacaggctggaatgtgcagagggaagtcattcatcacagaaactcagcgtcaggagtcaaagactttaaatctcactataaatctctatcagcaatgtcacgaaggccatcttcctagaataaaacctattctagaagcaacagcttttaaaacaaacatccttattgacttttcctgtttttctatttcttaaaaattaccagcattaatacatgtggaaatctgtgcattttaaaaaatgttgatagtttctcaatcttttaagatattttgttgcttttaaaaatttttaagtaatcaaagttgttcggggattttttcccaaaaatgttattgtaagataacactagatcagctatattgtgagcctagattagacattttttctacagaaaatttttcaaggccaaacagtagttagtaagaaacccaatgccagcaccacctcatgctgttatgtggttctctcgtggcttctgagtaatttgacttacgcgacggttttaatgacctcctcctccattggcgtcaggtaagcaccactttttgtctgcattttaaccctctacacccaagtcctactgataatttaggcacgtagtgaatagtcagtccatggctaattcctaagataaaatgtcctaaatgacctccaaggactttgtacatattaacctagaagctgcgaattacatggagaatggccacgcatggctcgggggcaacggtcccgcaacagccacagctgtctgtggctgccgagcaaacgccaagtccagcctgcggcaccttccttctgcacaagcttcaccagcatttttagcggcacagaccacaaatcagcccgaggttttctgtaaattcacacacagcaaagaagtattatggggtccaggctgatgacaccattggggagaacccgtgtgctctgtcccggatggctgagagaacgtgaagctctgcagactcggagcctggccatgcaaggggacctgtgattcaggacacttcttaaaactccagaatataccactgtgggtgaccaagccttgaaactccagaatgttcccaccatgggtggccaagccacatcacagggaagaaaccttcaatgtgctttctgtgcagcacactcctctcttctgtgatctgaacacgaaccaccacctctaggctaggactcagatgcagtgagctccactatacccacagtcacatacggacagtaacttctcttcccgaatcctgtctggatccaagtgtccctgggccagagtctccctaagagacagccctgagtccaagcccctgagaagctcagggccatgcaaagcaggaggcctgggtgtggaaggggtatgggtagggcctgagaatggactgaggggcagacagttcagggaagggaagatcactggggtagagaggtgacctggagggaggtcagcgtgggcaggggtgagaccaaggaaaagattgaccatcactagaagatcaggctcacaggcagtgagaggccttggctgagtgggaggtggagatagtaaaatgaaaacacgggcactactctataactcccatggcaattcgggcaaatgcccatcacctccgttacatccaagcttcgggagggtaggacgagcgtctcagacgtacatctcttctcctgcctcacgcacacagagtgattgtggccagctcattttagcaggtcacactcccttccctccatcagttgttgttctgctgtcatgagccttgacaccgcagtacgacgcgctcaggaagacatcaggacagaggtctagacgcttacaaccctgagagacacactggacgctgcgcgcaagagccctgtgcatatggactccgattgacgccatcagattcgcccacaagccctgtgcgtatgggctccaatcgatgccatcagattcgcgcaccagccctgtgcatatgggctcccatcgatgccatcagattcgcgcacgagccctgtgcgtatgggctcccatcgatgccatcagcaaagttttttcacttctttgttgggttgtactctacaaggacttgactgagtcacacatcatgatccatgcgttttctttgttaagatctagaaataagagacagacccaacctcatgctgtgtctcgggttctctggaatgaaggcagtcagctatagtcaccactttgattcccgcagcccgtctgttcagtccctgaagtgatgagaaaccaagaagaattcaagaagtcaaaggtgttctaaaaataaatgctcttttgaaagttgttttgtttgtctgtgtttctttccttcgctatgttcaaagtcaaccaatcaacagagttgctttaacaagttacaggcaagagggcttctcgtagcacctttgcaagcatagtgtagaacgcagcagtctctccagggcttgaccctgtgacagagagcccagggccccaggtgcctgcaggagctgacggccatgtggcctgaagtcttaaggctcgtggagggcctgcagagccccctgggcttcctgcctcctcccagccttgcccggctcccagcttttctcacacagagtcctctcaaagccatcttctctgctcctcttgtgttttacccacagttcagaacaagaggcttccttggtttttcaccctcagaaagattgtccacatgatattatggatgtaaaactatttggaagctaatatgatatctgaccttagttctagagaactagttgcaattatcctgggctgagagcattaaaattgggacctgtgcgagcttcttaagtagtcgctagggcatttctaccataaccattccaaaacaaagtcattcaaagtaaaatccccccactcctcctgttataaatttggcctcacagtttaatgagtaaaagctgcaagcccacaggcccttggcaggatgtgtggccaagatgtcttggtgcaaagaatgttaccgtgcacttcgagtgcagagactgctctccacagcaggccccaggcttgcattctggctaatgtccatctgaaaattcagattgtgaaactacagcatacgaatcattccacaggtatgaggcctgtttttcttatttgtcaatctcattcaagcctttcttttctttggcaacaggaggaaatacactggccaatacctaagtactaatctttgattcattttttaaaaatcttgctaatttcatacagaagacagaataactgaaagaagaaacaattcttttctctaaaaggctagataatttctaccagtgccttctcctttctcccaacagtccccactcagccattccttgtgggctgatgccagaaacagcgtggaaaacaagtctgttttccaagaggggctattaccacgaattatgtttaaaatgacagcatcaaagattaaaccatcattgtatataaacttaacatagctataacctaggaaaagctagtttcatggtgataatactaattagaaacagatgtgtattcaaaggggcaaggaaagaggctggcaggagagaaaaaacatttttcccccataatgtagtgcaagaacctttacagatatggtctcaccaaagtcagctttgtgcaacaccacggatgccaagtgcaagctgtcctgacaaggcacatttcactgatgaagcatttaataaattgcagataacccttattacagggttacccctattttgtagctggggagacaggtgctcagaaggattcagtggtttggcaagggagacagcaagaacactagggcagtgtgaggtggctgggagaaggggcagccggcaaggtcaggcacttcccacggcaggagactggcaccgagcaggggcaggagggaaacagggacaccacctgctccatgcctgcagaatcctacctccacggggcaaggcaagggcaaaccacccagcctggggagctttgcacaccaaggctcatagaggaagactggctagggagcattcgccgaatggaatcaggtagggctctcatatcagtagcattcttgggaacaccctctgactgatctccaggaacgcatgcaaatgactgcataacatatgcaaatgactgcataacaacaggtacacatcttggctggtcggaaacactgcttctggcctgcttggtaataaatcctaggtgtatggttacgcacatttgtcctccacgccctgatatgcaggtgcctccggcttccttgtagctgcaccattattttcccctagctaagcagttagcaggcaaggcttctcacgcagctgcaagtcagatgtgattaacagtatttcatatggaatatatttgtgtctgatccatttgcttgattaaatcacactgtagcttaacagcctatttgttgataatttttacttatttgaattcaatgtaatagcttttactagtgaaaatatatcagcaaacataaaacgctgagaaaatgcaacacaacctaattcagtgtaatcagaaataaaagcagagcattctagagaatgctgctagtcttagaccagctctgcttatttaataagcacagatccttggagcaaaaaaggtagagtatttctggctaagttactggttaccaactccacgtcatacaaagtaaactcatcctggtcccccatatcaaaggagcactctcctggcagctccctgaaggtccccaaggccgcacacatctctggttgacccgaacgttgccttcatcctgaagctacagccctaaagcctctttcctccccttccccttcacagccagcagccctggaagctgcctcagagagttcatacttctcccacccactattaaattgccacttctgagaaactatttgccccacatgtgagaaacagaatgaaattccaggtaaatggtaagtcagaggatgtgaacatagttccttttttatttaatgggcttccacttcattcttctacttctgaatgcatgaaaaatagtctgaacagtctttgctgtgctgggtgtggccaaagacagtcagcacgtgggtttacggaaaaggacgggcaaagcaaaaggggcaaaatctcactacgtttagttgtcttttcacatcgtttaaaaaaacaacaacactatttcggggatttttcctgaacgtaaagagagaaagtatgtaatgaaattccaagcataaggcatatcacagaaattgtgaccacaaataaggaattaagcttaatgtctttaaaatgagtatataaaggagcaaaaagaagaacaaattccaattcagtattcactaatatggactatttattgtggtttttttttggctgtcagaaaatccaataaaattaagataaacataatttctttgggagcatttattgagagtacctgaaaattatcttaattagaaatggttttcttggaaaccacccaagatctagaagaagagctcacctatcatgccccaagaataagccttagtggtaaactttccaggaagctttctttttatccatgactggagccaatattgttcctgatgcttgctaagagtcccttcacacttcctttattaggataccatgttttccttaaaagggatgagcaattaaaatgtctttatatgtacagatagatgaattctgatgatctgtgaccaccagaaatagaaataaattgacaattgatctaatcagaccatttaaatccaaagctgccaataatttcacagcacttataccctgatagcaagcttcttttgacttgtttgcctctattgttagacattaagctcactgagggcagggatcctatttttatgtcccagttgcttagcacaatgcacacagtatgtgctaaaatcttttgagtgtatgaacaattgagcaaatagataaataaaacgaaattctccttccactcagcagttcatcactagcaatatcccaggtagagtctcgcattttgtcttcctcattcactccctactgtctttcaggagaaatgccagttacagctgaaatagctcaaataataggtcaccaaagagaaccctctggctttggtaactccaaactaataactgcttcctaaatgaaatgactttgcatattgacacctttagcaagttggtggaagtcttgagttaataatctcacttttaattagtttaaatgtacattccctgttggaagaaatacaaactaagctttggaggttccacatcccatcttctgaggctctactggcgtgtggaaaggttgagtggggagaagattcctttcagctcagtggacctatggttctgctaagttaggacggtgagggtggtgcatttccttgctctcaaagccaccttagctcattaggcaactggcatgggtaacgtattttgtagataagtgcagtgactcataggccagacactcagagggtatcctatcccagccaggtgacggtaactccagcttagcaaatgggccagtgtcccctttcctcatctatgaagtggactgttgaatgagatgcaggttactctgcccagcaatgtgtcgtggttcttaggcaatactgtcaatgccctgaaagcagagctctcttggggatgagggtcttgcggtcactgagacctgacacctttctggggcacacccatggaagtctatggaagatacccagttttcctctagaaacccccaaaattatagttgccagagtcaacaacttggccatctcacttggttctatgctgatagaggacaaaaatattcagtgaatttcattttaatctgtaattaataaactgtttccaaatatgattaagtaacctgacttctctgtcacttagggtttagcaaatgttgggttatggacgtaaaatttattttaaaatcaagtatgttcagagaagttttgccaagcataaatgtaaaagagaggaaaaaaaagaaggaactttagaaatttctcattatttaaaaaaataaaaaatgaaaataaataaaatcaagtatgaaaacattaggactgagtctctctctgaaagccttttaaatgaagatattgttttcaacttaaagtaactacattaatttcctgtttatgtcactagactttgaatttcaaataacaaaaattttcaaagtctttgtatatttcaaaatataaatttcacagaaacaattttaaaatgtttcctattataaaacaagttatctttctcattcatccacacagaggaaatacacatctgtgttcagtactttgtgtcctatttctcaacctcaatccattgacagacctcccctgctcagttttacattttttgatgagtgcttcttggcctataaccagctgtgaacacacaaacgaacaggcagccttctcaagtatgggtagggcgcagaagaggaacttactggactggggcacaaagtcagctgcttgtgagactcatcactgggtggaagtgccctgaggccaggacttctatgtctcgtgtctttttggacacagtatccagaaaaagaccagcccaagacccggtcctccataaacacttgcagaatgaattccttggaaagcttttaacaagactctcaaactctcagggtttcttccccttagcaatagaatgaggaaagttacatatgctaccccgattttcacaagtatcaaataatagaaagctggggaatgcatttgtaaaaaagagagcattgtattagcattgacctttttttttttgagacaagtctcgctctctcgccaggctggagtgcagtggcgcaatctcggctcactgcaacctctgactccctggttcaagcgattctcctgcctcagcctcctgagcagctgggattacaggcacgcgccaccatgcccagctaatttttgtatatttagtagagatggggtttctccatgttggccagaatggtctcgatctcctgacctcataatccgcccgccttaggctcccaaagggctggcattacaggcatgagccactgcgcccggccattattgaccatcttagtgagacctccagcacctagtacgggatctggcacacaggaagcactaattgactacttgctcttagactacatgtattttcagcccatttgacctcctacatcgctgatggtttatgtatgacttctagaaattttatttctacatggaagaaacctcgtttcctattcccaccacccccccacccccccccccgcttgtttcccactgtattctttccggaggcacgcctgcagcccagccctccttgcagaaccctgtgacaccagaggcgtgtgtatccagaatcaggcagattcctgaactcccactggtcagccagtgtctagtgctgctcttcataaacaatgcctggagtgtgctcacacgtgtacctcttcttggcaaagacagtaaatggaaggagacaaggagttgtctaataaacttggcattgagatgaaacaggaaacaaagacatgtatccggataaagataaatactgttctgagtttctgatcttgtcaacttcagattttttaagtgcctgtgtcccaggaaaatgatttgcctcactggtgtgcttcatttctttcaatattagacttaaaagcaagccctcctccagtactggattaacagttttgtttgaaagatgtgttttaccctcgggaaccggccatactgatcctatctagtacttccaattctgatttagggatgccataagagaaactttttaaacaagtaattctcttctacttttttgtctattcctcaggtctctcaatggttacagaacccatgtctgtgtctaatatcatggcagctgggacaaagaaaaccaagatgaaacatttgagattgttccagctgaaacaaaccaaccaaaaccccacaggtgccagccttgaggcaaaggcgggacagtgtcaggcgaaatctttgggtcccagcctcagtctccccatcaccatgtctttttcacttaaacacgtttcactgttttgtcatctatagattcaacaatgtgatttggacactgggaataagagaataagatttgatggttgaaataaaacacaccacgagagaaccgtccacaaggaaactctaagatgccaagatgcgggacaggtagaaaggacagggctttgggagtactctgggttttcaggacgaatctgtatcagcctcggcgctgcgaggatattgcatcaggctctttactcctgaacgccgttttagacgcctaagcagattgtgctgctgcctgttcttccccgttctgtgaattctacactgacttcaagtgcacgaatgagctacaagataaggtggaacctgccggccgggcacggcagacagcacctgatcagcgcctcggagggcggagctggggggcttctccactcgggactttgagggacccccgcggagcgctccgcgccactcggcggtctagctgcagagaaagcccctcctcacccggggctccctgtggcccacaggggaccatcccacaccccgtgcagccagcggcggagaaaccagctggaaatgcagtgggggtggagttgcccccgcgaggacccacggaccgcccaattactacggagtcccagcgataacgtttggagccgtttggttcgattttcggaaccggaccagctttccagtaacttgaactccctgacgggtctcggggtccacccaggggtggcgaggcgggctcgggcgaccacggcccgctcagtgcccggcacctgcgcgccccgagggcggccgcattacctcgagccggctcaggctggagctcttggagcgcgacttcctgcgcaggtacacagagaagaacctgcgcacggcgaacttcttcatgctcaggtccatcgccccgcgcccagcccggagcagccgcagggccgggggacgcgcatccccggcatcccaggcgcggggctcaggtccgcgggcgggcacgcgtggccagggagcccggcacggcggccatgggcgcggggcgtggggcgcgagctgcggtcacaaagggcaggccgcgccggccaccgcggccggggccacaatcgctccctccgcctccttctccgc

SEQ ID NO: 346 - DNA, 87292 bp, Homo sapiens
tcaaaagataaataaggtccatgtttattcttcaatataatacatatacatgattgttatacatctttagaaagcaaagaaaaacagctaaatgaaagtacgttcagaaatttaaaatatacatgatagacacaatcaccacgttatgaatcctttttttaatttcttatcaacaccaataaacctagtcagaaagactcactgacatctatcagctgagacgacagcaaaatacacattaggtaacatatgaacgctcacacagcagatgctttctgctcttctgaatgggtagtagtggttgagttataagccttcatggaaggtgaaactgcccatagaaagaccacttatacaaagcacagcgcactaaaatggagcaaaaagaaatatagaacacttctaactgagaaactgcagactccaagctatgtgaggaagtcatcttaatccaggaacccaatatctaataaatccagcacccacttccctttaggacagacggaaagttgcctcctggtaagaaaatttcttaatctcaaaaaggctttcagggagcatggtgatggataagaagacaaacttggatccgaacttaagaaaaaggaaagaagtaaaaaaatgtaaaagagagtgcaaaagcaaaggcgaagctttgtggatattgggaagtaggccgtggtgatgctgcagcacacagggatgacaggacggccaggggacaggaaagaaccgagtccgaggaccacagccctccaggggcctgatgctgcctctcacttgtgcttttacaagcggactttcaaccggggttctgtcatttggcccccagcacacgcatgcacactggcacccgtgctgcgtggctgggggaggggcagaggaagcagaagagacaaaaaaggaatgaaataaagagcagattctgttcctagtatcaaatccatattttgattcttaaaagagaaaaaaaaattgctaagctaatttccataaaatggataaaaattaagtattcacacatctttccaaacatacatcaaagcaagccacaacaatggcaacatgcctacttacatttttgaggaaagaaagcaaattaatatcaagttagaggaaataactgaaaacaaacttatggcactcaacagacatgagtgttaccagcttcaacctagaaattgtttccccaagttagttcagatgagagtctcgtccaaagtttgtaatgtagcaaatggggacatgtgccctcctctccctgatttttaaatagcaacagattctgggtaagtgttggtgtcttccaaattaccaatgaggcatgccttctccttaataacttgcgaggtttatttctctccaggcagtgggaagtgctacatcggtgcttaatttcctccatttgctaaagaaagtgggaactgcctagtgagtgagcaaagccataccatccattaagagggtggaggagaaatacagcctcccaaatcctaatgacctgttggaaaaattgatctccatagccctggtctagccagactcagcttttctgagtccatgctcgcatctggcttgattcctcggctttgcaaagccccctttccccattagagcagcagtctacctagttaccagctctcgctggagcagccacacaaggacatggagcaggggcgggatgaacactagactgataatctcccatttcaagtaactctagactgtaatcatgaactctgcaatgcaaactaccctcagcactcatataaaaggcaccctgctggcatggagatgccttcccattccaaatgtggaaatttaactacagaatcaaacaagatccattttcaaagtacagtctcctttctaaacctcaaaacaaaacaaaaatcacacccactcactgcagggtcatcagtgcattaacttggcaaagaaatcatgcctgtatttggcctgagctgtctcttccatgtgtggcagggtctggggacagtttatctgccaacctgagtcagaagggaaggtggatgcaaattgcacgtcgtgcaaaagatctcctgcttgatttggtagagaatgcacaccacaggacagaaaacgccctgccacgaggggcttcaaatcagacccctgtgtcctgtttagcatttgagtgaatgccagctctctgcggtctaactaagtattaatgcatgcactggcttgtatttttccaggctcaatgaatatcatcagctaaagatagcatagtaatataacactccagtcacagggttttgtgtgtgtgtgtgtgtgtggtgtgtgtgttttaagcaaactaaattaaacacttaagcatagtcacatcacaggaacataagaaaccaacctcggataaatgcaaggccaaaggagaaaaagaaacgcatcataatgtaagagcaaaggctggaaaggagtcagttttataactaacacgaccacaaaattcgcatgtggccttcaccaaatcacgtatttccttctatctctacttcctccttaccttaaagatgagaataaggatgttgcacacattcacggcatgctgtaaggattccttaagtggatctgagagataatgggggaaagctgatgcaaagtgaaactgccatccctcatgaggccaccaagtaattcttatgcctttcattgctattgcgacaacagtaattgagaccattctggccaacatggagaaaccccatctctactaaaaatgcaaaaatcagccgtgcgtggtggcgtgcgcctgtaatcccagctactcgggaggctgcaggagaatcgcttgaacctgggaggcggaggttgcagtgagccgagatggggccactgcactccagcctcgtgacagagcgagactccgtctaaaaaaaaaaaacaaagaataaaggcattaacacagctgattcaacacaacagttatttggaaatggaaaatgtgagaaagctcatgaatctggttggtgagcttggagttcagcgggtaacaggaattttgtggggcttttccttgcctctccttcatgtggaaatgacacactcatttcgctctttaaagcccagtgcctttctgggccccataagctgtctacagtagggccatttcctttcttacatatctgccatgaaatggcacacaggctaggcataggaaccttccaactggaacgttccaacattctcacgtccagcaggtgagcttgcagagttgcccccacctctggtgtccgattgagatttcttcaccaccattgagtcccatgagacagcacaggcgagagactgtacttggtctttgccactgtttgtatgtgtttacccagaagcttgaatgttatttcccaagtcacttcaatgttgaaagctcagtgctatcttgctccaggaggtgcagatccgtctcttttagttgacaaatggggcttgaggaaacctgttgtgactgttgacattatttcaaaggtcagaatttcaaagtccaaccataaacagatactttttgcatcacctctcaaaaccaatgtgttttgtggggatgaactgtcagtcagaagggtgcagggagtatagatgtgaaaaacagaatcagctacatggaagaaaacgcacgctggggacaattcagaataaatgaaagacacagtggctgatgcctcttgttggagaattcaaagacggcttctgttccagcaaacaaattatttatccattgtagtcacgtgaccacagaccaaatcaaaatgacagagtctgtgaaactaagtctccaagggtgcatgggagtcagaattctttctggccatctaattgccccttccaaaggcatagtctaatggctggaagtagctttctccctctaaatgcatcctccagttttaaaatctccaatcaatcttaagtgtcacagctgtagtcatttgagaaatggcagacataatgcaccccctgccccagtgactaagatcaaaaaatttttttaaaaaagtaaaaaatctcaagatggcagggaaacatcttcccaacatcaccaccaccgggtgcagggatgtgtttgcgccctgagaccagaccgcagcgctgggtgttcctctgagcgcagcagaggcactccagttcaagttcacattcagggtcgagggctccccctgctaagactaccaggtcatcacaggggtcaaggcatcagaactgctgatttttcaaaaaattttctcgaagcagcagcaaccacagcagttttcctgcaaagcaaacaaaatatgaatcttgttaattcagcagggtttttaaaattataattagttggttgtgccccttaggaaaaccacagatgattttttttaataacatatgtgtgtatatgagcgggggaaaaaaaaaagaaacctcttgatggattccaccaccaaccagagttgggctttttatttttcagtttgtgcaagacattttttttttctttccaacttttattttaggttcaaggggtacatgtgcaggtttgttacatggggacatgtgtgcaagatattttagtactatttgcaatattgaaggacaaggcctctttgtttcgtctgaagtacagccactccgtccatctggtcagcttgatcccagcatcaaagtgagaatgtggcctcaggtgtggggaggtttccatgtgctttatgaccacgtctgacctggggcccgcacacggctacctgccatcattcctgtggctctgaggagtaccctaaatttatatcccataagttggcaaaagatataacagaggtaaccagaaacaaaatgccaccaggttgattttgggaatgtttcctctaacaaattgtaggagacatatatgcctcagttgacattgtgaattatgccttatttatcggcctggaactctttcttttacaacaggaataatcttcagccaccagatttttaaaatcaatattatctcaaatttggtttccatcataatacatcctgccataaacccatctcatcctggcagggaatattatcgtgaagaataatcttttttttcctaacttctcaaatgaggctgctcccagagttaaaatcttatgttaagttttatttatttatttatttttttaagtaagaaggtaggcagggaatggtggcttattcctgtaatctcagtgctttgggaggcagaggcaggaggatcacttgagctcaggagttcaaggccagcctgggcaacatagtgagacccccatctctacaaatttaaaaattagccaggcgtggtggtgaaagccttttctcccagctactcaggaggctgaggtaggaggatcacttgagtccaggagtttgaggctgcagtgagctatgctgatgacactgcactccagcctgggtaacacagcaagaccctgtctctaattaaaaaaaaaacaaaaacaaaacagaaagcaaactaggaagcatccagattgtgtgtatctgaaatgattcttccttggcctgtagtgtgactcaggtgaatttctgaggccaaatggggctgaagagtgcaggaaaggaaggcagccagctccatggctgtcagcagccctcctcaagcagttccagcagaggctgtgtccagctgccccagcgtggccagcccaaatgctgctgtctgcgtcctctgcacagccatcgcttcgtaggctgctgtggtcttccatcacattgggttcgaggcacccatgtctgtgtggaaggactctaccccctcccatcaccatttcctcctcattcctcccccaccagaccctggcagcaggcccgccttggaatgcaaccctggcacccagtgaattcattcccaccaggcctccagagtggctccggtccttatggtgggaaggtggtttgtggcaaaccctcggggtttgtggtcgctagggacaaaactgcttctgggggtgagggtgaaggcgagggagagaaggagtggacacagcctggttgtctgtggatccaggaactgacggtgcaggactggggcacctcgctgagtgccataacctaggcctgggggcacgagggtcctttcttgctccaggttgtcctcacaagaaacaactctctcctaccttattgagactttcatgtccttgctgtttttaacaaagaagaatggtctttgtaaatggaatgcacaagccttcctgttcactttttgtggatttctaaataagtgacagggcacatgtaagcgtcccttcctccgaaggccaagtgttttcctagcactgatgtgtggcctttactatgaggtactgattcatttctaccccatcttattccacaaaaaattcaaggcagcttacaataatatgtacaatcaaaaagacatgcaaaaacctcaggcccagaaacatacctatcagaagaaaggattaagaccaggccaggcccggtggctcacgcctgtaatcctagcactttgggaggctgaggcgggcagatcaccttaggtcaggagtttgagaccagcctggctaacatggtgaaaccccatctctactaaaaatacaaaacttagcctggcgtggtggcaggtgcctgtaatcccagctactcaggatgctgaggcaggagaatcgcttgaacctgggaggtgggggttgcagtgagccaagatcgcaccattgcactccagcctgggtgacagagcaagactctatctcaaaaaacaaacaaacaaacaaacaaacaacagtgagcagcaagaactcactcacaagtcgtcaacgctgtgcagttacatgcatggagctgtgaaaatggctgtggactccccacccaagattagggagctgacttgctgcagggtctaggcccccggcaaggacatgaatgttgggttttcttagagtccttcataagtacatgtgcctcttagtcttctcctttagggctacattgggctagattattgatatcaaagaaggtattcatgtgtaaacccatctctcaataattccaaaaacacctgagctaggtggaggtccgcatgtgtcagggtgtatgggaggtggtattctttgggctcgtagagcaggccaagatcaggaagcagctcaggggattaaaaaacatgggcttcagcttcagaaacacccgagggaaccacactccaccctttacaagctgcatggccgtgggggtgtctctgagtctctgagactctgagactcaatttccctatctgtacagaagagggtgtcacttcctctgatctcacacattgtcgtaaggactacccctagacggttaccagcaccccctgggctggttattgatccctcccacgcaccaggctctggtctcggggctttgcttgaatgatctcgtgggagccactcaacaagcttaggaagtgagactctccccaacccgtaagtcaggcactgagcttcctccagtaagaaagagcagaggcagggtgcaaacacagcagtctgatttcagggccctccacgccagccaaaacgctgctcttcttcctgcatagtctgtgagcaaatgctccatttatttcttattcctatctcttaaggccttcacagacacctcttcaggagacccaagactaaccttccaaatggctgcctcctgtagactatttggtcacaaagtcctgggcatcagagccacgattcttcttcttctagggaaagcagaaggcatatgggaaggattaggactgtttccttcaggtcctgacttatgagctcacatgaaaagacaatcacttgctactgaggagaaggtgctcttcaagagaagttcttgaagcctacattcccgacaaccccctggcagacacaccggccaacctcagagtccatctcagagtccactctcccctgaggcccctgtcacacgacccttccttctcacttagagtcagggccaaacagctcagcacctcatcacactcaggtatgttttgcaaaaactcacgcgtgtatagcacaagaatgctctatcacttgcgatactggggctacgatgactgcaaagatgagtcagacacagaaatggcttcttccaaaagttttcaaattgagtagacaacggtaatgtgaattccacaaagagattcaagaagacagagaaagagtctccagtttgaggattggaaaagctggggcatttaatacaggccttagacaagtactgacttgtgggctgctctagaggcagcagtgaagacgagactcaaaagaagagctgggggtgtcctggagcaggccctgactgcaaccgggttgggtctagtgtggacaatgggaaacgcgtgaagattttttcagtcaaggtctgagctgtaattaaggaactaatgatttgatagattagggaagagggtgagtagaggttggatatcagctcatgggttgttttattagttcactgagagggcatgagccgaggtcacaacactgagaatgggaaggaagggtcagaggcttcttagctctgggggaaagaaaacatgtcaaatttgtgtcgtgttccttcctctggccccagaaccctggctaattctgcagtaggtgctgagttctagtagattcctaatttgggagtgctttgccccaccccagctgagagctgcttctgatggaaacaggttatacacagagggttggggacgtaagaaaggctgcaaaccatcgcatgtcaccttgagcataatacagagggcagagaactctcggatgttaacttctaagaaaaaaaaatccttcttaaatttagtgacagtcaatatgctactcaagtggttacaaaatagtaagtgcttttaagcttgaagcaaaagagacaaataaaaatatacgaaagactcaaaaatagaatttagattgaaatggtaaacagttttggatcagaattaaattttcaacttaaaagtaaattctgattttgtagaaccaatattaatctaaaaataagccttctggaaaactttcgtctcaatatttccttgaaaagtaagatatactaagtttgaatattgattttcagtaacactaaaactgtatggtacaagaaaggctctggaagcatcgctcaggtcccctgtacccagcagcccatcaccggcaggagagcagagcagtgaggctctgcccggactccagagctcagccctgtcctgagtgttctcagctacagacactaatgtgcccattttgtgcgttgctatgaggagtcagtgagttattttttgtaaagcagttagaagagtacctccacaatactgtataattatagctgtaataactagatttataaaatgaaatttatttttcattaaaaaaaacccatcatcactcttgaactatctattcacctcaggtaccagcagatggatggatacaaaaggtgattttacttgttgttatatggtttaaaaaatattcttaaacactttttaaactgtacaatgtcattaattatctgctgtggtttctatactatcctgccatgtcaaagtgtatttggacaccaataagcttggataaaaatacatcggtggaaaattggctcaaaataggttagtaaccctaataagcagtttatgtagtctgggtgaggtacccactaggtaataagtctatttttacttgacatcagtaccaattatcaaggaaaggtatattcagacacaaataaaacttagtgccgatgctgaatttagaagtaaagttaatttcaataaaaactggatgtggaaaaagtgagtacctaaggcatagtcattccaaggtttgttggtcagtgaaaaagttccattccaaaacctcaggaaatggagaggatgaggagcaaaggtggaagaaacaaaaacgtatcaaacccatgctataccagggcagggcaccagccaccctaactgataggtacatcagacaggtcctggtgggcccaaaggttggcatggcgtcttgcctgtatatgcatcttgccagttgaacatcctagatgttcagtaaagttacttgggcattacacatctgtttctgtgttaattatataatccacaattatttggatggagacaacatgaaggaggcagagaagccagttaggaggctgcagtcactcaggggaggcatgtcccaggccacggtcaccatgggaatggagagaaacagacagcttccagaggtaattaggggatatcatgtacacaacatggaggtaaattaaacatgagatgggggctcgagggagaggaaggaagcaaagaagatgtacgggggctggctggggccgctccatgggcatccttccctaagaggatcactgatggtgaggcaaggggcagggagatgagattagtttagggatgggaagatcctggtggaaacatctagtacacagatggacatatggatctgcagcttaggaaagatatctgtgccaaagagacagatgaggaagtcggaatataaacatctggtaattaaggcaatgagagtaggtgaagatttcattgtaagaagttattacagagagtgggctaggttattcacaatactcagtctgtagtctaagagtctcccacacatagacttgtatagatacccggactaagctgagtattagagttaagatttggtgcccagagcagatcaagccaggtgagcacagaatttagaattctgaattctgttttaaggaggcatatttctcctgaatgaacattactatatattctccagaactttatatgtttataggttatatgtgtgtatgtatgtgcacataagacaatgaagtaattcattttataatggatacaataatttaataataaacagttatgctgaaaatactctgttaaacaacaaatacattatttttaaaatgtaaactgctcaaaaaagcattttaaggccgggtgcagtggctcaggcctgtaatcccagcactatgggaggccaaggtgggtggatcacgaggtcaggggtttgagaccagcctgaccaacatggtgaaactctgtttccactaaaactacaaaattagccaggcatggtggcacacgcctgtaatcccagctacctgtgagactgaggcaggagaatcgcttgaaccagggaggtggacgttgcagtgagctgagatcgtgccattgcactctagtttgggcaacgagagtgaaattttgcctcaaaaaaaattttttttaaaaaagcattttaagtaatttaatactgcacaagatttgcagtctgtgagaaaaagaatgagaaagaatcttatttaaggttaagatgactccagcatctgatcttcaaaagacaggcagacaggagaaaaagaggaagagcaagaagccgtggtcacctgggcattgagtctggagtggagcttgtggtctgacaaccaggggtgcttgagagcttcgcttgcacttattcgccaactagaaggaaattcagaaggtgattagtagaaacacaccgaagaaggcctgtatctgctgttcaatctcaactccagcttctgccttcgggagaccagatggccgaatgtcaactcatggtcaattctgccttctcttgaattgtgtgctatcaatgatggcataggtgactatcgaatccaatcaggataacattagtaaagacaaacaaggcaaataataaaaattcttgttaataactgaacatttactttcaaatataagtaaccatttctgtagtataacatctgagcttagtaaagtggattcctatcagtcagttgaaaaataaatatatatttattattgtaagaacaaaatgctacaatgattcttgatgattgccaaagcaatttgtgtattaaaacttttgaataataaatattactaacttttgaattgagaagttttgagttaaataggtagggaaatagagtcgatgtaattattaagagagggaccattagatacttttatgaagaaacaatatccttttggagccagcaaaggtttataagattttgggaaataatatgaggaagaataatatagatttaccatatttaaattctaagttctatacatttgtttgatgtgctaacatttatcacattaaaacaaataacctttcaaaataaaaactgtaggccaggtgcaatggctcatgcctgtaatcccagcactttgggaggccgaggcgggtggatcacgaaatcaggagttcaagaccagtctggccaaaatagtgaaaccccgtctctactaaaaatacaaaaaattagctgggtgtggtggggcacacctgtaatcccagctactcaggaggctgaggaaggagaatcacgtgaacccaggaggtggaggttgcattgagccaagatcgtgccattgcacaccagcctaggtgacagtgtgagattctgtctcaaaaaaaaaaaaaaaaatgaaaaaacaaacaaacaaacaaaaaacctgtaagtgaatgtaacaatctgaagtcaaagaggcagtttcaagcagtaatgaagcttcagtttgtaggattgcttcaatgcaatcgcttcatcagataccaaaatatttaagtataagatttgaagaggagataagtctttattacatcaatgaacttggtgacaacatcaccattatagtgccaaaaacaggcagaggtaatttttaaaaacctcgtgacctccatcaacctcagttggaagtgtggttctgcttagtgtcataaattttcagtactggatctccagagcattccaatggctgaccaaggtgaaaaatgatgattctgtactctagtgtcgaacttcttaaatctggctattaaaaagttaacaataacattgtactaataattaaacttaataacatttcaagtttatttctgtaccccagaaatttattctatgatagtggtgtttggcttttggctttagtttcatccaagcattgactggaattctaagccagttgccatcggcccaaatgggcatctgatgctccttgggcattcatgaagccctcagactgaaggagtgagcggcactggagcccactgggcccacctctgcatctgctctgagatagccgtgtgactgcagcactgctctcagcctcagtttccccatgtgtaaaatgatggtctccacagaccacaggattatccagaagccaaataagataacacatgaaagtacacatgtaaaacaggttcacagtaaatgtggacttctcgtcctccaaagatttgaaagggttgacagtttccatctgttcactgccttgggtagagtaatgtgctcataataataaccttggctgttattgtgcctttccatcaaggcacaatactagccaaggttattattattattaatccattatttgtgaattgtccctcctgtcggactgatacccctagcctggctaggttctcttcatcctctaaggatggccttatctttgtgttaaccacattttattacatctttttaaaaaatatctatcccttttattagatggtgagttactataggcagggactggatttgtgcctctattcttagcacatgacacatttcctggcacacagtaggtgatcaacacttgaatgaaagcatctcctgccaagctgtgtgccagacccactgcccacactgtttccccactccctgtgacacccttctacctgttgatccacagccatgtgtattagtgactttaaagccataaagataataaaacgataaggcaagtgctattgaccctgaaaaccttaactacttcaatcattatacggctcaggtataaagccatctgaaacagcgtgtttgatgggttaatcacaatgcccttccccttctatgattctaaaatgcaaatccctatatttcaatgtcactctttttcattcactgaattttgaattaatgtggttttagcataacagaaaatagagggccatgtaataaataacagccaagtgtgcggccgttggggaaggagaactatctgtttgagcctctgttctgccaattactggcggtatgatgatgggcaaaccacgtgggatcttctacccgatttctgcctcatggagttggggtcaggggtggtagttaaaagagataatgtctacaaagcacttggcatgatctggcccacagtagtttcccaaatgaaatggtagttaaagattcagctacacggaaccatatacagcttagtagaggtgaaaggaatcctagaaatacttctcccaagccttccattttgacagtgagtcaactaaggcccagcaggagtccatggctggtatggccatatgataaatggcaggaagagaaaggtttgtgtagcttcatgaccaaagcagtcccagatctcagtagactgggtcaagaggctcaaacctcattctatccatgactttgcgcaagcatcacagatgttagtaagagaataaattcgaacagccctggtggtaggccctgcttccttatcatccctactgcgcccggagcacaggacgaacttgcgttacctcttctccttaatcagaagcttagagatgaactccttggcctcctccgagatgtcctgaaattcttcatcctctaagtcccacctgcaggccaggatgttgttcagcgtctcagcatcattgtcacccaggaaaggcgacaaaccgctaagtctggaggacacggggtccagagtgagtattttttaaacagcctcaacccctttccatacagattgcttttctggttgtgccatttaaaggtgagagaaggaaaataacctaatcctgaagcataattttataacatattattgtaatcaagaaaatgcttgccgcccccacccaactcctaactgaacaactgcagcaataacagaatatgaatatgaatatcagcttcctttttaaagcacttttcagcttgcaaagtgctactacatgctcagatggcaaacgctaggcatgtcacctctgaggggtgaggctagcctgagtcatttaggagatcagttttttttttttttttttgagacggagtctcgctgtgtcaccaggctggagtgcagtggcgtgatctcgtttcactgcaacctccacctcctggaagcaattctcctgcagcctcccgagtagctgggattacaggtgcatgccaccacgcacggctgatttttgtatttttagtagagatggggtttcaccatgttggccaggatggtctcaatctcttgacctcgtgatccgcccacctcagcctcccaaagtgctgggattacaggcttgagccaccgcgccaggccatgtgagctttttaaattaatttttggcttttaggttgtgtcctaggagttaaagtgattaatgaagaggacacacatttacttttccaaatgatgtgcagggaaagaattcactcctttcacccacaggagtcaacaaaacctagaaggcaactgaggatgggacagtgttatttattttttaaataccccaattggggcttttatttaaaacggcaaaacctcagaaaatatgcatggagttggagaagggtcagagacagaggagagctactcacagcatataggcgatgacccccacactccacatgtcagtgggaaatgaaacaaaatcatagttcacaacttcaggggcgagaaattctggggttccaaagttcaccttcagcttctctctgggtttgtatctgcaatttaagagacaaagtggaaggatggacgtgtcgatcaaaaatcgtgaacactgaaatgatgtagtctatgagacaaaatgacttcagccatacagcaaacttcagacaaacaaacattgaaggaaatcaaacaatcaagcaagaggctcaaaaacttgtaaagaggccccagaaaatttaaaagtcaaaattcatactaggaaaccttaaaagctgaaccagttgttggagaagctgctgtgaataatgagaacatctgaattacagaagatgacaagaggaaaactgatatagtcattgacatggggatgatgtgaataagcctgtaaaatgaataaacacagtactgcaataatttacaacatccattttatatgtgtcgttaatgtgctgaattgttaatgtgtccacgtaaactctttgttccctgaagaatcttttatgtgccagaaccctttgcaaacttgcttacgttgttaatatttttaaagtaaatcttctctgtacagatggatcaaatatgaaagaggggacaaactcttgcaaatgctaaattaatggcttctaatttaataaacttcactgtattaggttttaattttttatactttttactgcatgcattatagaaacttctaaacactcaagtctcaaatttagcaagttaaggccaaacataatttttgttaaattaattataaatgagatcatgaaaccaaagagcagatcagatatatgtttgcaaaggaagggcaaccatcatgtcccccagctccattcgtacacctatgtccaaatagacataccttctggccaatccaaaatcaataatttttatttgcttagcatcccgattcacacacaggatattctcaggctgccaggagaaagagacacattagcaatgaaaacaaccatcattcactcaaattgtccttgaaccacaactaaaaatacaacgatgctcagaaaaaacatatcaggcctttcacttcggggcgggcttgtccgtgtgggtactttctcctttaattatgtggtggatgaggttgcgggtatcctgccaaccctgcattatccagcctgtcctctgcacggcttcacagttcaccataatgcctgagttcaggcagaggccttgaggggagcaagaaaaggaggttgcttcagtccttcccaaatgtgctgtggaggcccgctcaggcctgacatctgcccctctaaattattcagtatgaatttccccttcttggagaaatatttttcccaagattgatgagttccaagggaattgacctgctccattcaaacagccacactgaacatgcactgtcacgtgaacgttccggcctccagagcttccctttgctcaacgcctatgggaaagtcgcacggcagaggagggcttttctctccagtcgttcttcagtctcagcagttccaaggttttgctgagtttggtctcaatgcctaaaacccctgactaagtgttcccttggagctaggccctggtaagaccttagcctgctgacctgacagtcttggggtgcagggggagaaaatggggtgtagtgcagccactcagtgttcacagaatgccttacaagtgcacctaatgtttactggggtagaaaaacagaggtcttgggaaagtaagagatttgatttaaagtcaaggccatttataaaagagaaaaaaagttttcagagttaagaaccctcagtcccaattctttacaagctggagggcaccatcccagaagccaaatgcccaggatcccgttcctcagcctttagtgggatcaggctcccctccccaacctgtccaggtggagaagaggttccaatgagatcagaaattcagaaacacattatgaaatgacataatgtctccttatcaatattcaatagtacatttggttgggcagaatatctttggaagcccttttctaaactatctctaaaacagatgtttgtgagtaaaagtcattatagagaagggggtgctacgtgaaccatttggtttcatgcttaaatcactgatggatcatgtataaagctgtccaattgtgaaggagtactgtggcatcaaaaagtttgcaggatatagagaaaccgttttgagggcatttcaataagttagcctttttatgacgataaaattaaacaatgttcattggataaattttgcaaaacagaaaaatataaaacagactgtttgtaagtcacctataatctccccccacatactgacaatcactcaatatttttggcccttttccttccaaggagctttcagaaaagcagctccttaaggacccatccagctgtcacctttatgatgatctctgcatccaagccataactaaaactgcccactgcaggtcctcaatcaatgttatgaagcctcatatggagtcatttgacttacaataggtttgctcctagttccagttgccaatcaaatccctgtagggatatctgcagaatatctacattcaatgaaaatgctccatgaaagcatgcattatcaaactcagttcatagtgagggttttgctaatgatttttagcctctgactttgtcattttataaaccacttcctcctgctctcctcctgctcaaaagtgaatgggaaaggcaaggcacataaatcaagacagtgagggaagccaagttataggaagagaggcccatggaaacctatttcaggaggctaaatttatttagctatgcaatccctagtgaatgcaatagatgggatgttatatagattgtatattttatgttactgtcacgctgtgcaaacagggaaatgagaaaatgaccaagccacacaagacgtactttatgatacttagtcccaatatgggacttgatcagggttgttgggcctaggtcttttattggttgtaactaagactacatacagtccgattctaggaacttcataatgagacatgagagaggtaaagagggaaggggcaatcaataggaggagaaagaaaggcggcttggcttctgtgtgctttccaccattggcagtggggtgcccaccccaccctctcttctccttagcactttggccccatccttccgactgtcctctgctgcattctccataggattctattccacagggcagcaaacccacagaaaaacaagtcccaaagtctggagcttcctgagtgactcgaggagctgccggcgattcttggagacctggaaaggttgactactacttagggaattctgagttagctaaaatcctctcacctacttgtcctgatgagagggctaccacgtggataccgctgtggtggtggtgactgttttcattctaaacttttagggaaaccattgccatatagatttccttaacgcaggcaagttacaagaatctgaatatcacccctgaagatggaacatgcaaatattagggagtgacagaagctgagaataaggagatgagggtaacaattcagatgtttattcatttctgaaatgactgtaccaatttccccagctggcatataatagcagacagggcccactgtgcaagagctgggaagggcttacgtctcacaggatacaaaacacccttaccttcaggtccaagtggagaatgtacatctgatgcatgtgccttatcccctcacatatctgcttcatgaacaggatggtatcaagctccgtcaaattgtagctctcatcgatgatgcggtcaaacagctccccaccatccacactgcagagggaagaggactgaaaccctcagtcccgatttccttaccaccatgtgcttttctcgtagtgacttgtcgtgcaagttctgctacctcttctgaaaggtgtatgtgcagttatttctctgccttctttactatcttacttagatgattcttatcttgaaggcctgtattttatatacctttaatctcacaaatggaaatcctcaagccaactccccacctttttgtgtgtgtgtgtgtgtgtgtgtgtgtgtgtgtgtgtgtgtgttttgagatggagtctcgctgtgtcgctcaggctagagggcagtggcaggatcttggctcactgcaatctccgcctcccagattcaagcgattctcatgcctcagtctcccaagtagctgggattagaggcatgcgccaccatgcccggctaatttttgtatttttagtagagatgggtttcactgtgttggccaggctggtttcgaactcctgaccccaagtgatccaccagcctcggcctcccaaagtgctgggattacaggtgggagccaccacaccggccctcaaagcccctttattcagtgtcttcagctctggggtgagcccacatgtatcatgttctaaagatgttgaagagaaagaggatcctaagaactccaggaggggaactccaagccctgactgaaggtagtcagggtctcagccctctaagtctccagactgaattcagggataaagtgcttctctgtggctggtgctagacacagtaatttcccttatccttggggacaccttccaagaccctccgtggatgcctgaaactgtggatagtactgaacctgtatatactatgttatttcctatagacatataactccgatacagtttaattcataaattaagcacagtaagggattaacaacaataactacgagtaaaatagaacaattataacaacacgccagctgcactactcttgtgtcttggggccattatgaagtcaaatgatagttccgtgaacacaagcatggcgatgcctccacagtcaatctgatgacccggtcggctactaagtgactaaccgcagggagtggtggagacgctggacaaagggatgattcacgtcctgggtgggaccgagcgggacggtgggagatttcatcaggctactcagaacagtgtgcaatttaaaacctgttgattgtttacttctggaattttccacttaatattttggggccttgggtaactgagaccatggaaagtgaaagtgtgggcaagggaggaccacgatactatactttttattcaaaatgccttattgaggaatgaaaaacaaaacggaatcacaatatcgattcagtgttggaattgcagtcggccctccctattcgtgggttctgtttccacaggttcaaacaatcgtaaatcaaaatgtttgaccaaaaaacaataaaaattgacaatacaacaacaaaaataatacaaatttttaaaaaatacagtataacaactgtatatgtggcatttacagtttatcaggtattgtaagtagtctagagattatttaaagtactcggggggataggcataagttatatgcaaaagactatgccattttatgtcaggaacttgagtgtcctccggttttggtatttgcagggatcctgggaccaatccctctccgataccaagtaatgactgtactcggtttctaactaaccagtccttatgtttttataaaggtgagtttaaatggaagcttcttagccctaatcatcaccagttgttgacatgacctttgtattagtgaatatgttgaaagtaagatgtagctcaaaaaccactttcctccaggttgccctggctaatatttaagcttgatttttgacaaacagcgtagatacaaagctagatctacttggtcccactacttcttagcaataaaatcccatatggagatttgtaaccccaagtgtttcccttctagaactgatgtgattgtgtgatccgcgcgaatcagagtctgcgggggcgagcttggttctggtcccgctacagcaggacggagctactgaggcacggtcacggtcatgagtgcccttggggaggtcagggagggggcggaggggatacgtactactccatgaccaggacaatgtcgttcttagactcgaaggcatcgtacagctggatgaggttcgcgtggtccagctggttcatgacgctgatctcgttcttcacctcctcctgagaagcaggaaacagtgcattagtgtggtcaagatggggcggggagggaggggaccacctcccacaggctgtaccttgtccttcatgcctctggtcttgatgattttggctgccagcttcagacctgtggccgtctcctcacacttgtgaacctggccgaaacgccctctgccaaaaagaggaagcggcgtagcatgaggccctgtggtcagctgccgagtggacagcgcacagtggccccagtatttctcctgctgagtctggatgagcagccctctgaggagttctttcagtaaacttctagagcagtatttgtcaacatgtggtgtgtggatcacttgcatcagaatcacctgggagctgttaagaaagcaggtctcggccgggcacggtggctcacacctgtaatcccagcactttgggaggccgaggcgggaggatcacgaggtcaggaccagtctggccaacatagtgaaaccccatctctgctaaaaatacaaatacaaaaaattagccagatgtgatggcatgtgtctgtagtcccagctactcgggaggctgaggcaggagaacggcgtgaacccaggaggcggaggttgcagtgggccgagatcgcgccattgcactccagcctgggcgacagtgcaagaatccatctcaaaaaaaaaaaaaaagaagaaagaaagaaagaaaaaaaaaaagaatccaggattctgggccctaccccagacctcctgaggcaggaatccaggggtaggccccagaatctgcatttcagcacatttcttgggtgattcatatgcaccctcacatttgagaaccacctttacagacaatgcagaatccttctgaatacatatgaatgttatgagctgggctttgccagcatatgaacaagagagcccaccttcagatatataaaattatttttggaaactgcatatgtaacaatactgcatatacatccatatagtcaagactgcatattgccaagtcacctatgagcttgaatataaacacaagacagcttcttacctacgtaatcacatacagatgtgcacacttgtgagcagttttaaatttaatttgcttagtttgatttcttatttagtaaaataagctagaacacgtgtccctgctctgcaatggtggatgtcacagtagggagtgaggaacagcttccctagcaacacagtgaacccgaggcaagccctatgacaaggcagaggacttcagcgatgaaagtcatggcaacgctgggcagatgcaggggcactggcggccgctgcatcctactgtggggctgcacacccagcacagaggcagatgaatcttggagaatgacacaggattaccataaacgtagccacggcgtgacttcaattccaacctctgctccagatagagtctctatgggaacacacggacacagccccagccacctcttaattggttgttatggaaatggtttctccccttcactagcaatggccgcagaacctcctgagccagcagtggtgcccatcactgtctgacttcccggctccctcaaccttctgactctttcccctgatttattgtgcaagggccctgaaggttgaggccaactcccaggattcatgctggttcaacacagtgataaccttatgctcattgaacatggcaagcagggatgatggataccctcaaggccacagggcaggagacgaactcccaggaaaattcaggggcctgcccctgtgggcagggtttttgggatccagtggtccttggcatgttgcaatatttctgccaaaagtaaaagataagttgctacatcttgaacctgctaccacttaaaaggaggtgcagcacttggtgatgtctgcattttgaaggcatccacgcacatttgatcatgctcctctcacttatttgctgagtgaattacggctgccaattttggtgaagcccataacgagagctgacgggcagctggtctagactgcagtaccaaagagaagatcccatggtgcccaaacagacagaaaggaagtttcaaaggagcaattgacaaaccttgaccagaaaaacagcacaaaccctgggaattctttcaaagcttcttctgcaaataactattctcggttagagaaatagttgctggcttgccactgatgtccctgaaggcccaaatacctcaggcttccatggagccagttcatgctgtggaattcctgtttctccctcagcccatccccgcagtctcatggggcattctatgagatcagccagatcaggaagggaaagtccaggtggttccattcggcacagggcaaagaaatacggagtgggaagaggaggaagggacttcacaaatatcaaggactccctgaagaccacttgcagacgcctgaactgcagtagcgatgcgtgctttccttgtgttggtgagtacattttgtatgtatacgtgcagatgttctgctttcctcttcctattttacacagacatgccgatggcagcaaacgttataatttagactttgagttacaagatatcacggggggttgtgaaagaagtaaacgaagaagaacaccctctccccacccccagcaggaagcgggtccctgatggactttaattttccttctggttttttttcttttctttttttttctttttttttgagacagagtcttactctgtcaccaggctggagtgtaggggcctgatctcggctcactgcagcctccaactccctggttcaagcgattctcctgcctcagcctcccgagtagctgggattacaggcatgcgccaccacgcccagctaatttttgtatttttaatagagacggggtttcaccatgttggccaggatggtctcgaactcctgacctcaagtgatctgcccgcctcagtttcccaaagtgctgggattacaggcgtgagccaccgcgcaaggcctttaatcttccttctttagggagaatgtgtgtttaaatgtccctaaaataagttatttgctgagcaaagtaatcaattgaaatgaataatagtaattaatatagtaacaacataaatgaaaaaccagcagcaatgacagaaagacctaatacaggccacaaaaactacacgctgttgactcatttctatcttctgtctcctggaggctgcactatggctttggacagctggtcaaccttctggtgactcacaatgggtttttctttcttttagacattacaacatgggaagtaaagcagataataaatgtggagtttagtcaccacattaacctttctggcatcagtgacaattttcagaaatggttactgtttcttaaaatgtttgtttctaatgtttctagttctcaggtcaagacaggcagacatttacgaagtcatttgcacgctctcttcttttgttgagagaatattaacattcagccttactcaccctcctaggatttctgtcttgctcacagtatagaagctgttgaccgctccttgcttggctgtcacaatacgatgatcaaatggggccggaggagccgggatgtcaactagaaggtgagagaaacagaagggcaatctgtcaagaagtctgacctcgttaaggcagcaagcctgggcctcatagtaaaaatgtgctcatttaataataaaatacaaggagccatctgtttgattcctaatgatccagggatatagatttccacttgagattatgagctgtgactcataaaggtgatcctgacacctctgagaaagagtgtcagggcggctcaatggttgtccataccatcttcaggatcacttttagaaatgtcaaaatagttgaaaatttccaacccaacacagtccaaacaggtaatacttccaagcctgagaccattcaaattcaaacatgagaaattgtttgattcatttttaaaatgcattactgatataatccattattttaattatatcagagacaaaaaagaaaaatgaaacatttcttcatgttgttgaaatgcttgatattatatattactttccaaaatgtcttagactttatttaagacacatttaaggcacaaagatgaatttttcctggctggctggaaataaaacacccaataaaaccaggtaagtgtgtattcaacagagatcaaatttctcccactttctccccttccaccttaagtgtttaaacgctcgtccacatcagcaccagctctaacatacagaattactcagggatattcctcccagtattctttcacctttccatgactactgctgttgaaattggcttgccatgaacctgctcattcttcgttaattcatttactaagcagcgactgcatgcatacaataagaatacaaagggaggtaagtaaataacagctttgctttcaaaacactctacatttatttgacatatgtttcttgagcatttaccttgttccaggcactctgccaagtgttaatatttttaaaaattcagataatataaatctctgggaatctgatttgatatggacatcacctctcagagcctaaatatgctgaaaactgaagtcaccagagaagcatcttgataacattcactgtttcagattaatagagggagttaaatacacaagcggcatcgaaatggcattatatctcctgcaggctgttagactaaatgaaatttagtctgtaatgcttgctggagaaggttaaaaagccttaaaaggcccatacaaaagccatttcctacccagtggggtcaggccgtcttgccctcgggaggtcttcatcccagcagactccctgagtcggccccgggagctcctcagcttgcctggctgcctgtgtcttctgacacgtgtgttcttcccctgtgccgactatgtctactctgcgccttttgctgtcctcgttgacgaggcgctcctctgccactccacgcttactgctgcccgggcactctgtctggtcagcattccagaaaatggatcctactgctgaacttccagggattcgtgggggtagaaatggcccttatgctgctgacacacctgggaagtaaagtccagttgcagctctcaaagtttcaagaagaaaacattcagatggtggaaattctttaagaaggttttcttaaaacagtgttttggtgacgaggacgtgagctccgtgatagaggtgaccatttcggggcttggggaggaaatggagcagcacgctccccatcaagtctatgggtgtagagaaccagggtcccagggaatctcaccactggccaaatcgtgaccccaagttattccactggaacttaacaaaagccgtcattttatgaatacctaactaatttgatcttcattttttcacttcctttccttagagagaaattattaaattatagcatgataaaagaagcaataatctctctgaatcttttttttttttttttttttttttgagaccgagtctcgctctgtcgcccaggctggagtgcagtggcgcgatctcggctcactgcaagctccgcctcccggattcaagcaattctctgcctcagcctcccgagtagctgggactacaggcgcccgccaccacgcccggctaatttttttgtatttttaaatagagacggggtttcaccgtgttagccaggatggtctccatctcctgacctcgtgatccaactgcctcagcctcctaaagtgctgggattacaggcgtgagccaccgcacccagccaatctctctgaatcttaacggcagtgagactaaacctttatcagtggaagaattgacctaatttccatttctcagcagctctcgaccttactgaacacatctggcagtgttgaagtttctttcttagcaatcattaatatttatgcttaattcttggaaaattaaatttctccaagatgaggtttcagatacattattaaaaaatgaactaagaattatgttttaaatccctaaaaaagaccacacaagtggtttgatacttttggttccaaatagatactgtgatatgtgattactcataacttagagtagttcattttaattggctataatattacctgaatctataagtgaaactgtgtagttgagaaagaaagtcattcaataatctatgtcttacttcatcctcacaatatttgggaaaataggcaatttattatttataatggagtaggtaagctttttcagatttaggtttttaacttacggataaatctagtcattatttaattcttgtccttaggaaggatatgttctgtattgctaaaaatgaaactgttttacttcatctttaaaaaatactgattcctgtgggcactattaatcatcatctttgtctaccagttggtagaaaacatagaaaataacaaaatgcctgaaaatatcacaggcaagaagaaaaaataatggctagaaaatgtggccatgaaaaattcatataagctggaaaaccaagttataaatcattgcttcaaactctcttcatttatcctttcaataaggccttaaaccgcaatggcacatagctctagagaaaacattgctgtggatacgcaatgctgtaaccctacctttcgtgaaattggtcaccattagtttgatacacgtattgatttttattttgacattggtccagcactgtctcatgtgcagttgccagttctcttttctcctcagcttcttatccactagtatcttccttagaatgaaacccgtttctctcttcttcaaacactgggtgttcatttttatctgcagtgtcttgctgttcattcccagcactatcactttcctgtgtattcaggctctctgtgcatgaaatgtctgttccatctatattctctcttggatttatagaatttcttggagcaaaatcttctactttgtcttgtctttttgtgtgaaatatggcaaaacttctatgaactagagaggcattggtcttctcagcatttttcttgttgagtttattaaccttttctttctcagaggagagctgattcttctgggtagatctctctagaagccaccataggacacaaaatattttaatggagaatgcaggtgatcagtataattttggctttctataatggcatctttatccaggtttctttttatcagcagatataagcttttaaaagctaagtagaaggaaatatgaccaattgggttccaaaagattttcttgtttgtaactagtaagacccaaacacaagcaaaaaaaaaaaaaggggggggggggcatttttttataaacatcacttcttcctgcacagggctttatgaatgtgcaacttcctctgaataacaacaggacttttataacggaactttcttcatccataactatctacttttctaaagatgttacctgcgagggctgatgtccttttgcttttgacgggcatcctttccgtcaggtcggcgtttgaccacacctccttcgcctgtggaggcacaattgagtaattgaagttacatatcacatctgggcttttcaacctcagcactcctgacacttgcgctggatgattccgtgtggtggggaatgtcacgagcattacaggacagcagcatcactggcctctatccaccagatgccagtagcaccctccctcccagttgtgatgaccaaaaaggtctccagagatctataaatggggagcaaaatcacccgtcaccccaggctgaaaactactatattatatgattcaaacatagaaaaaagcccagtaaaattaatagtaatgtagagggcagaacagtctgaattaatgaaagcctgtatagactacagtatctgaaatgagctcactattttcaaagaaattctgtaaaactgtcattatgggaaaaagcccatcttcatgaatagatgaaaggatgttaataatgtgtgcatcacccttgacctctgtgtaagttgtcttgatatggttgacatataaatcaaatagaaatgagaggatacatgtgaatgggctctgtaaaccagagagtaggagatgaaagtcagctttataaatggaacctttacagtgcttagaacagatggcccttttcctaagtggataaacattcttctcacagtcctggagtatctgaattagttgagcaaaccgttagctaatgtaccccatataaaagggaaacattagcccaatccacccaaattatcacaacttctaaagttttgcattataaattaatgacattgtgtggatgtccaaaaaaagtatttatttcccctttgaaacacaacataatctgccttcagctgatttgcaagcatgaaacaccatgtaagttcagagcacagatatcaagacaaattgcaaatgtgcttttttttttttttttttgagatggagtttcgctcttgttgcccaggctggagtgcaatggcgcaatctcagctcactgcaacctccaactcccgggttcaggcgattctcctgcctcagcctcctgagtagctgggactacaggcatgtaccaccatgcctggctaattttttgtattttcagtagagacggggttttgccacatttgccagactggtcttggactcctgacctcagttgatccgcctgccccggcctcccaaagtgctgggattacaggtgtgagccaacatgtccggctgcaaatgtgcttttacacaatgcagggggcagctccatggattcagagtatttccgttttttagatggtgaacttaaaacataaaggcatgtttagtaaatctgtggaaagccaaggctggaagtgagagcttcagagtttctctttaagtgaaagtccagagacggcacttgcctacttttccctctgcagggacaatgggctgccgcctcttcaaacaaagctgattgctccctcctctgtgcttgcacagaactcagcacatatccccacccctggtgtcccttataacactttaagccttttttcctgtcaatttcccactagactgtggacttccagtgggcaaaaagactggttcatctttgactccctggtgattacttcagagaccagtacgtagtgatgatgatgatgatgatggtagtggtcatggtggtggtggtggtggtggcggtggtggtggtggtggtagtagtgttggttgtggtggtagtcgtggtggtagtggtagtgctgctggtggtggtggtggtggtggtggtgatgattgtagtggtgatggcggttgtagtggtgatggtgacggtcatggtgatgatggtggtagtggtgacagctaccatgtattgtgcacacacattatgtaccactcttctaagcactttgtttaactggttgctcctgctaacagccctttaagatagatactattagccccatcgtacaaatgaagttgggtaatttcccaaggttataaagtttagaaatggtagagctaggattctgacccagctgtctacttcagccagtgcacctaactaccaccctatactgtctttctggggaaaaaaaaagatagaaagactatagccaagttacatgattcctatttattgagatctactacatagttggcaccacaggagataagaaaaatgattaagagagaaggtcataaatcaaaaacaaattagcagagtgaagagataaatatttgtcgaaagattacaattaacatggaagagaagcaaaaaaaggagagaatttaagtccaattttgaaagcatatatccaaattagtcgaataagacagtttaacaaattgtgtttaaggtgttttataactgtctttcagttcttcccttttgaaatgaaaacttctggtgtatcaatagacattgtgcttctgggtttattctgtgtggcatgaatgcaatgatataagcatacgtggatttaataatgaaaactggtatgtatcagtcaatttctactcataaaagtatataaaattgagcagctggctgtaagactccatggagcactgatagatccacgtttgcccctgaggccatctgagtatcaggtggaaaagtccacatgctaacccaatattctttgggttcggagttggacttgaccaacaggagaagctgtcagtattgaggaatataagaagccagcttccaagagaggttgcttttttctttagtaattatatatcacatatgtttttccatttaaataatgtaagaaggcctttattcattgccaaaggctgttatagtttcatttccctatgtaatactgacatctagaggaactttgaaccgaagagtttccaacaaacagaagttgtattctcctgtcctttccaggacagacgctgtatttctccttttcttttcaggactgcaaccaaaaatatgaaacatttttactttgtatttctaagttatgcctagaagttgctaaaatagaaagctcaagtttgtagatacaccttgtttattgtccaaaaatgaaacatgtcttctaccgattaaagagcacaggaccagtgctcttaagcattaagtttctgacccaatcctgaccatccccagttaatgggatgaaaaccatgtcagtgactatattcctctgctgaattcacatcgatggctgggatgaacctaaggacctctttcatgcaaattcacttaaaaatatttctatatttgcatatggatttctttggaactatttaccaattccttttataataatttatcagtggatgtagaatgacacagggaagaaaggctaagtggtccagatgtccaagtattcaaaacacagcttagctctctccactctgtctggcttcctagactggtctcgtaagtgggatatacgtacccagggagtgtccatagtagtcctttggagggtatcaaggacatgctagaactcatttcaatttattccattccttatggattgaatgtatcccccccgacgatatacgcacacaaattcatatattaaaatcctaaccctcatggtgatgctattaaaaggtagggccttcgaaggtgactaggtcatgattggagagtcctcatgaatgggattagtgcccttataagaaccaaaatgaaagtttgctcactctttatggggagaagcccactacacactagtaacggggccctcgccaggccctggatctgccagcagcctgatttgggacttctcagcccccagaactgtgagaaataaatgtttgttgtttaaaccacccagtccagaataatttgctatagcagcccaagctaagacaccattcttttaacatttatattttacatatgtttttaaaaatatattgatacaattggacacatataaaagtatctctgacatattaaatgttatttataaaaataaaagtgcagccaggcgcagtggctcacacctgtaatctcaacactttgggaggccgaggtgggcagatcatgtggtcaggagtttgagaccagcccggccaacatagtgaaactccatctctactaaaaatacaaaaattagctgggcctggtggtgcacacctgtagtcccagctatcaggaggctgaggcaagagaattgcttgaaccctggaggcggaggttgccgtgagtcaagattacgccactgcactccagccttggcaacagagagagactccgtctcaaaaataaaataaaatgaaataaaataaaataaaatgcatgtagtggttatcaatgtatataattataaataaatatatcgcggagtgctttaaaatattttactgatggcagcacaaaatcaaaataatttggagacaattgtagataacaccgtgcttcacactctgattttctgaagtgtgttttggagcaggatcattctaattagtcggtttgagtgcaagaacataattagaactatcagctcaattcttgcaaactctttttctccttctgcaaagtactgcttttaagagttcagtattcatcgcttgcgtgccagttttgattatttaagcaatttcaagtcagcactttatcctcttttctccgttaaccattacatttactgccataggatccagatttgaacagcagggcggcatcggtccacaggcgtgtgccggctacctgggcatgagtgcgctctcgccctgcgtcacagacctgtcccagtactacatcaaaaccctacttttcctgagagtggcggaatagctgaaagggaaattcattcaactgaacaacatcgtctaatccttctttcattcccattcaataaaaatcatttaaaaaatcaatggtaaaacggatttgtccttgaaagaacataaaggctgagataagggctgctcctctggacctcaacaatgccaccatcgttttccgtgttactgcagcgttctcaatgtgtctgtctgcccgctggcatacggacccttctcttccccttcgtttccccagcaccgaacagagggtaaagttctgaagtgcttggtgaagcaatgcgtgatgaagaaaacagtgctttctggaatggcacgttcactgtgagaacactctgtcatcaggctgcacccctgaaaagccaggctgccctgggggccatctcagatgcatccctgccacggtggctcatatccacagccctgaatttacatagccgatggccagcaatatcaacggccatgcattttgggattacagttgctgcagaaaattgtgttcataacataacatatagagaattcctggttctttttaaaactgttgcaaacaggccagatagaagaatggaggagaacaaatatttgtaataatttgtagctgtgacccacagcctggactctgatggtggcaggtagatgttagaggtcggccaccctgtcctacagctctgtcctctactgccaggctcaagtgttggtcttttcaaacctcctcagctctgaacgtatcacccacatggcctttctacaacaagggggttatcaggataagaaaactcggaagtgtatttaaattctaaaagttcagtgtgaaaaaggaatagcctaatggaataaatctgaccagtcctgggctccgcagagtcttttcttgctagcagaggacgctgggtcatgtaccctgaataacagttttgcatattactgtttgtggaaatgccaagatgaacaatttttggccattttacctaagttctagaaatatctaaacaaaagtataacaatttataatgactttattaaacttggattagattcctaatgggggagagaacaataaataaatcctacaagaatacaaagagatgaattttcagaagaaatatgaaaacattttcttgcctgagcatagaagatacttctagagattgtttgtaaagcaaatctatttcccttcaacctcagcacacactcaaactctccatgtatgaagcgagaaaaccctgaagtcctgggtgataaaaggaattctcactaagcaaagcctgtttcatggtctgtggggactggcatggctcaaggcaggacagaaactgactgaccaaatccagaaagggaaagtgttcacctgttctcagaactcagtaagtggatcctccccaggctgctgatgacatcaggtggagtcagtcacctgagaaaataaccccgccaggaaaattaaagcctttccatgcacccacaattatgtgcacagtgcttcactcggaagccaagtaaatgggaccctccaagtacatagaccaagaaagagcctgaagttaaaggtgtggatttaggaaagcctaactggatcatccactgaatgaagatgcacggataattttactttattttattataatatacattgagctgtatcataagagaaagcatgctaccacttttcttttcttttcttttttttttttttttttttttgatatggagtctctctctgtcgcccaggctggagtgcagtggcgcaatctcggttccctgcaacctccatctcccgagttcaagcaattctctgcctcagcttctccagtagctgggattacaggtgccccctaccacacctggctaatttttttttttttgtatttttagtagagacagggtttcaccatcttggccaggctggtcttgaactcctgacctcgtgatccacctgcctcggcctcccaaagtgctgggattacagctgtcagccaccatgcccagctgctaccatatttaacagcctctgctagcaagaaaagaccgtgtggagcccaggatggtcaaatttactccatcaggctattccttattgacatcaaaactttttataaatatacttccaagttttcttatcctgataactcccttgttgtagaaagggttatatgttcggagctgaggaggtttgaaaagatcagcgcttgagcctggtggtagaggacagaactgtaagatggggtggccaacccctaacatctactggccaccatgggggtccaggctgtgggtcacagctacaaattattacaaatattctctctcctccattcttctatccagcctgtctgtgtaaattttaaaaacaaccacttaaaatgaacaaattaagaatcttcacctacctatgtggccacagtgagtagttcgataacacagattttattttcccccatcttatacccattggatgtgctgacaccttataatgagtctgatattgttattttcttcccactgccaccttacctgtcctccccacagagaaaacgctgagtcctctgacttgaggccgctctttctttccctctcaaactcgcattgctcaccctgccgccccaccaccccacctgtttttgttatccaaactgttctaagttctaatatgtggctctcaaccatctggggatgttggacactattaatgcctgggtcctcccctgaagattctgataaactgggtcttgagtggggccagaacaccagtgttttttaacccacccacaccccagggattgtaaagtactaaaagggaggggacccacttcctctgtcgcctccggtcactctggcctttgttctgaggccttcttaccagccaggctccctctggtcacagattggagcaattataacaacactggaatccctcttcctccccccgataagcaaggtctttgatcctatccaggatggactatctagcaaaccactgcctcctccttatcctccacccagggatacgtgtgtggaaatgaggccaaggtaaacggccctgagacccataaaacctccctccaaaaatgatctatggggcatcctgggagggcaacaaataaaaaatccaacgttgccaaccatgcctctggtcctctgcctgaaagctttctgccttgcttcttggccaaaatttagtaattgaaagtgatttaattcctccattaaaatggaggtaagcagaagagaggaggactcaggctgaggtggagaaatatcacctttcagggcatagaagtatttatagcactttgcgtaaaagtatatctaaaaactatacatcaagggatgctttgccttcttgggattccgtcaccagaatagcacctgagcacttcaaaaactgtgcagtgaggctactaagaaattgagagcgtgagtgcatgtgtgtgtcaaccgacttcaaatggaatcacagctcctcatgttcatttcattaaaatgagtcttactttgtaaaatttccctttcataacgcaagtccaaaccttggaatgttttcgcatgaagtttacagtgtttcttcatcacccaataaaactctttgatttcttcccgccgcagacagttttaagagccttcatttcacatggggttctcggtatgctttttaatttttattttaagatcattttttatcacttcatctcctgtctcccactctgagcctaagttcagttcggcctccccgagccccactgcctccctgcagtggggcacgccggccgaggctcagaggggcttggtgtttcctaatgtgaggcgaggtgtggtcccctggactgcaggaatatttagagatctgcgcttagactcaaggagtaaaatgcttaacctcctaatggtttacctttctgcatcttcccctacacaggaaacacacactgcaaagcaaagtgacttttgaaaagctacctctgaaaagcaaagagatactacaaagctcttcaaaaatgtctctgaatgaatgaatttgtctgtaatacaaactgcgtaggtaaaaaactaatcagttatgactgtccccaacatttagtcgcctggtccagtctatgcaaagtgggctggtgaatccgcagcagcagcatctcctgggaacctgctagcaatgcagaacctcagaacctcagcctctccccaccacccacccaatcaaaatctgctctttaaccaatggccaggtggttcccatacatgttagaatttcagaagcgttgacctagttaatatacgtcatgaattggtgcgaagaatcattttacaaaatatgtgtcccagcctcgtgtgtctatttacatcttgcctccatccacaaggcgtctgaagagctaatctcgtacttgggtaaactcagagggaagccagtgaggagcggggagggagtcgagacagcattcactgggggccgcatgccgctggccttgctggcagcagttggtggagacccagcactgtgtggaacatccgtgagctgctcaggaggcccaggactcccgctggagctcagggaagagcatgcataactaggtatcatgtgcctggaactttccactaatctctggggttgacagattgcccaaactcaggcctcagagaagagcaacattaaggcccaaagacaggatgaaaaccaaggcaaaccaagctctggagaattaggaatgtattctgatgggccccaaaatgcaaattaggcagtcaggattaatgcaaagaatacagttagaattaatacaagtgctgtaacctggctacaataaaggtgactatcaacttgaaagaaaataaaagtattgtgtctagcatagttcttacaaatcaaaatttagaggttgaagggtggggtggggaaggaaggcggaaagatgagctgttgattaaagggtacaaagtctcagactggagggataagttttagtgaactattgcacggcttggtgaccacagttgttaataacatactgtacatatttaaaaattgctaaaggaatagatttttaacatcctcaccacaaaacagtgttaagttggggaggtggtagatgtgtgaattagcttgattgaccctttctacaatgtatacatagatcaaaacttcacaccgtgccccaggaatatacacaactgttatttgtcaattagaaataaattaattaaaaatgttaagtacacagctagtacataccctccaacacccccgatcggtctgtgttttactcctaagatatgcttaagccctcaatatatgaagaacatgaacaccaagctgaactcttcgggttcttgtctcattgtcctttgtttgattgtggacgtgggggaaatattcagctggtatgctggtaccatcctagttattaaaacatggaaatacctccatgctggctggtaaataggggattttctgagactcccaggagctcctccaacctcccgacctcgcctcctctcagcctcaggaccatcctaagaccagtaactatagggtcaatatctagcatggagggggcccccaggaccctggtccaatgcagtacaccttgatacgtgagcaactgtggactcccagttattagtgtacagaccagggaaaaagagtatcatatgaaggcatgtggccacaacaacaggctgttggccatgtaatatttaatatttaaataagaagtttttaaaaatatttacgctatccctgcaagttcattattaggtacggaatcaaagtgtgctttgaaagtcaaggagagagcaatggacaacagtgaagagaggtaaaagagttactaccagcaatgcctttacctaccttaggccctgggacggtggccctgaaattattaaagttccttccccagaaattcttaatctatgggtctgggttgaagcccaaggacatttttcatgagctctgggagtgattctgatgcacatggtccagtgaccctactttgagaaaacaggtagaactcctacccattattcaagacccaattcaggaaggtttccctttgtgaattcttttttttttttttttttttttttgagacggagtcttgctgtgtcgccaggctggagtgcagtagcacgatttcggctcactgcaaactccgcctccggggttcaagcgattctcctgcctcagcctcccaagtagctgggactataggcgtgtgccaccacgcccacctaatttttgtatttttagtagcgatggggtttcaccatgctggccaggatggtctccatctcttgacctcgtgatctgcctgcctcggcctcccaaagtgctgggattacaggcgaattctttcttaaacactcccctcccatatgttctacctaaagaggagtccaccttctctctgcctctgttggccacacatcttcgtggatttatcacactgtgttgaatgatttgtttgcatttctgactccctcaaggcatctcagtatctctagaatctaactcagtgtcagctcatgacaaacactgattgattgactgatttgttgattagaaggtcgggttgggggaactgatgccaggctgtatttactgatcatctcaaccacctgtatgaagatttttgtcaagggctgccattacatgccctttattacatcctcctcagcatcacactttgatgtccagctcccagactcctgtggtacctacaagtcccacgtccatgcagcgcaatctgttgtcctggacctctggaagaaaagctaagtcttctcagacctttgtagaaattcaaatgtttgtgtcaccagcagcatctgaaactctatcctcagtatggtttttgaagtaatttaccatttgatcaccttctcaaatttcttagacctactaaaaatcagaacatgtactataaacattcatttgcttagtgtatatatttaagatctattattcatatttctgcattggccgtaacttctttagcatgctttaacatgtttgcccagagagatacttcatgaatacttttgatcatgggaaatgaggttagagttagggattgttgctgccacattttactttattatgattatggaaactaatttttccagaaggcaagagcagggagtagctctttcctttgaaatgtctggttaaatttctttgcacatctcctagcccaacatcaaatcaagtgctaaataatgtctttgcattttactattaaagtcctttacaatatatttctaatggcaactaagtagccagtccaattatacatcatatccatcactctaatgtcccctcagctttaaagttctaggatgtcacaggagctagaagaaagcttagcacagcgaaggagcatcctcagaaactttatatggttgcaagacaccgattctcgggtgcttttccaaatatctccacccttggaatctgtcttctgttgtgattatgatttagtggtaaccagattgctaagcaaaaatgtctttataacagatcgcagaagaaagcaagatgcttgtttgggtggctgtgtgcttcttattgatttatttagtgtttttagttcttccccatttctcagcaggtgaggccttcacttgggttcagttcttaggttctcctcactgcattaggaactgtcaacatggaaatcgttctactgaggactttctcaacaaagtttcccattcccctttctacaaagggaagggagggtgatgggagtagtctcaaggttcttctcaagtttcttctcaagcattgcttggaggtagtaatgagtgaagcgggatgggggtatacagagtctgagtttgtaacacatgcccctccaggtccttttcaaattcctggtcccagtcatccatggcaatgagcctgtgttccctgtttaagcagggagcttgatttgctgattcaaataagaataacaatctcttattctccaaggcaggaaattgctgttttggtgaatgaaaccaaaacaaatccaaaaagcagcactttttgttgttgtgtaaatcagccatttattttccatgttggctgaaggcagaacaagaagaaatctgaaaaaacaacttagatttaacatcacatttaaattttatattacaaagaaattacgggaatggaaggagtttgcctcccagtccattgggttagaaaggtaactgttttgtattcccaaccatacaatttaccacaaaagaacatagtattttagaagctcaaaataagacaaagaaagggaaaatttctcaaattatgtaatccatttgaattcgggggaaaaaaaaaaaaaaccttaaagagcattgtagcccaatcagctcaacttgaaatgagattctacccaatttcacctagttacaggaaattttaataatgtttaaaatgtttttgccaaaagggatgaccgtcgataacactgaataatattgatgatcttttcccacactttcatctttaaaaatgtcataggacattgcaatatatgatcttttctctcattaaacatccagccatcacaatgcatttttcaaagacacacagctctgaatattctatctgttattgtatactgttttctgtgatgtttagaagagtaggcaactatagattaatttgtgttaggtatttgtataagcataagaattaatttatgttttggtatcaggtcgctatagtgagaagcacgttattcgtcactctaaagtgactttttttttttccagaaaaaaaaccccacaaaagaacaaaaggacatttttggaggtgatggataagtttagtaacttgatggtggtgatggtatcacaggtgtatgcatttgtccaaactcatcaaaacgtgtatattaaatacgtgtaattttttgtatataaatttatacctcagtgaagctttttttaatatagatataataatggacaagattatgaaaactgtattagcacctgtggtatcgaaagagaaactttagctttggactacacagcgtgtgggagccaggaggggctggcttacttccttgattggcagagggccccacttgaaattcttcgaggaggagagaggtacagtatcacccagggcgtgcatttccataggaagccacagcaatgcagactggctcttcctccttcacggagaacatgctaaactacactcagagcagtaataagtaaatcaatgcctacgacgaggtgacagctggcctctgcagcagaaacacatgatcacagatggaaagctcaattatgggtattccaagaacagaattaaagtctgttttcagttagaagccccatataaaatggggctccatctgtatttactacatgcagctgcgtctttctcaaagtgcttaatgaactttttcttctttgtgaacgtccacttgcacataaaggtagcaacctgaagtaaatatcacaggaacatacctgcacaaagcaacacgggacagtatacgtttttcttcctctgttaactgagagacattacatactccatactcaggtcctaagctatttcaaccaactgcagaaaatagatctaaactgtgaaataaaaaaaactgctttaagaatagtaactttttccaactattatggccatatctcattattttcatgtattaaaatttagtccacagtataaatatacttgaatttcacatttaatgagatcagttcaatttggcatttaacaatcactgtaaaatttttcattttgatttaattcagttatacagcaatatattttcaaaccgatctcattattggtggcgcacatttacacgcacacacaacttactacagcaacatcagtcaaatcgcaacatgaaaagttcgcatgctattactttgctgttgttcattttctattcacccccacaaaattaatcatactggcatgaacttctcctaatagagaagtagtgttatttaaaataagtaagttcagttcccaggtagatgctataaaaagtgttaagcacattttatgaattcgactttcagttagtatcacccccaaatttttctccactaaaagttgtgacaataaatgtcaaagtcaaatgtgttttttcttttgaattttaaagaaaacgaaccaaataaggattacaacacctaagaaaatctgcattctataaaattgagacttcagatgcaaaaaaaatcaacaaatcaaaatcctaaaatctactttttttcaagtgattaagtaactaagactagtttgttataaaatatggatatgtatttttagtgaaatagcataccattcataagcatcatatttttattaaaatattgctcccatcaatactcatttaaccatattcacattcacagagtgtatataatcttttcccctggatgatttaatatctttattaaaactcaaaaatagaaattttgatggtattaatctcaaccttatatggaaacacactttctcaaaacaatgttttattttaataattaataatgttaaagtcagtttcattactaagttcaagtaataatcaaagaacaccaactccaaaataaaagttgggaaagttgacactgaatctacaaacatattcatactcagaaataaaaatgtgtgcttctgagtactattccctgatgaaaacctcagttttaaaaatttgcctttgagcattacattttgttacattctcctctactgggtttgggaatgatttttcagagaataccaaagtgctgatctttgttcatcaaagttcatcttcacagatttgccatacaatgtaaccttcatcatcattttggctatgggagaaaaaaaaatcgtggctcacctttccatttcctctgctaacaaagtagagaaattatccaatctcaaaaaactatatttactttgacttaaactgttagtctcaggcagccccaaagtaaatcggctattctagtatgcttagggattctggcagctctcaactctcacaaaggttgttgttttggttacacccaggactatatgttctagtctacttaatcttttggcctatcactttgtactctgactcataactaaaagtcctagttcccatgaagaaacatcgtttcttcaaggcagaagtcaacattataggaaagcctgggttcatcttctgccttttgcgtctccgtatattctctcatagccttgaacacagtatctgatttctttctaaataagctactatttttaaaatttgaaaaagtttaacctcccttctcaagccatgtacctataaaatttcagattgtccccattcttttagaagatattttgccttcttcagcatgataataacagaatgatcatggttgctatggcctttatcctgttagtggtactcatcatttatgtttaatcagaacaactcactgctatttgacatttcttcccactttggccatcataaccctctatcggtcatctcatctactgtctactagtcatctatgaacagtgaactgagattttttcctcttggaaaactcatgagccctttctattcaactctgcaccaatcattccaaaattcggtctttatttctatcacacaacgatgagcagatcttaacatctggtcatgctgtaaggatctcaaactttacatatcaaaaagaaaacatcattttacatcaacatcttaacactccatattagcttgccttcccgttgtttcagtttctgtcagtggtgccatgagacttgcgtcttacttgtggatctgcccgtgaggcatggtgtcccactcaaagccagacacagacagatctgtgccttgcaccttcccactgggcatagctcacaaaggaggttcaccaccttagaattcagggccacagcaagccccaggactgaggttcatgaatggcaccaggaattcaacaaacaagcaagtacagcacatggcaacccagagaaacgctgtttgcaattccatttgaactagtgttctgcatgtttttctttggcaacctatgtgattccaacattcagtcacagattgaattgagttgagaacaattgccctagggttagcttgctaatgtacgatctctctaatttgtaaagcttgtgctaaatggaaagtgaattctgtagccccagccaagatttccctttcaggtttggttaatgatggtttaattcaccaaactttaagagtaggtgttgggaggtgctaggatttgacagcagagaaataaacccaaaatactgtctctgtccccaagaaactaacagtcaggagctgaaataaaataaaatcttccatacttgaatatatattttattaaaacaagaaatcatttctttaaaatataaaaatatttaagtagtaattggctatgttgacatttctacttatgagagatgtccatttggaataaaacataaataaaacccttttacatggaggcatcaaaaatatattcttaaaaattaatagcttttaagtactaatataaaccttctctcacttgtaagttttctgacattgaatgctgcttccggttttcaatgatgcctcactcctgcaggctgcgttgaataaacatagaaattgatcccccaacattggtattaaagctctcaagccatgtggttccttaggagattgaaataggcccagttgtcccacagaactgatgttcatagtgtcttattagaaatttacagcccccactccctccccaagtcttaaaacttaaaaaagttacatttttcttctctgagttcctttctcaggaaaccaaccatcaggtctcccagacagtatcaaagaactaaaactcaccaggtcaccacatctggacaatgaaatgccagactccttatccatcatgattgcttaaacaactacctcctttctgttgaccagctctgcttccttacccctccctaattcctgttttacatttcttcactgctataaaaacccctaatttcagctggttgaggagatggatttgaaacagatctcccatctccttggctgcagcacccaaataaagccttcttccctggcaagactcaaaatctcagtgacaggctttctgtgctgcaagaaacaagacctagaccaaacccctggtgttccagcaataaaattagacacatggctttcagtgttctttaaagttggtgtttaaaagcctgaacaggatgaagggctgtgtcatagcacagactgtcttacagtagcttatactatcaccaataatttgttatcagcaatgtccgaggtaataaaatttgccagcctttcttttttcaaatcagtggtttcaagtttattccttataataacatttcttgcactcacttgtctccaggagtgttttcctgagtgggagacacaggggaggaactgtggccattctgctggcttacgcataaccacacacagctgtgtacatgagaccagggtgggaacatcctcctccgtgtgtgccacaacagaaaatggcaagaactgctgctcaggttcatatcagtccattaattaacacgtatcagtgccacagtttcacccagctgttgttatccagtttccatgcctctgaatttcccacaaggacatggtaagaaactcaattgcagaaattaatctaatcatggtattaccatcaacaactagtttagtaaccatggagaaaaggaagtaagatgactttagcatgatattttcttaatgaactcaagttacaaattattgttagtgttctggatgtgttagcatcctcctaccttcacactcaggtggttccatgttctaaatattcttagattccaattacttcagaatctcctcattaaatgttcttgcctatggctcaataaagataaaatgaaatggggggaagatgctccttgtattttcaaactttgcactactatgacataggaggacaattttctgtttatcctgcatgagctttgctatggggtgtcagctctatggaaggaccacgacctcacagcaacacactttaatggggcagcacttattcgataagctaagaagtgcaaagatgttttggaaaggcatctgagacacacatttagtatgtgacattatccatgaactgaaaacaacttttaacaatgctaaagttgggtatcttttttttttaaaggcaaattttaaggtatataactttaaagtaggctctaagcatttcatccaaaaaagcaacatacaaatgataaatgtttttcaaaataactaaagctctttcctccaaccatgatatccttgacaaaaggtgcttctgtaaagatgtaaatcatgaaaatacaagttatacattatgcaggtaaatatgtatcaggatatattcagagctggccatttgaagtagatttttctcatcttttgttttaaagcagaagacggactgctgttaactggtctattcaaaaaaagcaccaccatgtttccactaatgctcactgtaatctaaagtcctcaagcacggatgccactctcccttaacatcagcttcatcatgttccggggctcatgttcagcagaggccacctgagatgataaatgacctttgtggagagaagctataaatctaagctggctcccttttgtccatcaacggcagtcaccagctgtgttcagtagcactcacgtactctctctgacatgcaggtcctggctagcaaattccagaagataggccacatatgggtaggcttgcccagacccatgtgtctacttcaggccctttaaactcaagtagagagccaacaggcattcaaagtacatcgccagtgatgtaaaaggtcatctctgacttgcactaaacagaacaatggtgacaatgaaaacccagcaaattcactagtctatgacattcatgttttgagaaacagatttagtgatcacaaaagtcataagcaatagcttctaaacttaagctaagcagaatcaaacaaacagaacctccaacgattttgaggtacactaagtgggacccactgaggttcagaaggcccaaatgagacgtgcctctcttcacagagccagacggctgcatcgggctttcacacatcaagacttcatggagaaaaaactggacacaagctactctctgcccccactcaacagagtaccttgcttcaaaccctgaaaagtcctgaagaaagcaggccatttaaatccacaaaatgttaactcctggatgggatcctctctctcaaaaccaaggactgatctacagccaggatgctgggttctcatcccatttctgctaaccagacatgtgcccttgaggaaggcatttaacatctcaaagactatgcttctctgtcaaatgggcacagtttccattggatccaaagattattgtgaggccaagatacagtgacacatgtgaaagcgcttttggaaaaagaaaagcaacatagtcccggcatggtggctcatgcctacaatcccagaactttgggaggctgaggtgggtggatcccctgaggtcgggagttcgagaccagcttgaccaacacggagaaaccccatatctactaaaaacacaaaattagccaggcatggtggtgcatgcctgtaataccagctacctgggaggctgaggcaggagaatcgcttgaacccaggaggcagagattgccgtgagccaagatcgatcgcatcattggactccagcctgggcaacaagagtgaaactccgtctcaaaaaaaaaaaaagaaaaaaagaaaagaaaagcaacataaatactaacttgatttagtctttccttcagcaagcattttcaagttctgcacaaatggagcagtgcacagaatcctttctccatggccaaaagagaaggttctgtgtgtgtctcagtgtggagtctttgccactgcttggtgaaataggagtcgcatccatgcatggccctgatacttggaacaacgctctccctttacgtaacaggaggcacaaagctgccctggtattacgttaaagagaactcactccccatcccatgagtcagggcaggatttaactgttagcaatgccctggggaggtcattgaggaccagcagggccaggtggtacagccagtaccttttaaaggttgtatcccatatttaggcctacgcataggctggcaaagctgccctgagctcccattcagtagagaaaccggcttggtaaaaattcctcttcaaaacacaaataaatcatggccactcccactcaaacccaggatgaagaatgatttttcttgggtgaaaaataatacaagcccaaaccacaatgagataacaccttatacccattaggatgtctactgacaaagaaaatagcaagcgttggcaaggatgtggaaaaatgggaaccctagtgcacggttgtttggaatgtaaaatagtgcagctgctacagcaagcagtgtggaagttcctcaagagactgaacatggaattgaggtaggagaccagcaggacttgtttccaggacccggtcagaggaagtgaagaaaccagccaaaaccagcagatggcaaccaaaggaatccccagctggccccattgctcattagcataacacatctcaccagcccatgactccatgacagttcacaaatgcaatggcaacgtcccagaagttacccccgcttcttagaaagttctaagtaaactgcccctcaatttgcattaactcaccccttaatttgcatgtaattgaaagtgggtttgaatgagtgtaaatacagttgccaataccccacacattgcactctggatgcactgcctatgagtcagccctgctctgcaaagagcagtaccatttgattaaagattgctgactaacgtcactggctcatccttgaattctttcctgggcatagccccaatttgggggctcgcctgtcctgcatcagaattatcatatgacccagcaattccacttctgagtatagatccatgagaactgaaagcaaggatctcaagagctatttgtacacgtgtgttcatagcagcttactcacaatagccaaatggtggaaacaaaccaagtgtccgctgacagctgaatggataaacaagatgtggtatatacacacaatagaatatgattcagccttaaaaagaaaggaaattctgatccctgctacaacatggatgaaccttgaagactttatgctcagtgaaataagccagacacaaaaagataaatactgtgtcattccatttacagtagtcaaattcatagagacagaaagtagaacagtggttgccaggggctggggtcagggaatgggaagttggtctttaatgggtacagagttggctgggcgtggtggctcactcctataatcccagcactctgggaggccacggtgggcagatcacccgaggtcaggagttctagaccagcctgaccaacatggagaaaccccgtctctactaaaaatacaaaattggccaggtgtggtggcaggcgcctgtgatcccagctactcaggaagctgaggagaatcacttgaacctgggaggcggaggttgcggtaagctgagatcctgccattgtactctggcctgggcaacaagagcaagactccgtttcaaaaaaaaaaaaaatgggtacagagttgcagttttgtaggaagaaaagagttctggagatggatggtgctgacgggctgcacgacaatgtgaatgtacttagcatcattgaattggacacttaatggttaaaacggtattttatgttatgtgtcttttactacaatttttttaagtcataaaagccaatttcatctatgttgctgtttggaacctttctgagaagaaaattggctgatccaaacaatgttgggcagagaaaagcgtggtgttaacattacctgttgtatgagcaggaggtttttccctcctacctgagtacaggggacttgttggatctaggggaaaggagcatctccctacaagacatctaaatcaaagttgacttccaagaattagctagtcctgcttcacgtgtctggcttacaggtgagggtcaaaaccgctagcaaacatgcttgtctcaggttcatgaatgcagaaattcttgctgtctccccatttctgagagaggggcctatttgtagcatatggaatatgaaagggttttccctgccagaggagatgaaatgtttgcatagtcaaataactcagaacacgtgtgaaactccaggcccttggaaagtccaagatttatgggacctgttccgtgctgaccaggattccacggttcctcgtgcactgccaccacccaggctaccacgactgttgccccagggattccagaacctttgcactctggtcaaagctctctgctgcctattttttttttaaactctagtaaatgtttctttgtaaatacagagtaacagaaaatacaggaagaatcctttaatgagtctgaacattgtggacaagcacattggttaagacagataattatctctctttcctaatttctttccctcatcaccaaaggatttgaggttactaccatgtggtcaggacaactatttttatggacacaaaatcaaaggattttcaagtatcatagttaaccaaaacatcataaatcaccccttcatagggttttcactttgtcagaagttgaaaattatctttatacctgtatgtagtagctaggagcagaatgtgtttaagtgtgatcctgtttgggtaaatcctttaaggaaaatacatatatgctggtgtgtgcattaaaacatctcaaagaaatcacaagaagctattgactgtgtttgttatgcagatagaaacttaaatcgggggcatcgagtattctatttcagttattttctgtagtttgaatttgttaccacatgctagtatgtggtattcattcattcattcaagataagacctggctatgctcagaggagtaagacagagccctggcagaaaactccttacaacctagtaggggaaactgatccacacattatcagttaccatgtgtgtactgtaattggtcaagaacctaggttcaaatcctgacttggccatttcttagccatgtgatcttggacaagctatacctttctgtacctcaattttcacctgtaaaatgaggatagtagttcctatctgacagagtttttatgaatataaaatgaatgaaaatatgtaaagcagttaggatgtgcttggaacatagtgagctctcaataatgcctgatgttactatagtaaagataagagacaggcattacaccaatagaagaaggatttcttcagtctgggccctggggtatcaaggctctaaagtggagatgctgcttgagctaggccttaatggagaagtggtgttctgccaggtaagaggagggaaagggcattccaagagaaggggacagtatgagcagaaacaggttggtatgactgcctggttagcagccactgcaggcaaggtgaactcctgaactttccttccaggaacgtcttgaggaaatgagaaagaaagagcagctttgttcgttttgaaagtccagtacgtaatttgtgtaaagtctgacccttcctatgccatttcagactcacttgttaaatttcctttttacggtcttcttggtagaagttcacacctgatcaaacatctgtaaatgagctagtataaaaaatgaaaatctgaaatataaagcaggtccctaagcagacctccagagcagacatgcagaatgcagcaggcctcacacctctcgaaatccaattgacacctgcttctggggccagggaacgtacaatatggctgttgggcgttgggagatccagttcagcaccccctaagtggggctggtcctgaaggtcacatttccctggctctcccgagatttgggattagactgtaatcttgggcttctcaacctaaggtcacactgaataaacacctatatgtttgagatagtgcactaagacgccctcatccaatcctcagcagaagcttgtgggtagacattattttttcccttttataggagaaaaactgggcctctgagaagtccagaaatttgcctgagttcctgataatagttcaggatttagatccatgtcttctgactccacattcagtgctcttttcactgctacatgctgtctcctctgagaagtgctttaaactcagcattccaggatgtcggcttcatagaatcattgtgtgagagatataagaaatcctagacatcggccgggtgcagtggctcatgcctgtaatcccagcactttgggcggccgaggcaggcggatcacctgaggttgggagttcgagatcagcctgaccaacatggagaaaccccgtctctaccaaaaatacaaaattagctgggagtggtggcgcatgcctgtaattccagctactacggaggctgaggcaggagaatcatttgaacctgggaggtggagattgcagtgagccgagatcacaccattgcactccagtctggtcaacagagtgaaactctgtctcaaaaaaaaaaaaaaaaaaaaaagaaaaagagaaagaaaagaaaatcctagacatctagtgctgcggtctccaaacctacaccaagaatccccaccatgctcatgattccagatgtacttccaacattgtctacagactgagtgagtcatagattgctagtagcctagccaatatccttctcccttcttctattctaacagatacctggataatgtgctctccaaaaaaactacatcctttagcctcttttgaagaaggggtagccattggtaaataagcataaaaattataaaaacctttcaaggaaaactctttgcccttccatcatccttccttcttcaagctgcaggaaaagcagatatggtaggagctccagcagccactttgggaccatgaagaaaaggtcagagaatttcagagacattggctataaaccaacacctctggacttctttattgtgagggccgatatctttatgtataatatttaatccaccaggcatagagctctgtttctagaagctgcatacaatttctaactaaatattagcactactgaatgtattaccattgttcagatgtttgtttatactggtgtggttagtaagaatcaaatttattcaaaagaacaactgaataaaaatagctactagtcatgtaatttctcaacaggaaataacagaagtatggctgctatgataaggaagtctgtgaatgtttttcttttacattaagaacgcctttagatatggctagaagtcacgagtctcctttgatccataaagtaactttctaaggccagttatctggactcacgatgtggtcctctttccaccatcccactgacattactttggactgttcttgcagacagaccatattagcaaggaatgagggaaaacggggcgctcattttgaacaaaagtcctagggcttcttagggaaagctagaactctctacaaaaggctcttcaaagggcaggacatgcagctaaatcttgggttacattcctggatcacatccacccacatacacgaaaaaacactcccgtcagcttcactcataaagaccagtacattgaatttttatcagtgagaaaggtggggaggggaggaggaccagaccaatggtattaaaaagaaacaaaccagcagcatttctgtaaactggaagggtaaggcataatccccccaacacatgcacacaaacatctcatgttttataatagttcttgaaagagtcaaaagagggccacccttccacaggtaaaattacgagtttgaaagcaactaaatacagtaacttcctacccagctacagaagggtctgtgccaaataatttactattaactgtctgtgaaaatgtgtggcattttatagcccttgaagtttgtgcctctgtttggtgatttattaattataaatggcatgatatatctcacagtttgtctttctgttattttcattagcgtaaaccctcaacaaattcaagttcaggtagattacaagtccattaaaaaaaaagtatgaaatttatttaaaaagaagcacaaattgtattccaggcctgtaaattcagtaacacaaattaatagctaacaaagtgaggctcaagtgtgtgccatatcagaattcacatcaacaagcagcatttgtcatcagaaaaattagtctgggctggatgtggtggctcacacctgtaatcccaacactttgggaggctgaggcgggtggatcacctgaggtcaggagttcgagaccagcctggtgaacatggcaaaaccccgtctctactaaaaatacaaaaatcagtcctattcccagagattataatttaatttacctggtccttagaatttttaaagatttcccaggtgattctaatacacagacaagtttagggaccactgtcctaacattttttttaaaaaagcagagactaggctgggcgcggtggctcacgcctataatcccagcactttgggaggctgaggcgggtagatcacgaggtcaggagatcgagaccatcctggccaacatggtgaaaccccatctctactaaaaatacaaaaaattagccgggcgtgatggctggcacctgtagtcccagctactcgggaggctgaggcaggagaattgcttgaacccgggaggcagaggttgcagtgagccgagatcgcgccactacactccagcctggagacacagcaagattccatctaaaaacaaaaaaaaaaaagcagagactaaaactaatgaaacaaagcaagttggagacaacagagattatgcagggaaatgagaactttaaaaattactcattgatattaggctagtgcaaaggaaattgcagtttttgccattaaaagtcatgcaaaaactgcagttacctttgcaccaacctaatatcttcagggaaataagaaaatgtattaaatctatgtcacaagaataggattcgtgtaaaagaaacattcagagaataaaaagaaattattggaaattaagactatgatagtagataagaaaatttaaagaaagtttccacaatagagtaaagaagtctccctgaaagcagagccactagatatagaaaagaaaaataaaagcaaaaagacaggaaacgtaaaggactagactaagagatctaacatccaaatattaataataggagttccagaacaagaataagagaatgtgggctgggcgtggtggctcacacctataatctcagcactttgggaggttgaggtgggtggatcacgaggtcaggagttggagaccagcctgaccaacatggtgaaaccctgtctctactaaaaatacaaaaattagccgggcgtggtggcacctgcctgtagtcccagctactcgggaggccaaggcaggagaatcgcttgaacttggggggcagaggttgcagtgagccaagatcacaccaccgcactccagcctgggtgacagagcaagactctgtctcaaaaataaataaatacataaataaataaacaataagagaacatgaaactatccaagaaaggttcctagactgaaggatgtgagcacccagcaaatgtccagcacaatgaatgaaacactcatacaaagcctaccactgtgaaatttcagaaaatccagatgttatgaaaatgcattctgggtacgtgacctcaaagtgagttgcaggacacagtgactgggggaccaagataactgctgctgccaggaataactgcccctgctttaggagtgttgaccagattgtaggggatccaatttctttcagtagaaagtaaatagattaagaaagcaactggatggtttaacacaccgtctatgacttttattttctttcccttttctttttgtgttataaaaggttagagaggcatgcatcgcaagctcagagatctaccccttcttcctgctacccaagactgcctcatatgtaagttcctcctgaataaacctttgactacctaccaacctaaagtggttttgcctctttcttcagtctgaacttccctccacttacggacagtggttcttggttctggcagaaacttttcccaatacaaggacaaatagaaggtttcccaagttgctagagagagaaaatataggccacacacaaaagatcaggattctgaacttgtttggacttctcaacagctgcatgaaagctagaagacaatagaaaacaaagtcaaactatcaatgtgtacatataaaattaagacactttcagaaatgtaaggtctcaaaaatatacaatcctccatcattctcagaaaactactggaagatgtatgacatctaaacagggagtaaaataagaaaggaacgcaaaagatatctaacagaggtgatgcaacataaagagacagggtctttccagactgttggagagttgaaatcctcagataccagctgtgcttcagacttagacggcaactactgtggaacagaataaagcccagattggttagaagtctcttggagaaatttcttcaagaagataaaattgatagaatatttaataaatctgaaggcatgtagaaaggattttgacaattagtatacagtgtggtttagagtatgagatgcgtctttcaaaaataagcaagtttttaaaaatcaaggcaaccaataactccagggaaaagaaaaagctgagcaagaaataaaaatttatagtagtgctttacatagctttcagccatgaataataacattttcaaaatcacaatcattgaagcactttttatttaaccaaaaattataatataactatgttgagagaatgagagcaggaagtaggacataaaaggagtgtgtgtgtgtgtgtgtgtgtgtgtgtgtgtgtgtgtgtgtgttggaggtggaaaatagaagagacctaatcctcatctttctctctacagaagtcaattttcaaaacccaaatatgaaaagaaaaacgaacacatgcatattatttagacacatggaggtaaataacaaaagaatcagataaaggaaatgaaaatgtttacctctggtgagggggaatggagacagaatgggtaggaactgctgtgtcttagcaaaggctttgtaaaacattataactcttcaaattatgtaaatggataacgaatataaaaatacaaagatttttaagtaaaaatattttatacatcctatatataatgttttaattatgaatgaattgccccaattcttagcatgacaatttgagaacctattgtatcaccttaatatgcattttttcaataatataccagcttctcatatttttgcttttttaagtttttttaaaaagctgagtctgggcatggtggctcacaccttcgatcccagcactttgggaggctgaggggggaggattgcatgagctcaggaattcaagcccagcctgagcaacatagtgagatcccatctctacaaaaactcaaaaaaattagctgggcatggtagcgcatgcctgtagtcccagctaatcaggaggctgaggtgcagtgatcacttgagcctgggaagtcaaggctgcagtgagctgagatcacgtcaccgcactccagcctgggtgacggagtcagaccctgtctcaaaaataaagaaaagaaaaagttatgtgagtgctgataattattaagataattcagtaaggttctaactgaaaactttctgttctccatatttgtgaaacatggggaagagtttattttaaagctctaatttgaaacaaatttgctgaagcaattgagcattcaaatattggggaataaaacagatgcaaagatctctcaaaaaaactgctgacgtccctcacactgagttagcttgaggttctctcgccctcgctggcaccccagggtctgcgtttgctctttcacttagaatcaattttccatatttccttttcactcatggccccatcagagcaccttgtaaacttacggttttggctttttgcatcctcaataagagctcaggtagaagtggtcgggctgtgggtagctctgcctccagtcatctctggctaaagagacacccttcattaggttggcagcactttggagccccactatttctgggatctaagacaacttggttgtcttctacacagttattttgtcagtttctaatgcccttcacaacggctttggtgattgattattttattttattttattttattttttatttttgagacagggtctcactctgtcacccagactggagggcagtggcgtgatctcggctcacggcaacctccgcctcccaggctcaagtgattctcctgcctcagcctcccaagtaactgggattacaggtgcgtgccactaccactgggataatttttgtatttttagtagagacggggtttcaccatgttggccaggctggtcttgaactcctgacctcaaatgatccacccacctcagcctcccaaagtgccgtgattacaggcatgagccaccatgcctggctgattgattattttaaagatgaccttgttttccctcccttacccagcatctgctacagatgggcgatacacatagaggactttccagtgactgcttagtcattgtcaccaaaaacccatgtctcccagtgttcctgctcctgaggttccaaaaaggagttgtcctggataggggcacattaagaaatcccagagggttcagatctataggagctatgaaagggttcctccaactggatccggccagggagaaatcaatcactaacgcagggggaaaggtatgcagggacctttcgtcacttggtgctggagaaaggaagtgtgaagggtcggtaaaagccaaaagggaaatcatgaagggaaggataaagctttttactcccaagttaaaatcacactacagaaatccatccttcagacttttatgatcagttgctaaaaagtccaagacatttgagcctactccaaagtgcatttcttgcaggatattttgagggaattcattttgtaatgatgcggtgaacacagagcccagcccggtctgtctctgaatattgtacatagcacagcaacacacaaatagaaaattagcgaatgtcttgatgattaagatcatgtgacagggagacctcgtattctattaattcaagaagcacaattttctaagttaaagcccataacacaactcaagcatagtaaaactatatataattaagaataggctgggcattttgggaggccgaggtggacggatcacctgaggtcaggagtttaagaccagcctggccaacatgatgaaactccgtctctactaaaaatagaaaaattagctgggcatggtggcacacacctgtaattccagctgctcgagaggctgaggcagaagaatcacttgaacctgggaggcggaggtggcagtgagccgagatagccccactgcactccagcctgggcagcagagtgagactctgcctcaaaaacaaacaaaaatagaatatggggctaagcatggtggctcatgcctataatcccagcactttgggaggctaaagtgagaggattgcttgaggccaggatttcaagaccaacctgggcaagatagggagactccatctccacaaaaagaattaaaacaattatccaggcatggcatggtggtacacacctacagtctgagctacttgggaggccaaggtaggaggatcgcttgagctcagaagttcaaggctgcaatgagctatgattgcaatgattgcactactgcactccagcctgggtgacacagtaaggccccatctcaagaaagaaaggaagaaagagagggggagagagagagagacagagagagagaaaaagaaacaaagaaagaaacaaagaaacaaagaaagaaagaaagaaagaaaaagaaagagaaagaaagaaagaaagaaacaaacaaacaaacaaagaaggaaagaaagaaagaaggaaagagagagagagaaagaaagaaagaaaaattttaaaaagaatatcctgtagataagtagaatgtaaagcttatcttttaactatcgataggcagagcacttcttgaaataacctcatgtgttctgggagaatatacatcagaattcaaagtacgtccaaatttaacatttttaaaaatcaaagaatcctgcagtttggagggacacgtgagtgcctctcactcagccttctgtgatattaataatatacctgataaccgatcatccagccacgagctctctatttcataaggcgctctagcacggaacaagctcagtgtttggaaggtctgtttttatataacaaggtgagtaagataaccctggtctcttatctttaagacagactttgaggggttttccaaggagtaagcagtggccaacagcgctgagtcgtccctttgtctggctgacttctctcgttatcagttgcaaacatctcatggagttaaggcattaaaaagactgagaaataatctacatatccagtgtgtttggaaaacatatactgttattaaagtccaaagattaccttgagactctctaacagcaaaatcgcaaaaaaggaaaatgttttgggttatagaccaatgtaataaaaagcagaaagatgtagtaggtgagaggagagaaggagcccagggccagcagagtcgtagccattttgccaggaagtagctttaagggtttctggactgttaggcgagtagctggcctgaaaccagatctcagcgtgcaggggctgcttccgtaaattgcatcctttcagtcactgagaaaattactcactccaacttagaggagacaaaaaccatgcccagagttgttaggtcattaccaaatatgagaagtcaaagtgagaagccagggaactccaaactaaagtagctcccacatccttagctgtgtgcctactatacaattttttttttttttttttttttttgagacagagttttgctcttgttgcccaggctggagtgcagtggcgggatttcggctcactgcaacctctgcctcccggcttccagcaattctcctgcctcagcctcctgagtagctgggattacaggcgcccgccaccatgccaggctaatttttttatttttagtagagatggggtttcaccatgttggccaggctggtcttgaactcctgacctcaggtgatccaccacctcagcctcccaaagtgctgggattacaggcgtgagccaccgtgcccgggcacctactatataattaaccaaatgattacctgggctaaaacaaatttctgtgtaaatatcttaaaactgtattattatctcacagcgggagagatcagttttgtgacacaaaatactttgacattgtgaacgtgtcagattctgccatctgaaaggtggcctttttcagcccactgtgtggcttcagagatgtgggcagaacaggtggaatccaacttaggggatttgctctttctggtctcactgtcagttttcacagatcttaaagaagtggctgcattaactaagtcaatcaaagcctgctcccttttaaagcaaaatgaagccactgctcagccttcaacataaaaacctggattccactactgtaagattctgcccacaaggaaagagaagaccccggaaagcgctgcagtgctgtcagccttaaatggaagttgggagagctggaggaatgccacggaaagagctgcccagagctagaggccgaggcactgaaaaactctgccttctcctctagagtctcaggaggggccctgatccctgcccccatgcacaagtgagtgggaacccccccaaagacagccgctcttcatagaaaatgacagtcatacttcaaaattgtagagtgcctacaaaccgctcgaggttgcatctggacagaaggatcagaagttttaatttcataggcctggaacagggttctaaaataaaaactaataagacggttcatatctcatcatcatcattattattaataatagctatcattcacgcctgtaatcccagcactttgggaggccgaggtgggcggatcacgaggtcaagagatagagaccatcctggccaatgtggtaaaaccccgtttctactaaaaagacaaaaattagctgggtgtggtggcgcatgcctgtaatcccaactactcaggaggctgaggcaggagaatcgcttgaacccgggaggcagaggttgcagtgagccgagatcacgccactgcgctccagcctgggcgactgagcaggactccgtctcaaaaaaaaaaaaaaaaaaaaatgctatcatttacttagggcttacagtagccctggtatagcccttatttaatgctcacctcaaccttgtatgggctccattttcccccattctacacacaattaaactgaggcacggaaaggataagtaatgagtacaaggtcactgaggcagtaggtagcagagctgatatctctatttttaaaagtgatccaggtaccacagtttgaaaaacaaaggtcccaacaaatggcatcagacattgggcagcaaatactgctgcaggactttgtatatgtttctccttatttgtctttaggtgtttttcgtatgtaagacacaggcagtgcaggggaaccttactgttttctacagaatgagaggggtctgagtccccgtctctctgaagaaaccacttttgtgtcttttatttaactcatcatgtattgtctgaagagttttattaaaaaaaacaaaacagtctgatgatgcccagccctggagaggtgggagctcctttgccaggatctctgtgtcccgcagccgacctgccttggcatcctcatctcctgccacttcctgttttaccccatgtgcttgctggtccctgaattctcttccatctgtctttcctcatcctcctggccccagtggctccccagccatgcccagagaggttggcactccagctgaggctgcagctgggaggcccgtggaggccacagaatgtgttttccttctgtccttctgtcctagttatcacagtgaccaaaatttcaccaacctggaaaccaagcacatttacatctgctttgacttgatctgtcaaaccaatctgtcaagcacccacctcccaataacagggtccctggcatctctttcttcttccatccacacccaccccaagaagctatctctgctgctgacctcagaggaaagagagctgagaatctccacggtggatggcagatcctggctttctgtgtctctgccttctgttgctacctccccattttgctatcatagggcttggcaatagaatggagtctttgctggttgctatgtgtacacacatgccatggttcaaggagatacccactccctcctggctcactgtccaccaactgtgctcacgcttgggatcccaaggttccagctctttagctcacactcctgcaaagccacagttatgacacacacttcatgtgccagccccacttacaggccatgcccctattatcatgcaaataaaaatacaggatatgcagcaaatttcaaagactccattctattgctcagctatagtgccaacctctctgggcatggctggggagccactggggccaggaggatgaggaaagacagatggaagagaattcagggaccagcaagcacatggggtaaaacaggaagtggcaggagacgaggatgccaaggcaggtcggctgtgggacacagagatcgtggcaaaggagctcgcacctctccagatacgcaacaaataactttggtttgtgtactgattattacaaacttatactaaacacgatccaccattatctgatattccagtttcaccaaggggccctgtattttttcccttagttccccaaccctaaaccctgcctgccgcagggggccaggctccctcaaggagtgtttctcttctgcctctcaggatgctttccagactggactttagtggatcagatgtgttttagtgactttgaacctcactggggagggggtgaaggcctcatgctgtttctctcaaggaggcatttttcagcatttacccaccaagaccattgggagagaagtttctgacaacctacaaagaaccctgttaggacctatatgaaggcagtggcttctgtgatcttttttcatttatataagcaagaagggtggctggagcaatccctcccagctgggccactgggccgaaagcaacttcttccctccatccagacagaaacacagttggcggtcttcaaacgctggattttctccctaaagcacatcgccttactgaaaaactcactatacttcctttaaaacttcatgatctggggtctttcagataaaatgtcagtggttcgacaataatgaatggacaggtagctaagaacagcgtgctggggaagcgttccgcaggccatctgcctgcagcatgtagttcacaccctccatggagctgccctttggggaggtgaggggctgaaagcaagcgtgtgctcccttggccaaacccaaggaggggaagcgctgtcagctggccaagatgtgagccaacagggcacgtagaaggatatccctcccaatctactgcccccaagggagcccctcttttaattttgtgcctgctggcttggagtgatacattattcttggagaattgtccagcatagcgggaggaaggatgcagaaacaggggcaagtggttgaacctgaaaattcccagttttccttcattgcagcattgaatgaggggctgtaagtagccacaagagcaggtccccgtgtggttaaaggccctggcattcacttaacaggcgaatttccaggcaacattctcttactcagcacttttaatcaaaataatcagtccagtgtctgaggaggaatgaatagggcagtgtaggaatcccctgttgctaatgaaacatttaaaaatccaggacagtaatggcctgtgctatttaatacagaggagatgcttaccacagccccctcataccctgtttttttttcttatttgcaaaaggaaaaaaaatagaatttattcatcttaaaaaaatacgaagtgaaaaattatccattagcacagcaaagacctatttccaggaaacgagttttaaaaagaaaattcttgacatcctaaggttgaaagcgggaggtgtcatgactttgaacgtgaaggatgaaagggccactgtgtccaggtgcagttcagcctggcctcatttcatctgttacgggaggctgcttaaacccctggttgtggtccaaaaatatcctggcagttagcatcctgcattaaaatttataaaccacgaaagaccttttcttacagaaaagctaattcaggctggatagcctttttaaaaaaaagatttaaaaggggtagtcatcagaagaggttatatggaaaactagaggtaagtaatgcttttcagtcccccaaaacatactaaaaatacagcaacagtaatttcagaaggaagggaaatggtaccaagcataatttcgtttctaagaagtcccaggaatgaatcctggaactgctagaatgaacttttaggggtgacaaaaaaaatggttggaatattatcaggaaatgggaactgacaagaggatggaaacaggctgcaccttggtgtctcggctctggggctggataaggggccccagtttctctggactctaggtaggcaggtctgaaacctggtcactgagccatggctgctggaggtgcttctccctctgcctggccgcattccttcaccccatgctgagcctttgctgagcgcctcctatgtgccctggctttagtccctgctatccttcaggtgcagatgaaacttcacctgctcagagataccttccttaatccctacagattagataaaattcccctgctctggactcctatggcacctgctctggtcttaaccctgagcacacttttccactgctgaattctctctaaggttggtgggggaggggactgtttctttcattaatcattgtattcaacctcccttactcatccagcccacacccacccgttgggtgcttaatgaatactggtaaaatgaatcaatgctattttctgtgagtccagttttatatgcgtaggttatcttttattataaaaggacctggagatttggctccaaagttgacattttaaggagactggtgaggaagagcaagtggcagcaagtaggtgaccatggcatcattctttgagtagtggggaggccatccacaggcagtcagtctgaccatctccagggagcagagagtgcactccatttctgcacaaacttaagtgagagggaggaagcctaaacagacctggaaattgacctggaccagcctgctcatacacctgcaaaatgcacctggaggatcatagcctctaagacgtatgctggcctttggccagccttgttttcttcctgattcacgtaatcagacatgccagcttccacgaaatgataagcttctggagtgatggtaacaataccattaataatgattttagctaccttttagtgagtgctaaccttgagccaggcacagtccaagccttttatgcacagtatatatttacctgcacagcagcccagatgagaacaatggcgctaaccccatatttcaaatacccactcagcaagctgcagagatttacataggtccaacagctcatcgtgatgggcactggaaaccccatttctttggcctcttctatagatcctagtggatacctgagcactcaggaagcactcagtaaatcctctcaacttagccagagcagggtagaacaagtccttgtatttctgtttacagaagcttccacctgggtctacacatacagccacagagtcagcctgagtggatcctgggctgacagagtttatcggccagctctgcagtggccctaggaacatcacactgtgcctatcatgccaagtgacccccgagacccactggagctgagagagcctgaggagggtgtcagaccaacatcctgggtggttgctgtagtttcctctgatgccttaaaactgaaaatctagagggtttgcaggaacgaccaaagggactgcactgtgctttgtttctgctgggagtgaccctacatcacagagagtttgggcttcactccacctagccctggctgttccttccaaacattctttcactcacaaccttccttgaccctctgtccccatctgctcccttgatctatttgtggacgtgcttagagctaaataacactggagttggatttcattcaatttctcaagtcgattcaaggaaggttgactttattataactattcaggcagagaatggcccttctatctgctttcacacagaacaaaaatggtctcagctcttctttaaactgtcaaattatatccttcttctttttgaattatttataatctgttgtttttaccctgcaaaaatgggcttttgctacttcaaccacatattaggccttttatgcaaactgtaaaagaagccagccttctgtcagagaaaggcttctgacttcactaggtataagagaaccaaatttttatccccataaaatttttcccatttcagtcatagcacagctgatgcaaaggcagaagagttatggtggaaatggaaatacatgtgtaaaaactacagtccctacagttttctgtgaattcataatccccagagaccagcagacctcagaaaccaaccaagcaatgggaggagctagaaactcaatggtatcagccaaaatgagcatggagtgttcactcagaatgaggaaccaccgaggaggtgtgcgtcatcagcctcactcacagagaaggaagcctacgtggtcacaagactgagctgtaagagggaggggcaatgcgtagtcagcccagatagagctcaaatgttttaaaatttaatacgttttttattataaggtctaaccaatccctagcaatgacacaatatcactctctcagctctcagttggcacctcctggtagggtgagtttagaaggatgaaggaggaaagtgagaggatagcaatcaagtggattcccttcaacagcacgaaccacacttctcatgagacccctggagggttatccaaagcacagattcccaagcttcgcccgcggagacgctgctttggtggcactaggggaacctcgcaatctggatgctaacctagtaccccaggtgattcttatctacagtggttctcatccccgatacataaataataaatgtcagcgcatcccaaaacttgctcaaagtcaaggtcacttatctaacgtgagtgccaaagcccaaacggaccacagactccagacactagtgacctttccattcaaccctgggaacgtatgagccaaaaaacatgctaaaaccagcgacagtagaatgcaatggtattcagctgctccatgccacacgtactcatgtctgcaaacccttgctagcgggcacctgccagaagcaactctgttacaggatggaatctcacaggttgttcccctacccagcacatatgcggctttcgctaaaccatctgctgctttgctgacaaggacagaccaaggaatttccatgctgcggtctgtcagcgtctgtcacagggccaccaccctttgattgggcgaggaacttggaactgagacctgtcctccaggagaccaatgtgaccctcccagggcagagggagtgctgccacttcacacgtcctctcacccgggcttatctaactggccacaggacaagttctgtgttttgtcggcctgggaaatctaatggaaaggactattattagaaatatttatcttatcaaggaaaatatgctcttaaaatgttcaagaaaggatgctgcctggttcccaaggaatagcctgaaagactatatatatatataatatacactcatacacatatacatattatacacacacatacacatacatgtatatatgtgtgtgtatttaaatgtaatatgcatatgaatattacttaggtaagcatatattcacaactgcagtagtatgttacctttatttttctttcagcagttttttgaagtaaacttcatcatctgactgcaggggttaatgaatattctagtgcttctcacactctgatgtgcacatacatgagtcattcaggaaccctgatgatatgcagattcctattcagcaggttggatggggcccgagagcctgcatttgtagccagctcccagggaatgcttgaggcccaggcaggagccactctgagcaatcagattccagcttgtgatgatgtttgcatcacacataaaacagcacctgtcaaagcttagaatatgtaaaacaaacaaaactaagttcaaattaaggcactctttcttagatgattcagaaggaacttcagaatttgggcaatgcctcttagccatcattacaaacaattcttcccgtattagagccatttcagtaataacagacaagtcctgacatacaagaatcaggttgccttcttcttcataaagggacagaaagcacccagaactacaggtatttttctctcatttttgatactctgatctgaaggtaaatgaagaaagccagggcatgtcaggccactttgactgcttaaaattgattctgccagtctagaaatgattaaaattccaatcttggaagctcttgggaaaaatatacaaacgctatattattccaaatattctgctatatgaaggctggccctattcatcacattgtttaaatatttgaaataagtacattaatcattatcctcacttctaagacatcaaagacaaaattatgcctaaaatgtattggtaataactagtacacaattgagaatggacatgtctcatgtgaaggatacaaagaaatacagagaatgatccccatggggacggagctgcagcttttcaggaatggaggtccaaacccatgacatagtatttatcacacagggccccaaaactatgcacacacctggctcagcgtatgtagtcgatgcaaactggggaggtaaaattagaatcaactgtggtgggatttaaatctggccttgaaggatttcaaaaggcatagaagaggagagagaatgagagcaggtttggggagaaacaatgaagcggaacagaaattaaggttttggatcatgtctctaacagacaaattgctaatttaatcctcccaataatcctgcaaggttggcattattacaccaatttggtgaaccaagaactgaaactcagaaaagctaaatgactgaggtcacacagccggtaggtggtctccaaggggatttgaatttgggcctgtttgatatcaaagtccatcatcagtccaccctaaaccagcacgccccaaagcacatctcatagctccctaaaatgttaataatgagtcaggaaaaagaaaaggtcagaagtcaaataaattttgaaagctctcaggataaataataatactgttacagatataagttaacatttattacatgcttcccgtgtgcttgctttaaaatatttgttattattgctgttgctgttgttgtttttgagatggagtctcgctctgtcacccaggctgcagcgcaatggcgcgatctcggctcactgcaacctccgcctcccaggttcaagcaaatcacctgcctcggcctcccaagtagctgggactacaggcacctgccaccacacccagctaattttttaacagaaacctctcagggcctttaacactctaacctgcattgaaaatctctaatattatgtgttggaataatattaaaaatctcacataagagaatattgatcatgcaaaaacataatactgaaatagataatgggaagtagactctgatgggtttcaatgataagtcattatgttatggtgaactagcttcagagctagactgtatgcctggtggctttccattcttcctgacatccccagctaatttcatttaaaaatacactctaacagactgtggcaattctcaggggaaaaggacagaaactggaaggtggaaacacagcttctgctgtggtatctaacagctaggtaagtcaggtctggtggtttggcatttgacatattaagacacaaaggttctggacaagacaccaaaggaatctctcctgccccttttgttagtaactgctgtaatttcctaatttataaatctttgtacactgtctgcatcaggtgtaaagtagccatccatcacctggctctcatgacatactgagttgcgttcctccaataaaatagtctctgccttctctcatgttctacgaagcctatgttgctaagttcttatgcacatcaaataatacacctgtaatcccagcactttgggaggccgaggtgggcagatcacgaggtcaagagatcgagaccatcctggccaacatggtgaaaccccatctctaccagaaatacaaaaactagctgcgcgtggtggcgcccgcctgtagtcccagctactcgggaggcaaaggcaggagaatcgcttgaacccgggaggcggaggttgcagtgagccgagatcgtgccaccgcactccagcctggcgacagagcgagacgccatctcagaaaataacaaaaaataacaataaaacgatcctaccattatgccttgcttaatgcttttgattttccaaggcattttcacacctgtgaccttggtagtacatgggcatcttattcttgctggactggatgaagttccattctccttcttcagtctctgatggtaactcatctgttcacatccttagaggacagttggggtggggaggaacgaacacattctgcagtcataccagtaggaatgaaaaggagagatgtaagatacatttcaagaaatcatgtgcagaatttggtatctgacagaatatgacagggagggagggggagtccatagctccaggcaatgtggcatcaagatgctaggatcccaggccagtgcctgagaaacctgacagcatcacccacagaaagaaattaagtgtggaaagacatgaaagaagaaaatgtccttcaggaaactagatctgtaggactctgagcaggaaagatattgggtcacagacaatatgccctataaattactagaatggtagatggtgtaaagtttagctacattagtagtaagagtgtattgttttgttcatgtagcttttttttttttctctaagccaagcagtgtgttaactgctttatacaacaactctgctgggggtggggtgccgggggcgggtggggggggggtggtcaatgttattaaccccagatgaggaaatacttgagagaggctaaataatatccttgatgtcatagaagtagcaagaggcagaaacgaaattccagctggtggtcttatgtgaaactagattgcacagtaagaatgtgtcacattataacttctcattattaggcaaaacatgtgagtaggcaaccctgcaaaactagcaagtgggtgacactataaaaagctaaacaggataaattttggattacccaccttcctgatctatctttagtgaaatgtcagttccactctgtagtcaagacttatgactaacagagtactgagcataggaaacatcttaatacattgtttaatgaaacaaagtattttagagcatgctggcaaactgcatttagtttataatcttccagccttattctatatgcatgagggaatcattagttccagtgtagtctttcctagcagcttctgtgtctacgaacagagagctgagagtggcctgacattcgttccaacaattaggattagcttaaaatgctgggacttcactgcattgccgcagtaacttttgcagcttttccccactggaggtcactgtcaccttgcagttgcagagaagaacctcaatttgtggtggtaaagaaagtggacgttttcatctatctaggctggctgtagttgcttaaagaaatcaaccaaccaaccaaagcaacaatcattaaaacatacttcagatcatgtggcaaaaaactgtccttagaaaattcatcactgatagcgcttgttttcaaataatgtttcatcttgacactttttaatttttaggttactataacagtagatacatgttattatatatttgtccaaacccacagaatgtgcagcaacaagagtgaaccctaatgtgaaccatggactctgagtgataatgatatgttaatgtaagtttatccattgtaaaatatgtcccactctattgggattgttaatagttgataaatattttgaattcagttaaaatttctacaaagagacccaagcacctgtttcatatgttgggcaagcgaatgcattcaaagatcagatggtatatagcttcataactttgagccaattcctgacctcactaagcctcagtttgctcacctaaaaggtagagataagaattctaccaacttcggccaggcacagtggctcacacctggaatcccaacactttgggaggccaaggcaggcagatcactactggagagcctgaccagaaccaacacagtgtcttttgtgcagtggtggctcagtaatgatttgctgagtaaattaatacagaatctaggcataaatatttaaaggaaagctgagacactaaggaatcttgggtgagtccatctgacttttcccggactttcagtttctcttcagagaagggtttgaatgagctgacccccgaagttcctacgcattaaggtccctaatctttgagttacaacctgtgggtcagagcacagccttcagtgtcccattcactatggaaacgccatgacaacctgtgtgcatctgaaaccccaagtggaggcagccatgagtcatggattatgtttatactggtatccaattgagcacatagcatactatcaccctcaatggactggcaaatcagatacttttccccattaaaaatggcaaatgaggttttaaaaaatcattacaattaatacaaaatgccaggaggcactgtacaggttgtatctccatatttaagaagacctagggcctaaatatacttaagcacataagagaaatgtactgatagcagtactaacatacagcattttacattttacaaagaactttcacacatgcatggtactttatttggccctaagagcaaccctgtgcagtagagggggctgcagaaactgacctgcatatactgttgtgtaaagaacttaaagaactccactgggagggcagggccaggactggaagctgcatctcctgaccccagtgattcagcttgaacaggatgtttaactgtgaagcacgaagttgggtatagcaggacaatccttcatggtggcatagagtgcaagctaggtgcccaccatggggttcaaagcccagctcttttgcatgtgggttttgggcaggtcagtgagccttcctgggtctccactgtaaagtggaggaaatagtacctacctcatggctgacagtgagactttaaaggcatcagaataggtgcacctctccttgtcctccgcgcatgctctcccccacctctgctccagccagtactgtggcaaccagctccatagaggtctagtctgaaagtgcttcacctcaggccactgcattacgccttcttcccagggttctctggcattgctgcgggaccttcttgggaactggcatttatgcatatgcaactgaaaatgccagggggatagtcactccacaagacccccgatggtggagatggcgcccggggaatcagtgccaattgcctgcttcagtcctatgggcaggtggctctgaggtcatcctgtctgaagtagccagtttggcaactcaaccttgttggggcttctttccttccctgtttcatactcctccagcccccacacctattccctggagtcagttcacaaaacaagccaccctcacgcatgcttgggctctgctttctggtaggaactcaggaatgacatcgtagagacatggtgctgggcacataagaaatcctacataaactttacctgttcctcattttctatactaaacgctgcctacgatcagtcttctccatgtctgctctcttgaaggaagtggactttgttgttgtcaccatgtggtgggcagaaaatgacaaataagtgaaagggccaaataccacagggcaaagacctggaatagcttcctgagtcggatgtccagagactgactttgggccacttcattgcaagagactttaggtggttttagatcatacagtaacaaaccgtttttaaaacttatgtgtgtgttactgtgcattagaaatctataaataaaacatcaaaaccatgatttcactttatttttgctttggctaaaaatgttttaaatgactcatatgaaaaatattaataggaataaagatagcatgtaaatatagcaaaaatcatgatagtggtgtgtgaaaaaaagatctgggaaactaatagataaatgtgccttttataaccattatgttttaggtaagtggataggatcgtagtttgggcatctatatttaggaattttgttatcaagtatgctaaccattctcttacttaggtacacagacttgatttgccacatttgtatttttgacgacgttgttctaactttcagggagagcaaataaaggtctttttctcatattaaaacaacagaaatggcataaaactatcataattttaattactctaagaagctgaaacaacatacacataagttgactcatctgtgcatttggtcaaggacactcagaatttacatgggcaggtacctatacacagtacattggaaaacctttttactgctctctgtcttgaatggatatagagcacattcatatcataaataggattcactgatacctctagaaaagacagttcttaaaactgctgtgcttgtagatatttcaaagacaatagtttgctcacatttctaaatattcattagcaataagaaaagctatgaggacatgttgtacactctaatttaggagagattttcttcatggctaaaaagttgcaaaaacattctgaaatatacatccacaatactcctaattaactcacacaacttgttggccttttcactgggaaatgctctgagggctacaatctcatagcttgagtgagtaacacattcttttccacatggaagatgaaagcccttagtatttcccataggagaaatgtagtcctcttggcatctcccacaggagatacgataaacagcgaaaaatgattaacacttgggcaacagtgactgcctaaaaacacagacttaactatgatgttaggtcagacctaaagagaattataatgttttatgattgcttacttaaaaaaaaaactcttcctttcttccatctctttcactttgtcctcaactaagacagatcagatgattgacaagccattccaagattgggcaattcctcttcatatgaacttgatgctccagaaatatttgctgtggaaaggtccccgggaaaggcgcaggccatgcggaaaggctgactcctagagctctccgacttctgaacaccaacaagatgccgagttggtggcttcttgttgaataagaataaataaggcatttgacccagccatcccattactgggtatatacccaaaggattataaatcatgctgctataaagacacatgcacacgtatgtttactgtggcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcgcaaggacaaaaaaccgaacaccgcatgttctcactcatagatgggaattgaacaatgagaacacgtggacacaggaaggggaacatcacactctggggactgttgtggggtggggggaggggggagggatagcattaggagatatacctaatgctaaatgacgagttaatgggtgcagcacaccagcatggcacatgtatacatatgtaacaaacctgcacattgtgcacatgtaccctaaaacttaaagtataataataaaaataaataaataaggcatttatacacaggtgtagggatagattgtctaactcccctagagaaatttttttaactgcatgcattgtcaatggggcaatagcaccccaaaggaatgaaaattggttcttctgggggcatgtgaagaaaatcttactctttttacgtataaagcacagaggtacaaacaatgcatcaacagctatgcagtatacatgtggtattaaaatttaatgggaggagtcaactaaggggaaaaaaccctaaaaagtctaggagggggtggatgataatgaaaacaaggctgagaaacaccgccataaacccaccttcagacaggaacaatgattcagactgttttccatagtgctttctaaactgttgtatattgttttaaaaataatttatcatatgctaattgataagagagtcaaatatgtgcaaagagctgtcttccccaaaatgaataccctctcttgaaaagtgctaaaattcttagaataggaattatttgtcttcttccagaattctgctacgcttctgactgaattccattcctggaatagctatggtgttacatgaaatgcattatcaggcgacagctcaaaggagaaagcagagaaggctatgctcagaagggctgatcactgcaggtgctgtgtttgcaatcgatttcttagtaagagtagaagcacttttgcttctgttttattttcttttcataagtcatataagaagtaggagaaggaagagatacggacattatttttagctctcacaaacaaaaacagatcactaactttaatatgcacagggaatccctgcccgtgaggttccccaaaagttggtgcaagtgtttgaaatgtgccacatgccactattattacctcaactgcccctaagaccagggccctgggcaaagattcagccagggcatgcattccatttactttggcaagcgtcactcccaggttggaaacattcgaacaaaatgaatctgtcttagataaaggtgattttactacctgcacgtcctcaagagcaggagtctgccagtggcctccccgggtcatcacgaaccggatcaagcaccagagaactgaagacgagagaaggcacacgctacctacaacccagacgtcttttcttctgagtgtgaagtccattctttgggagcagctgtggatgttgcttggcttatatgttccttccctgccctgatctagcaccagcacttctcaagcagtgtcaccctttgctctgccctgaggagtgggtgtcaccgaattacagagggttcttgcagagtcctgcactggacgtctccagttacgtgatcagcaaataatctgcctctttaaaaggaaaaatacgatggccttgtgtgacagatctgaaacaggtgtaggggcattgggagactgctggcaataatttacgacgctgtgaatgcgtatttgttcccagttcaaggacaattagcaccactgtatctggcaactgctggctgccgaggctgggccactgccagggagctttctcctgcccttacagggtgaggagcacagggatggaggtggcgaaatgcaacttgaaaaatcacaaaacctctgccctcagccttgttattttgagatctaagttatagtcattacggatggtgctgatggtacaatttcacagcagatggtcaggaaatgccacctggtgttaaatccaccaactgcaatcaaaataggaaaatccacactttactccaacccactgtccctctgcacatcctgttaataaatattttgctttgcttggtcttgggagcatttgtaccgggcatttaaacactccagggacagtggggtcccgagtctgctggggccatgcttgtttctacccccacagctttgggataccccctggttgggatatggaagaacttaagccaggttttaaaaaggaattattccctatgaaggaaggctttcaaacacaaatcaacaagggttaggataaattcagaaatgatttgcttaggggtcttccaggcgcggatgtggaacggtgggctatgctgacatatttttgtagagtgagcattcacaacctgtgtcctacttttatacttgggaccatgccttttggatggaggatgagtaactaggggtgaacaggcaggtggggaaaaccaacggaggaggaggagagcacagacaaccccgggcctcaggagcagggatgggggtggtacaccgaggaaagcagtgagaagcacgcagggccgaatggttggctgagaatatcaccaggcacatttgtgtttcattaagcaaaggggtgtgggggtgtatatgagacagagatcctactaaatattcaagtaaatctgggggaaatacaacacgagggctatttactatatagataacagagaactgacaaaagaaaaaaaacccagattcaactgtacaaaaataatactaattatagttatgaaacctgttcatcatttataacttaatggtatggacacagtagctatcgagctcatcactcatatgagtcagaccaatttggtcttgtaaattttacttgatttcaacaccacaccgtgtacgtatgtttagatctagtttattatggcatatggttatctgctgaaaacttttaaaattttacacagtaggtagaatttaggtgattttgaacagcctttggaacataatagaataagaaaagtcattagaaaacagaataaaaaggaaagtaggaaaaataggccacacacagcagctcatgcctgtaattccagcactctgggaggccaaggtgggaggatcacttcagcacaggagttcaagaccagtctgagcaacacatggagacccctgtctctacaaaaaaatacagaaagtagccatgggtggtggtgcatgcctagtcccagctacttgggaggctgaggcaggagaatcacttgagccagggaggtcaaagctgcagtgagctgagatcacaccactgcaatccagcctgggcgacagagtgagaagctgtctcaaaaaaaaaaaaagaaacaaacaaacaagaaaaattaaaagaacaaggccgggcacggtggctcacgcctgtaatctcagcactttgggaggccaaggcaggtggatcatgaggtcaggagtttgagaccagcctgaccaatgtggtgaaaccccgtctctactaaaaatacaaaaaaaaatataaaaaaaaatgagtcaggcgtggttgcgtgcgcctgtaatcccggctactcaggaggctaaggcaggagaattgcttcaacctgggagacggaggttgcagtgagctgagatcgcaccactgcactccagcctgggtgacagagcaagactccgtctcaaaaaaagaaaaaaagaaaaaaagaaagaaagaaaaattaaaagaacaagaactacttaagtagaaggaagaaaagaaggctatgaagtgtttcataaactcagtaaaacatagaggaaagaaggaagatggctaaaaatgaattcagtagaagaaaaataaaagaaatagaaaaatctgattaagagcaggaaaacaaaaagaatctgagttttatcaaactattttaacaaatataagttgttaaatctatataaaattcttcccctattgggactggagagtagttccagactctaaagaaactgcactgcaagcttccagaacaaagctttcatgtcaccagagtctgaaattcagagtacattctttccagtgcaccacaggggatgtttctactatgattagccgtgctaatcccctcaaagagagaagggatgagagagaaaggggaataggtggagaaaatcgacaagcatgtttttatagtccctggagagaaaagcgtggcattttaaagatttactgctgccccagcagaagatgaagacgtgttaatctagctctgtctgcatacctgaagacatctgagctgctggaatgtccttctccacccacccgctgccaagcctgctggctgccctggcacccaccaactaggcaggcaggggctccaggccatggaaaggagaactctgtgcctctgacacatgcacctatccattctccacgtggacggagagagacagggaaatttattgcagacatctctaggcccttctccatttacaagtaagaaattgaatgggacacatggagctcctagtgattccttcccaccttccacagggtgtcaactgcaggacggaagccaggaggcccaagttacagaagggatatgagacttactataaaggacattctctgatggtttctaggggttaaatagcagtctcaatttttccctcaaaaacaccctaaaaatatttaacttccaaatcatcaacttctggatgtagttggctgcacaaaagtaacatccctacatatatttatgttccaacttagcactatcgcactctttttttttatcttcagaaacagggtcttcctctgttgcccacgctggagtgcagtggtgtgatcatagctcactgcatccttgaactcccgggctcaagcaatcctcctgcctcagcctcccaagtagctgggactacagatgtgtgccaccatgcccgctattttatttgtatttttttatttttgtagaaatagacatctcaccatgtcacctgggctggtctcaaactcctggcctccagtgattctcttgccccagcctcccaaagtgctgggattacaggtatgagccatgtgtcctgcttatctcactctttagagtgttgcccatttataaaaattgtatcatagattttggagaaaaacagtacttgaaagataatgaaattcatataaactattacagttagttgatgatttcaaagttctccaagaagaatattttgtcttctctgtcctaccgaaattaataaacagaaaaaattatcctgtttgtaccactgaaaaccctaatgagaaagtcatgtctcacttaattttgcctgtagatatttctccttggtctatattgaactcatggggaaagcagaggtctcaaaaaaatgtttcaatctgattcatttattctctccagcacattttgtcatttcttattcacttacaataaaaagcctcctagaccttttatatacaatctctctatttcattgtctattgcattgttagaaacgcccttcctacctgaatagtgttttttagaacagtagctgggcaaagaaggatgttttccaaacctgcctgataagaatcacttgctctgattatcaaaaataatggttcccagccctcaaccagaattcacttaaatagatctgtgcattccaaaaacacttttggtgcctatttgtttccgttactaggaaagcaactgaggaaacatgaacaaataacacgaggtttcccaaccttaaggagccttgtctagagaaaggtgatcaacatgttcaaaaccaccacatgtgctggaatgaaggcacgggcaaaatgcttgatgctcccaccgggcaaggagccaacggatgatgggcaggaactgactgggccaaggcaggggaggtaattgctgctgccgctaacacatattaaatgctgactctagtgacagatactaggcggagtgctttacagacgtgatcacacttaattttcacaattgctattatctcactaattcagatgtggcaagcccttggttaaattaatatttttcccaagaacgagcagctggaatggggctcagaactctcgttctgcacagaggagggtacaagccccaccgtcgtgccatcagcaagtctttcttgtcccttctctggacttcactatcaacagctctgctgtctaccgcgtgaggaactcaagatctgaaggaaaaaggagaaacttctttctgcagaacagtgtgcctctcagagcccttttctgaatttcaagcccaaatccatcatgctaaaggattcttcttcatttctgcaagctggctgtataactcctaagccactaactaaaagtgaagtcgactgctggcagaaatgcagtttcaaaggcctcctaattatttaccaaacacaattgtatagtcgacacacacaattctcactgaagcaaagtggaatgatgcctattcataaactttccttaattgtactcacaagcggctccatgacattagaaaagataagatagaatgaatactttttaggagactaaattagaacatgattacctcattatgtccagatcttgaatcctggtccccagaatttttttccagaaaacacttcactttctccacctcttccctgcactgaaaaaaggccattttctccagctggttgctgttataacacgtgttgaattcttccagcctcttcacttttaacatcttagtagtgagtccgattaagctactttctggagtgtggttttcgtctccctctgtctccgatttataaatcaggacacaattatgactcttcagtgcttctttctcttgactgcaaagaaaggaaacacaaaaagttctcatcacgtattcatgcatttgacttcttgagaaaatgaccagtgagaatttggaagtcccttctgtttaaactggagagaggatccaaaatcaggaaaagaaatactaacattcatattgagtttccaacattggaactttaaaaggaaaaaaaattttttcactttaaaactacaaaagcaaacagtaagaagcaatgtcaagattcactggtgatgaaatatgctccttattgcacaaaacaagccgtagatcaagtggccagcttggatgtaaattataaagtatctttgggtttaattggaaccgcaggttttgcagccccgtgggaagggcttatcacagaaggggtctctctgcttcccctggcctccctctgcagagggatcgctcccgaatgagtccttttccagaactcttctctacctatgccttaaaatgtgtggtgtttatttgtgaaaagaaatttatttccttacagtcttctcacgtggacagcactcccagatacctttccttgcatctgcattaacagctatgtaccgagaagttcagagtcttttcactctccttaaaatactttcctcgcaaatgaagtaatgcagcatacataattcgctttgatactagagacatatacgcatgtctatatgtacacatcacttgattgcatagagaggcagggagagggagagacatttgaatttgtgctagttccgcatggctgacaactgaggccccctggtggagattttccgaaaagcgcctcttcgagcattttctccgcttaaaaaccgtattgtgattctcatcagaaaacttaatattttgttttgtcagttcctatagtaaaatgatactcttgagttccaaagtgtttaaaattcactgctctaacaaattatacttatccacataaagagcttacattcaaacaaataaaaatgcaaatattaatactatcaaccagagctctacagatatattacagatcattcttagcattctttcaaattgccctgaaaaaattattaaaataaggaaacaaatgcatggctatttctaaggcaaactacgactaaaatactatggttaattgcagatgaaactcaagttggatcaggaagccacacaaaattaatgtattaaaacaaaagcttaggattaagatacaataattttgcaaagaaatattaaacattaagctctacctgaagtttggtacaatttgttattgaaggtaacttagaaaaaaggggaggagatttgagaggttataacaataaacaaagataattaccattgataggatcacatcgaagagcttgagccactccaagtctagagcatacattccagaagataaagagaaattttgcagaattcaaactgactatgaaagtctctggtaaaagttttgactctcagtcgtataaatcttctgaaaagacaagtgtccactacgagaggaagtatcttctctct

SEQ ID NO: 347 - DNA, 906113 bp, Homo sapiens
atatgcgagcgcagcacccggcgctgccgagccacctcccccgccgcccgctagcaagtttggcggctccaagccaggcgcgcctcaggatccaggctcatttgcttccacctagcttcggtgccccctgctaggcggggaccctcgagagcgatgccgatggatttgattttagttgtgtggttctgtgtgtgcactgccaggacaggtaagcatgactgtggcggttagagggatccgggaaatgggggtgcccacagaccacggcggcgtggggagacctggagccgagctttgcgctggtctggggaacggcggtagcgtggaccggttcctgggatctctttgccctgctcggagtgacagggtgaaaatagggactcacgggcttgaagatgtccccgttgagtgccccttctcaggggacccggcctcaggggcgcaggagtgaggggcgcggccgagtaggcgcaccctcttgctgctagtaaccggctttccgtcccagggagtcgaaacccgcagcagggcgggcccgcgtgccccgagttcccgaacttgtaaggtgctgtggaaaccactctcgccgacccccgccaggctgggaaggggtagctgcgggagtcgcacccgcagagggagcgcttccggctggcgggcgcggccggggcccgggagggcgcggtgcggcgagggcagagagctgcgggagaaccctgggatcccgcgatctcctcctgtgccttcctgactacccaggagaactccaggagtattctcctccgcctgtctttgctcccaagggctgggcgaacaattatctgagggaaatagagcagtggagacaatctggggaaattttctcaagctcaaaccagttttctcttgccataatcgcagggttccgtgtggggaggggggagcaaggatgacgcttgattgtctgaagtccccacttcgttctgcctccggagacgcagttgtgaggactctcagcgcatcttcttccttctgcttccaccggctcccttgcccaaaagtcccctggggttcggagactggcttgcagccgccttcttcaaagagctagtagtagatgcggggagactggggtgaggtgaggtggggtgagatgtaggaaattggcaaaaatagggcctgtcaactggggggagtgtcggaggtttgcaatcctacccagccatcctccgtacgcgctgcaccccagaatctgtgtggtcattccctttccctttattctcccccctttaccatccttatttccttctttagaggcgtggccttctctctaggccaaagagcaagttcatctggagagggctaagaaggggcgtctgcacttggttggctcaaaagttccctccgcttgcgcccaggcgcccctctttggcagttagcccgctggaagatctagcgtctaggagctttcagagggcccttcccacttccccaggactgagcaggcagcggctttcgtctggttaagaatgttgaatatggatttctcaagggacaaaagaaacctcccattccgttccttacctctatccgagcttcccaggctgcggagacgccaaggctcagtctagcttagaatagttgcttcttgagttcaggcccatccggatgggttagtcttttaaaaccaggacacgctgaaggagtgcgcgcaccccaggaagatcaggacaggcaagactagtgcagagcgtgggctactggctctgagcgcgagagtctggtgctcgtggacatcttacagaggaaccgcagacaggaagaagctaggtagggagggggcaacccgttagtgagttcacatccctaagtgcacatcactacggaatatgcctaaatcctttgttctcattactcctttgaaaagtcgccaaagtacccttatcacggaatggaacgtgtttcagggttcattgcttgtggaaggggtctttaagaacaggtattttccctctttccacttccaatcccctttaaatcttgtaaaaatttcgttgtaggggaagattcattcatgtctttactcattcaacaaacgatgtcttgctgggtgccaggatttcttatgcaaagaggaaatgacagtccttgacttctaggaacttaaagctcagctgggaatctagatagaaactggcaggcattttaattttacagattgatggggggggtggtggagaggtaggagtataagtttgtattaaggaaatgtggaggagagacagtttgaattaattctagggaggagtggtggtcagggatttgagagatgtaccttcaaggctttctagggagttttccaggtggacaaagtgggaaggcattcttggcagagggagcagattcagcaaaggcagggaagcatggaaggatctgacccactggttgtggctgttgcctagggagcttgggttctcaatgtcacttggcactatttgaacactagaggccgcatatttcttctacacacattatcggaagaatcagagagacgggggaattacctctcaatttgtacacttaaagtatcttgtagcttgagagggtataagcggtagctttctggaggcagccctctgattctgtgcagaaatcatttccacatcatccatccaccctcttcttaggtaacaaaggctggcttgtgattatcagcatccaaacagctgcgttgaaagtttctttgtcaagtgggacaattgttgtctgggctgttaacagtcctagatgaaataaacatgtggttcacttagtgagctgctcagatatcaccggcttttaatggaactgagtagatgatatcaggcacattttaattaaagcaagactgcagtgcagacacagttgcatatgaaaagatctaatgataggtgtcatgaggagctgcttaaatctgccttgttcagagaacttgttttagagtgcaaagtggagtcaagacgggaggtgccattctccagttcttgttatttctggttgagaaataattcagagattttcaggtacatcactaataatgaaaatttagaaggctacaataatagcagtaataacacactatctctatgagttttcaccaatgctttggcagtgtgaataattgaaaactcaataattattcccacattgctttccagtttgttttggtcaccagggcagagggtgaagggagtacctacacctgcaaagcccctactgaccaagtgaatgtcttttgctgccacctgctggaaaggagagaatttttttttttttttttgagatggagttttgctcttgttgcccaggctggagtgcagcgacatgatctcggctcaccacaacctctgcctcctgggtttaagtgattctcctgcctcagcccccccccccccccccgagtagctgggattacaggcatgcaccaccacgcctagctaattttgtatttttagtagagatggagtttcttcatattggtcaggctggtctcgaactcctgacctcaggtgatctgcccgcctcggcttcccaaagtgctgagattacaggtgtgagccactgcgcctggccaagagattttcttttggaaggaactctcaggtggatcattaattatgaattgaataatggaactgtgaacatgagcccccagcctccaaggatcatggaaaatactggccagcttggaacaggcatagagcatattcttcaagaaaattgcttttggggtattaaggaccttcgtaggtgcccaggggcccaaacctgattaagtggttgtgaaattctgtggttaaatgagctcttggagcatttttttagtctgcatggtccagaggaaaacagcttccaccatggacaatgagcaggagtaaatttaaagtcagccagacccaggaggatttgctggaaagcctatgtctgggaccccaaaggtgaactgagtgggctgtgggcccgagcattccctgggtgggggtgaggagcagccaatagcagcagtagcagcaggtatctttgttagggtggagtttctgaatcctagtcaggcctcaagtgcctctgtgacattgacatgctgccttccaggtttttaaaatatttcttccccaggagcttttcatcttgcttaattgtaattcccaattttagccatttgtagagccgttatgtccaaagtagagaactttaattgagtttcctaggaaagggcaggagctccatgcttggacaagaagcagaaacaatacattttttttttttatgagaccacactcacactacataaggttcaagacagcccatgtcaatgctgccttattaataggttttctgattccctaggcagtatgcaaaatgctatcctttatacatcctgctatgggcacgaggcattttcatcctggtggggaccaattaaaggcagagaagaaaactatccagaagcctaattgatttctctttttttggctctgtttttatgaggtgttttcataataaaagcaatacacttatcttaaagccagagaagctccttcacttttgagttgcgggcagggagttggggagcgaatatacatgtcatatatggattttactagcaaacccagcgtgagaggcccttctaagtcacttgggcatggataagggctgggaggaaaggggccatctgtaccttttttatgattccagtggaattgaggaccagggagctggagtggtctggagaactggtcttattaaagacagatgaaacaacccccagctgggcaccacctatgtgccagatggagctgttgaagtgtgaatatagtttccccgagtcctcatgagtctggtgtaacaggtaccagtatctttttacacacggtaacccaaaacatgaaatttcctacagcagaagatatgaagccacccgtgttatcgctgatatggagaactagagttctgaagtctctgcttcagcaatcccttcagggaggcaggtattaacgttcctattttatggatgaggaaactgaggcttgataaatgaatgcttttcttaagggcacagggttagtagagggaagagactggactgaaactggatctcagtttagtgttgtttccacaatactttctggattgagggcactgtgttctcatttgggggtggggattcaaggataccattggggtgttctgctagttctacagagtttgtttgggtggttgaagccttgcccaattaattgcagggctcttagtctgggagatttgagcgtcttaaggatgccatcgtagaaggtctttagtccctgcatcggtcaatattgtcataataattttgtataacaaataaccccaaactcagtggcttaaagcaaaccattgattttggttcacatatctgtaaattgtgtttggggttggcttatctaggctgcatttggctgggcttggtttcaaactcaggtaggctgcccgctccacatgtctaggtctccttggaccagtggaccagccgggacatgttcttatcatgatgtggaagtagacgagaacaaaccccactgcacaagcatattcaagtcgctgcctgaataatgttactaacatcccaatggccaaaacaagttacatggcttgcctcaaaatcaagagatggggaggtttactcccattgtagtggaaggaactgcaaagccactcagtaaaggctgtggatatgagaggggtaaagatttaaggccaatgttcagtcaaccactgtccttttggaaagtttcctgggcttgcatgtcatccgtcatctcatactatccccagatatgcatattgctcagagttcattgcacccaaagtattgatcatgcatcaactcattagataatcaggtcttaagttgagagcctgcctgccatctgtccaggcctgtgaaaggcacttgggcgacaggggtgcttccttcttcttgcgtctggtgaagggcacgttccccagaccacattccaaattcctggccagagaaacaccaacttggaggtcccctgaaatttaatttctgcccttaagcataaaccttagaaccctccaattatatctcagaattagaataacatccaagctccttttgggtcacagggcttatatgatctggcccttctctctctcccactttggcctctcttcttttttcttttcttttctttttttttgatacagagtttcactctggcacccaggctggagtgcagtggtgctgcaggatctgcttcctgggtgcaggtgatcctcctaattaactgggaccataggtgtacgccaccatgcccggctaattttttgatctttttgtagagacatggtctccctatgttgcccaggctggcctcaaactcctgagctcaaacagtcctcctgcctcagcctcccaaagtgttagaattacaggtgtgagccaccgtgcctgggtggcctcattttctacttctctacccctggcccattcagtttctgccatgctagccttttttctgttcttaggacactcccagtttgttcctcgtttgcatgcacccttctctgcatgtggaaagcttcctcccatcttgccttttctagtcattcaagtttcagcttgaaagaaacttttcaacccccctttctaaagtaggacccccccatccaagttgctttctatcccattactctattttcttcatggtgtttattgccatctcagattatcttattcatttgtttattttttgccctcccccaacctaacccacaggaatgcgagctccatgtgtgtgctatatagtaagcactcagtaatacctgttgaaaaaattatgaaatgaatgaatgcagagtgaatggaaggaagacatctttgggtcaactggaaggggaaaacttaaatcttcagttcaggggacaaggggaagtctgatagaaactgagaaggcagttatagacattttgtctgccttggcaataaccggtttcagctctaaagaggccttcctgaccaaccgtctgttgacagaagcctagcaggtcctgtttcctaacaggaaaagagtaaggaaagagtagatttccttctccaaggctgtaggaccaggggttaaggtgggaggacaggtgaggtggtgatagcttatgatgtcccggtgaacattcacgcagtgggtacaagccctccaaatcttgtctcagtgactgcattaccatcagatgagagttgacagctgttgctgattaaaacatttccaacagcacagtcaaaattgcactattgagatggtatgtgtagatagacacagcctttatgaatggcttaaacatagccccttagagtgatcactagccttattaatacatatagttggaaatcactttgcaatcatgaatgaatcattgctcagagcaccccatgggtgagaggcatctttagggatttgtctttctcaaacaagggaagaggaggctcacggctgtatttctctgcattaaggttctctaaaaagagttatcagggtatctggctttccatccaggaatccccttggatggaaatatatatccattattccagggattctccttcctggccagtccctctgccacccttcttcaacagggacagggtccttttccacttttttcctccttaacacaggtgattgtgactgattaattagggaacactttgtggaggtgtttactggtggtggtgggtcagattttgctactgcatcagtctctgaggcaggtggatcagggccacaatcttgtatccgcagtcaccacctctataaagcttggaaacccagtttcttcataactcatctgacagcaaaacctatcctgagttgaactcatttcatggcaagacttgatctaaactgatatcaacctatttataatctttatttatgccaattagagaagtatgtcatactttttgcttcagaaatgttgtacttgattatggggttctgagttagactttgctaaaaatgttacataaaatgtagtatataggccatattacctttctaacacatggcaccttctgaattctgaactatatttaaccccaggagttttggataagaaattatcaatccataattgggggtggggttgggggaaggaacaaagaaactacagtattagcggggtaagggagcaaagatttgcttttcttttccctccatagacaaagactctccaagcactcatcattggcttccttgtattccctgccactccccgactctgtaacctctgaatgctagtaacagtctgcattttaagcccaaacaactctttgttcctttccagtggtgggctttgggatggaccctgaccttcagatggatatcgtcaccgagcttgaccttgtgaacaccacccttggagttgctcaggtgtctggaatgcacaatgccagcaaagcatttttatttcaaggtaaaggcacctcctttcttgcatggtggcagaggttggggaggagggtctgtctggggagtgctcatttgttgtgtgtttgtctggagatcgcctttgctatttctcttgtgttgctgtcttgagtgtttagatatgcagggggtattattctgagggcaggagggaggcattagagatcatggtggtaaaatatttggtttggcagtgaaatatttccttgattttggtgaggatctaaagtgggatggatttataacatacttgaaagccattgaccatctatattattgttacaggacatttctctagctgttatcaatatctttgcctgtacttacacctatacctatatttacatctttcatctagtggataggccataagaacagaggaaaacttatggctgcattctccttgaggtagagcttactcagttctgcccactataagcgggaccacaattcattaaatcattcagcaagcatttatagagaaaacatggtgtggttcttagaagcatggtgtttctcacaattctggaggctgtgaagtccaagaataaggcatcagcagatttggtacttagtgggggctggctctgtctgcttccaagatgatgccttgttactgtgtcctgtggaatgctgtgtcctcaaatggtggaagggatggaaaggcagaaaaataactagctagtttcctttctaaagacactaatccattcacaagggcaaagacttcataatttaatcactgtctaaaggccccacctcttaatgcactagggattaagttttaatatgaattttggtgggacacagatattcaaatcagcaaagtgataggtcaacagatacttaaaaaatggataaaaagcctggtataggaagggatggggtctcacagcattctgaatagaggaaatagtatatataaaggtaaggcaaaagccaacaaaaagactttcgcatggcggaagggtggtgaatgtctagaggggtagacagagactaggttacatgggaccctgttgtcagagctgatattctgctgatatgtgtgggtttgggtgtactgatgatttatggtcagtgtccattttgataggtgggatgccatgtactttttgttacctgttttaagtattactcttgcccataggccacttaacagctttgtgctttactctcagagaagtggggcctttgtagaggtttaaacagggaaatgaactgaccagataccatagtaaggcagcctggatattcctctacgaaaatgtctggcagggttcttttaactcagccttttatgatgataacaaaaggattattttagcatggctgaaccaacataatagaatgagatttacatatttacagtgcagataacttaagacttgttagtgatatgtagcaaatctagagttattatgtaattatatgtaacaagactatggacatactaattttcacttactccttactaatgaattggtgaagtatgtaagctgggcatggttaaaagggtagactgaattactttgtttttgcattgtgctatatctggccagtcactgttgagagtccatacctttcttgatctgagtcttaatccatcatagcaacaactcatgctgatactttataaacaaagttgctatggaaacctggctggtctgtaagcttcaagagggcaggagtcctgctgacctagatactcctagatcctcagggccacctactgtgcatgaaacacagtaggtgatcaataaacattttgaatggaattaaaatttcttttgtactatgtaccttataaaaaacttactgcttgctttagttactactattcattccacaagtgtaggtcccctgggctggaactctactttctaatctgtgcattctctgttttggcaaccatctctgtgttgtctgcccggctacaacaactgggagggattttcagcttctttggtgggaagagtaacttttttatggaactttgacagagaaggcctttcgcttatatcccctgtgattatattcggctcacctagaaattcaggataatctcccccatctcaatatcagtaacttaatcacatctgcaaatcccttctgtcatgtaaggtaacataattatagattctgtcaattagcacctggacatttttggggagccattattttgtttgccacaaagtctgccctctagatcccaaggattcatgtctgtcccacatgcaaaatacattcaccccatcgcagtatctcaaaaagtcttaatccatcatagcaacaactcaaagattgaaatctcccttaatctcagctgaaaaattctacatctcattaagtaatctaaatcagatatgggtgagacagtgggtataatccattttgggggaaaaatttctctttattgtggtcttatgaaactggaaaacaggtaatctgcttccaaaatacaatggcgggacaggcataagataccagttatagatatttctgttccaaaggaaggaaatggaaagaagaaaggagtcactggtcccagacaattgtgaaattcagcagtgcaaactccgttgggttcaagtcttagaaataatcctctttggttttggctctgtcttctggcttgtggctcattcctctgagacatcgttcatttttcatgaaggatagcatttgtttgcagttgagtagtttaatcagcttgtttcctgcctgtaaagttttggtggtttgtcagacatctttcattgtgtcctctctcagtcttcttcagtccaaattggcagggtttctgttggtatagtattctcaagaatcttgaaggtctcctgtccactagacaagcagcttatccacagatctgtcctagataatgctgtctctattcctgactactactgagatggctgaagggaatccatgattcacatactgatctctacaaagaggcctctaggtgattgaatattttgatcttttgatccttccaaggcactctcaaaaagttgtttaaccacaacgtggctctagagcaggctttcctgatagtgtgtctccttttattgtgttttgcaatctggataggctgagaactctctgaattatcaagtcctgactcctttttgcttaacagctcttctctcaatcccttacttttctctcacattttgccataaatagcaagaagaaatcagactgtaacttcaacactttgcttggaaatctcctcacctaaatatccaagtttattttactttccacataactacaggacaaaatgcagataagctttctggcatcatgtaacaaggatcctccatctttgggtattcattcaataatatgtccctcatttccttttatgtctttgctgggaccacttttaacatctatatttatttttaactccctgttgaaggcaactggccttttctaccaagctccttaaaaattttccagcctattatccaatgccgaagcctcttccacatttttaggtatttgttacagcagcaccccacttccagttacctaaagtttgcattggtttcttactggtgctataacaaatttctacaaatttagtgacttaaaataaatttattatcttatacttctagaggtcataagttcaaaaaagagatttatggggctaaaaccaaggtgttagtagggctgtgttctttctggaagctctactgaatattcattcagttcattgcctgttggagcttccagaaattgccacattccttggctcatggctgcatcagtccaaggtcgacttctgttgtcacatttccttctctttgattctgtcatcatattatcttctctgatattgaccttctgccttccattttcccttataagaaatcttgtgattatgttggaaccacccaggtaatctaagtattctcatctcaagattcataatttaatcacatctgcaaaatctttttttgccatataagttgacatattaacaggttctggggattaaaatatgaatatcttttggggcccattattctatcatagaatggctaagcattgttgggcataaatatgaacataatgatgtttcctgagtactacaattaaatcttcctttttctagtgcagtatggtccaatcgaaatgtattgtgcgctgcatctttaattgtaacatctgtaagagccacattaaaaaagtaaaaagaaacagataaaagtaattatatattttatttaacccaacatataaaaaatattatttcaacgtatggtcaacccaaaaatatattaataagatattttactttttttaaaaaacaaggccttcaaaattaattggtattttacacttaaaacacattccgatttgcatgctaaatttttaatttgtagtaattgatatgtatgttgatttcataaaatttaaagttaaaaacgtagattcatcaaattattctgtacagacaattattagattaaaaaattaaacaggtttattgaggtataattatattataataaactgtgtattcaaaatatacaacttggtaattttaatatacaaatatacctgtgcagccatcatcacaatcaagaaaaatgaacatagttatcacccaaaaagtttaccttttttcttttataattcctcccacttacctctcccaacctccacttctaggcaattattgatctgctttctgtgactatacactaatttgcattttctagaattttatataaatagaatcatacagtatgtgcttttttggtctggattcttttactcattatgggtattttgagatttatacatattgcagcatgtaaagtgcttttcttacaggcaatatatagttggaggctaactttttatttaaaccaataaaataatttgtgttttttcatcagcgtatttagactatttacatttaatgtgattattgacatgattatatttaaatctatcttctcgtgatttgtttcctacctgttccatgtattctttgttccctttcccctctttatgtcttcttttggattaattgaatattttttacaattttgttttatctttgttggcttattagctataactctttgttttgctatttagtttataaactcctgactacattgttatttttatttaatgagtcaattatcttttaagcagatttagataataaaatcaattatacgtttaactcatgtagtttctttttttccccaacttttgttttaggttcagggggtacctgtccagatttgttatatgggtaaattatgtgttgctgaggtttggtatacaaacgatcccatcacccaggtagtgagcataattccctataggtagtgtttcagcccacaaactccctcccactctcccgctggaagtagtcctcagtgtctatttttcccatctgtgtctgtgctcttgccgtttctgttttctgtgttctttgttcttttgtgtaactttatatttccacccgatattattttcatcctgcctgaaggactttctttaacatttaacatttctttcttcactaatatttcttatagtgcaggtctgctggtgatgaattcttttagattttgtacatctgcaaaagtctttattttgcttttatttttgaaatatatctttgctaagtataaaattctgtgccgacaggtttttgtccccattctttaaagatgtcttttcacttatattgtttccaacaagaagtctgttgttattatatttttgtccctctggagacaagtatttttccctgcttttaagactttctctttatcactgattttgagctattttattatgatgtccctggtgtggtttttgtcatgtttcttgcatatgagatctactgaacttgggaaaaatttggccattatgtcttcaaatattttttctgttcgttcttttttttttttttctgtagtgactacaattacatgtatatatttgactgcttaaaggtgttccataactaattgatattatatttatttaaaatatttactaaggccaggtatgggggctcacacctgtaatcccaatactttgggaggtttgaggcaggaggattgcttgagtccaggaattcaagaccagcctgggcaacatagtgagaccctcatctctacaaaaaataaaacaaaaattattttaaaaagactaaaaattaaattaaaaaaatttaaaacattattcttttttctctctgtgtataatttttgatcatttccattgttatgccttcaaggttacgaaacttctgtattatctgtcattactatcacttagtgtattttttacctcatatattgtagctttaactctgtaagttcagtttgactgtgtaaaaaatcttccatgtctctacctaactctttgaatatatgaatacagttctaataactgttttaatgttgttaatcgaaaattctaataattgtatcagtgctgggccaattttgattgactgatttttctcctcattacttcttccttgcatgcctcttaatttttgattaatggccagtcattgtgaattttaccgtctttggtactgagcttttgtgtatttttataaatacctttgagttttgttctagtaactgggacacaattcaattcttttagatcctactttaaaggtttgttagatgggcccagagaagtgctagtgctagtagttagggtagaactaattatttaccatcactgaggcaagatccttcagcgtactctacccagtgactgataagtcatgggattttccagtttgactggtggaaataggtactatttctggccctcgtgtatgctggatactgttgccttttgggtgggtctttcctgtccttgggtaattttctaacatgtatgcacaggtcagtactcagctgaatactgattttgggtagatctgtgtttccgtctttgtgctgctatcttctcttgtgtatactgtcctgtgaaatctaggtgccttggtctccccagacttcagctttctctcctcaactcaaggagattgcctgagttctgccttcctatgctatgcctggaaactccctcagagcagtaagctatggtaattatagggctcatctcttttgtatcccgtctctgaaggatcactgcccttcattgactgatggctagtgtcttgaaaactgtagtttcatcaaatattcactataaatctaaattaaaattaattaaaattatgcaaaattgaaaattcatttcctcagccacactagccatatttcatgtgctcagttgctttttgtggctaggggttaccatattagacagtacagatctggagatgctcagaaattttactgtttcaccacagctctgttaatataggcagacttcaaaaatcctgtactttaaggttaatgtatgatagcaactatcaagctacttaagctctccatctcaaagtacttccatttactcactgataaggtgggggtaataatagtgcctactatatatggttgtagtgagggtgaaataatacatacaaagtgctcgaacagtacttggtggtgagctctcgttaaacttgagtctatacattttaaagtaatagggtatagctttggctttttttccctcatgtgtatcatctgccttatgcattattgatgtcagattttaacccagaagtagattaggatagtggaaaaagcagaagactggggaagggcagaagattaaaatcagcattttttgttttaatttatttcatcctcactactatgatataaaataggtactattattacccccttttatcaatgagtaaatggaagtattttgaggcagtatttaagggtgacagtggatacgtctcttaatgtattcaagcctcagtttccttgtctggaaatgggacgaataaaaagactgataagaattcaatgactacatatgggaaagcacttcaaaagtgcaaagtgtaaaaaaaaaacagttcattattctttccttcatttatttttatttctcctaatatttcaccatctgatgtccagctgtgaattgtgtgttcagagaatgaaaaccttcatttcagtgctagcctgttaataatatcgatacatttaaatagaaacctcacttaactgggaacatttctacagtaccaattgcaaagcctggtagcatttattttggggctagccagcttttgagttatctttgttactgctgtctttgtagagcacaaagaattgagtaagtaagatttttattttcttcttgcttgaaataaatttttttagggtgttaaaagaaaaactttagacaaattaaatttaacagaatttaattgagcaaagaatgattcgtgaatcaggcagcccccggaaccagaataggttcagagagactgtcactgccgggtggttggagaggatttatggacaaaaaagggaaagtgatgtacaaaaaatggaaggaggtgtggtacacaaacagctgaatttgttgtagcttggcatttgccttgttcgaacatttggccactgtggctgaaactcggtgatcaatatgagtaggttacagtctgtttacaccacccagttaggttacagtttactatgtatggagaaactttcaggtggaatttacaaggaggaagctttaggctaaacttaatttaacaattctcccctttcagtgccctctccaagtagagaagctgaccaaaactctaggcattgaagtgactctgtcattattgtaaatatatttagttggtctcaaatatcactgggaaatagtagaacatgtgtgtataggggcttcagtttttttttttttttaatagaggttagagtagaggggtcccttttatgctggaatctcctgttttcaggagagaaaaaaacatctggtctgttttgggatctctctctctctctttttttttttttcaaatttttagtttgattatgttatatttagtatgagtgacttcattttggtttgatctgatctggtctcttggggactagtatatgagttttgtctaaaagaaggcctctcgtaattttaataattcttttagtgagattttttcttattatttaatttttatgagtacattattacatgtggtattgaatattttgatataggcatacaatgtgtaataatggtcagatattaatgtagatgagtgtgaccaaaactaaggacttcagtgctatttttgttattattttgaatttttggtctcagtatgtcatatgtcatgtggtgtctttatgactatgtatttttgtttattgagtttttgtagtttcagtagaagacagactatttgacattttatgaatggctatgtataaacatttacaatttttgggagaatgtagtatgccagggagattggtattatgaatattaggaagataatgttaagaatatggagtatgttttttggttaaggtctttatgaactaaactaaatttttttttttttccgtgacagttttgctctgtcacccaagttgtagtgcagtggcacagtctctgctcactgcaacctccgcctcctgggttcaagcgattctcctacctcagcctcctgagtagctgggattacaggtgctcactaccacacccagctaattttttgtatttttagtagagacagggtttcaccatgttggccaggctggtctcgaactcctgacctcaactgatctgtccacttcggcctcccaaagttctgggattacaggcatgagccaccatgcctggccttctctaactaaaattaaataggtcaaagaataagttagacagactatttgttttaactaagtagtctgttttattaatctcgtataattgaatccctataatgcttaatgtgtaacaagaagtatcactaaccatacagattttttttcctgtttaataagtatgcaatttaaagtaaattatttattttatttagtatacttttagtaagagaatttaaagaagtccattgtgtaaccatagttttcgtagtagaatttgttatagaggctactatgagagagaactttttttttattttttaaattaaaaaagttttctctttgcttttaaaaataatttcaacttttattttagattcagagggtacatgtgcagatttgttacttgggtatattgtgtgatgctgaggtttggtgtataattgatctggttacccaggtagtaaggatagtacccagtggtttttcaacccttacccatcaatatcttccccctctcgtagttcccagtgtctgtagctgccatctttatgttcatgtttatccaatgtttagctcccacttataagtgagaacctgtagtatttgattttctgtttctgcattaatttgcttaggataatggcctccagctgcatccatgttgctgcaaagaacatgatttcattgtttctttttatggctgtgtgatattccttggtatatacatatataccacattttctttatccaatccaccattaatggccacctagattgattgcatgtctttgctattgtgaatagtgctgcaacaaacatacgagtacatgtgttttttggtagaatgatttatttacttttggatatatgtattatatacccagtgatgggattgtgagtcaatggtggttctgtttcagttctttgagaaatctccaaactgctttccagactggctgcactcattcacattcccaccaacagtgtataagtgtttccttttctctgcagcctcacgaacatctggtgtattttgactcttttgaacatccattgtattttgactctttagtaatagccattctgacaggtgtgagatggtatctctttgtggtttggatttgcatctctctaatgatgagtgatgtggagcgttttttcatatgcttattggccgcttatatgtcttctttcttcttttgaaaagtgtttgttcatgtcatttgctcactttttaatattgttatttggtttttgcttgttcaattgtttaagttccttatagattctggtcttagacctttgttggatgcatagtttgcaaatattttctctcattgtgtatgctgcctgtttactctgttgatagtcttcttttactatgcagaagccctttttttattttttattttttattattattatactttaagttttagggtacatgtgcacaatgtgctggttagttacataggtatacatgtgtcatgctggtgtgctgcacccattaactcatcatttagcattaggcatatctcctaatgctatccctcccccctccccccaccccacaacagtccccagagtgtgatgttccccttcctgtgtccatgtgttctcattgttcaattcccatctatgagtgagaacatgcggtgtttggttttttgtccttgcgatagtttactgagaatgatgatttccaattgcattcatgtccccacaaaggacatgaactcatcattttttatggctgcatagtattccatggtgtatatgtgccacattttcttaatccagtctatcattgttggacatttgggttggttccaagtctttgctattgtgaatagtgccgcaataaacatacgtgtgcgtgtgtctttatagcagcatgatttatagtcctttgggtatatactcagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgatagccattctaactggtgtgagatggtatctcattgtggttttgatttgcatttctctgatggccagtgatgatgagcattttttcatgtgtcttctggctgcataaatgtcttcttttgagaagtgtctgttcatatcctttgcccactttttgatggggttgtttttttcttgtgaatttgttggagttcattgcagattctggatattagccctttgtcagatgagtaggttgtgaaaattttctcccattctgtaggttgcctgttcactctgatggtagtttcttttgctgtgcagaagctctttagtttaattagatcccatttgtcaactttggcttttgttgccattgcttttggtgttttagacatgaagtccttgcccatgcctatgtcctgaatggtgatgcctgggttttcttctagggtttttatggttttaggtctaatgtttaagtctttaatccatcttgaattaatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgtggcgttctttctgagggctctgttctgttccattgatctatatctctgttttggtaccagtaccatgctgttttggttaccgtagccttgtagcatagtttgaagtcaggtagcatgatgcctccagctttgttcttttggcttaggattgacttggcgatgtgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtgtcctcttttgtttcattgagcagtggtttgtagttctccttgaagaggtccttcacgtcccttttaagttggattcctaagtattttattctctttgaagcaattgtgaatgggagttcactcatgatttggttctctgtttgtctgttattggtgtataagaatgcttgtgatttttgtacattgattttgtatcctgagactttgctgaagttgcttatcagcttaaggagattttgggctgagacaatggcgttttctagatatgcaatcatgtcatctgcaaacagggaaaatttgacttcctcttttcctaattgaataccctttatttccttctcctgcctgattgccctggccagaacttccaacactatgttgaataggagtggtgagagagggcatccctgtcttgtaccagttttcaaacagaatgcttccagtttttgcccattcagtatgatattggctgtgggtttgtcatagatagctcttattattttgagatacgtcccatcaatacctaatttattgagcgtttttagcatgaagggttgttgaattttgttgaaggccttttttgcatttattgagataatcgtgtggtttttgtctttggttctgtttgtatgctggattacatttattgatttgcatatattgaaccagccttgcatcccagggatgaagccaacttgatcatggtggataagctttttgatgtgctgctggatttggtttgccagtattttattgaggatttttgcatcaatgtccatcaaggatattggtctaaaattctcttttttggttgtgtctctgaccggctttggtatcaggatgatgctggcctcataaaacgagttagggaggattccctctttttctattgattggaatagtttcagaaggaatggtaccagttcctccttgtacctctggtagaattcggccatgaatccatcgggtcctggactctttttggttggtaaggtattgattattgccacaatttcagatcctgttattggtctattcagagattcaacttcttcctggtttagtcttgggagagtgtatgtgtcgaggaatttatccatttcttctagattttctagtttatttgcatagaggtgtttgtagtattctctgatggtagtttgtatttctgtgggatcggtggtgatatcccctttatcattttttattgtgtctatttgattcttctctctttttttctttattagtcttgctagcagtttatgaattttgttgatcctttcaaaaaaccagctcctggattcattaattttttgaagggtttttttttgtctctatttccttcagttctgctctgattttatttatttcttgccttctgctagcttttgaatgtgtttgctcttgcttctctagttcttttaattgtgatgttagggtgtcaattttgggtctttcctgctttctcttgtgggcatttagtgctataaatttccctctccacactgctttgaatgtgtcccagagattctggtatgttgtgtctttgttctcgttggtttcaaagaacatctttatttctgccttcatttccttatgtacccagtagtcattcaggagcaggttgttcagtttccatgtagttgagtggttttgagtgagtttcttaatcctgagttctagtttgattacactgtggtctgagagacagtttgttatagtttctgttcttttacatttgctgaggagtgctttacttccaactatgtggtcaattttggaataagtgtgatgtggtgctgagaagaatgtatattttgttgatttggggtggaaagttctgtagatgtctattaggtccgcttagtgcagagctgagttcaattcccgggtatacttgttaactttctgtctcgttgatctgtctaatgttgacagtggggtgttaaagtctcccattattaatgcgtgggagtctaagtctctttgtgggtcattcaggacttgctttatgaatctgggtgctcctgtattgggtgcatatatatttaggatagttagctcttcttgttgaattgatccctttaccattatataatggccttctttgtctcttttgatctttgttggtttaaagtctgttttatcagagactaggattgcaacccctgcctttttttgttttccatttgcttggtagatcttcctccatccttttattttgagcctatgtgtgtctctgcacgtgagatgggtttcctgaatacagcacactgatgggtcttgactctttatccaacttgccagtctgtgtcttttaactggagcatttagtccatttacatttaaagctaatattgtcgtatgtgaatttgatcctgtcattatgatgttagctggttattttgcttgttagttgatgcagtttcttcctagtctcgatggtctttacattttggcatgattttgcagcagctggtaccggttgtgcctttccacatttagtgcttccttcaggagctcttttagggcaggcctgggttgacaaaatctctcagcatttgcttgtctgtaaagtattttatttctccttcacttatgaagcttagtttggctggatatgaaattctgggttgaaaattcttttctttaagaacgttgaatattggcccccactcttttctggcttgtagagtttctgccgagagatccgctgttagtctgatgggcttccctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaatgttggcctgccttgctagattggggaagttctcttggatagtatcctgcagagtgttttccaacttggttccattctccccgtcactttcaggtacaccaatcagacgcagatttggtcttttcacatagtcccatatttcttggaggctttgttcgtttctttttattcttttttctctaaacttcccttctcgcttcatttcattcgtttcatcttccatcactgataccctctcttccagttgattgcatgggctcctgaggctctgcattcttcacatagttctcaagccttggctttcagctccatcagctcctttaagcacttctctgtattggttattctagttatacattcgtctaaatttttttcaaagttttcaacttctttgcctttggtttgaatttcctcctgtagctcggagtagtttgatcatctgaagcctaggtcctccttgttaatttttgtttttcttgtgattgcttttgaggtactagccataaattctttgtcaaagctgttgtccagaatggtattttctgggttttcttctaggatttttatagtttgaggtcttatatttaaatctttaatccatcttgagttaatttttgcatatagtgagagacaggagtctattttcattcttctgtatatggctggtcagttatcccagcaccatttattgaatagggggtcctttccccatcacttatctttgtccatttagtaaagatcagatggttgtaggcgtgtggttttatttctggattctctattctgttctattggtctatgtgcttgtttttgtactaataccatgctgtttactgtaggttactgtagccttatagtatagtttggtaatagaaaatatagaagtggggtaatgtgatgtttctgtggggtaatgctctttctgcttaagattgttttggttatgtcagctcttttttggatccacatacattttagtgtaggtttttttttaattctatgaaaaatgacattggtagttttataggagttgtgttgaatccatagattgctttggattatatggtcattttaatgatagtgattcttctaatccatgaacatggaacgtttcttcatttacttgtgtcatctatagtttcctttagcagtgttttatagttctccttgtagagagctttcacctccattgttaggtgtgtttctaggtattttatttttttgtgcatatattataaatgggactgtgtccttgacttggctctcagcttgaacgttactgttatataaaaatgttactgatttttatacattgattttctctcctgaaagtttactgaagtcgtttatgagttccaggaaccttttggcatagtcttcagggttttctaggtagagaatcatatcatcagtgaagagggatatttggactttttcttttcctatttggatgcctttaatgtcttcctgttgcctaattggtctgactagcacttccagtactgtgttgaataggagtggtgaaagtagacatctttgcctgttccatttctcaaggggaatgctcccagcttttgcctgtccaatacgatggtggctatgggtttgcatagatgacttttattattttgaggtatgttcctttgatgtttagtttcttgagggtttttatcataaagagacgttggattttatcaaaagctttttctgtgcctatttggatgatcatatggtttctgttttagttttctttatgtggtgaatgacatttattgatttgtgtatgttgattacatccctacttgatcatgatgaattaactttttgatgtgctactggattctgtttgctcgtattttgttgaagaattttgtgtctatgttcattagggtagggatgttggcttatagttttagtttttcattgtgtctttgttttttgataacagggtgatgctggcttcgtagaatgagttaggaaggagtcctccctcttcaatttttcacaatagtttcagtggaattggtaccagcttttctttgtacatctggtagaatttggctgtgaatccatctggcctgggctttttttttggtagataggattttttaaaattacttattcaatctcagaagttgatattggtttgttcaggggttcaattccttcttggttcaatcatgagaagttacgtgtttccaggaatttatccatttctggatagattttctggtttgtgtgcatagagatgtgtatagtagtctctgaggatcttttgtatttctgggggattggttgaaatgtcacctttgttgtttctgattgtgcttttttggatattcttttttccttgttaatctagctagtgctctattgatcttgtttatactttcaaatacccaacttttggtttcattgattctttgggtggacttttgagtcttaatttctttcagttctgctcttattttagttatttattttcttctgctagctttggggttagttttttctttttctaggagtgaaaaacactaggtttggggtcatttttgtcttgttactctgggtgtgatgttagatcattgatgtgagatctttctaactttttaaggtaggcctttagtgctataagccttcttcttaacactgcttttgctgcagagggatatatttaacattattgccacatttattttaaactatgccaaaagggacctaataaatgatgtctatctagaagagggaaagcctttggtaatgtttttcattttttaacctattataggttgtaaggagtggacttatgttttgtttgtgcctgattatgaagtaataaaaatactactcaatttttttggtctacatcttaccatttattttttgtcatctgacactgtcacaataactttagaaaaattacatttaatgaagtttaagcaaagaataatttgtgaattgaacagccaccctcctcaactccaaacaaccagaataagtctagtactgtcacgtggttggagaggatttacagacagaaaaaagaaagtgatatacataaaacaaaagtgaggtatggaaatagctgaattgtttatagcttggcatttgctttatttaaacactgtttaaacagttggctgcctttggttggctaaaactcaatgattggtttaagagtatgttacagtctgtttacacatccagttaggtttcagttcactatgtatagaaaaacctctaggccaaacttacaaggaggcaactttagaccaaatttagcaacaaattagcgatggtgccgggaaaagaatgagtgtctatgggtaaggctggcacagatatttaagttgaaaactattctaaacaccagcattagattttcaaaaatcattttggaacacctctgctttgctttgagtggtactcagaggagatctgagagtttgaaactatacttctccttgactgacagtgtcttagtgttaagtagttgggaggatgtgtcatcggtggttcatttataaaagtgaattagaatatgcatgagtgcaaattctttaatatgttgcttttttttttttttttcctgccaggaaagtgctacctttcaggagttctgcttcaaaagagtttctaaaggaagaatagatagtatctttcaagtagcttgttttatgtaacaagatagaacaaaggctaatgtagctgcttccaggggaagattcaggaatttagcacctgtttgccttctaggctttgagctacatgttgtggaagacctagatgaataaggtaaagatctcagcctcaactacgttacagttcagaagggcaaatatgacctctggcaccctaattcagaataaaagagaactggcttgccgtcaagtgtggataaagtcttaagagtgttcaagaaagaaatttcttactggatgacctgggaaatggtctttgggggaggtggcacctgaacagaccttggaagatgtacaggagttaaatatgtggtttctttttcataggaacactgcccatgtgtaaccattttcacaaaaccgtgcttgaggtttgagctatagctgttaatgctcagaaaatctgagtaagatggaattacccaaagggtttgttaaatgccgatcttccagatttcctgccacccactgttgcccaagtctgaattgttttttctgttgattggatgagcctagtcactaattacctcagggagcatttactagtcaaccttactttgagtggagtgatttagtataactttgcatttaatcaattagccgagtgattcaattcacataccagtgtctcccaaatagaagtgtttttgctcttgccaaataaaagctcaagctagccgtgagagtggagtggtttttcaaatctctctctggggcaaattaacacctgcactggcttattctggaaaatcattaaatggctttgtgattatcgtagagcaaataaactgtgtttattctccaaatctgtccacttctaccgtctgcactaaaatctcttctctcagtcatgctccttctgccatcaaatagtacattaaggaaagcagagatggagagagacagcagagaatgcaaaatcataagaattattttagaaactatttagctatatgggccaatttcatctgaacaaattaaccttgggcaaattgcttcatctcttaaatgtgttgcctcttcagacattgaataataatgataatgtccaaggtagaagatatttttaaggattaatttagataacttaaattcatggtgtgagaaaaagacattcatattaaaatttctttcaatagtttttggggaacaggtggtttttggttacatggataagttatttagtggtgctttctgagattttggtgcacccatgacctgggtagtgtacactgtacctaatgtgtagctttttaatccctcaccccattcctacccttccccacaagtccccgaagtccattatattattcttttcctttgcattctcatagcatagctcccacttataagttatacaatatttggttttccattcctgagttacttcatttagaataacggtctccaaactgggcgtggtggctcatgcctgtaatcccagtactttgggaggccgaggtgggcagatcacctgaggtcaggagtttgagaccagcctggccaacatggtgaaaccctgtctctactaaaaatacaaaaattagctgggcatggtggcgcacatctgtagccctagctactcgggaggttgaggcaggagaattgcttgaacccaggaggcggaggttgtagatagtggagatcgtaccactgtactccagcctgggcaacagagcaagactctgtctcaaaaacaaacaaaaaaaacaaaacaaacaaaaaagaataacggtctccaactccatccatgttgctgtgaatgccattatttctttcctctttatggctgagtagtattccaaggtatatatatgtatacaccacattttctttttctttttctttttttttgagatggagtctcgctctgtcactcaggctggagtgcagtggtgcgatctccgctcactgcaacctctacctcctgggttcaaacgactcctctgccttagcctccccagcagctgggactacaggtgcacgccaccatgcccaactaatttgtgtattttagtagagatggagtttcaccatattggccaggctgatctcaaactcctgacctcatgatctgcccaccttggcctcccaaagtgctgggattacaggcgtgagccactgtgcctggccacacattttctttatctactcattggtagatgggcatttaggctggctccatatttttgcaattgctgattgcgctgctataaacatgcatgtgcaagtttcttttttatataatgacttttcctctgggtagatacccaatagtggaattgctggatcaaatggtagttctactttagttctttaaggaatctccatactgttttccatagtggttgtactggtttacattcttaccagcagtgtaaaagtgttcccttttttatcacatccatgccaacacctataattttttagtttttaaactatggccattcttgcaggagtaaggtggtatctcattgtggttttaattttcatttccctgataattagggacgtagaactttttttttataaaatgatgctttcattatcagtcaacatagtccttgacaaagcaagcttcattacagaactgtttttagaaaaaacaaaaacaaaaacaaaacagagcttaaaaaacaaaatatatgttaaatggataatatgtatttcaataggctgggtgcagtgtctcatgtctgtaatcccagcactttgggaagccaaggcaggtggatcatgaggtcaggagttcaagaacagcctggccaatatagtgaaaccccgtctctactaaaaatacaaaaattagccaggcatggtggcacgtgcctgtagtcctagctactcgggaggctgaggcaggagaattgcttgaacctgggaagcagaggttgcagtgatccaaggtagtgccactgcattccagcctgagcaacagagtgagactccatctcaaaaaagacaaagaaaaaaaaatatatatatttcaataaaattttttttattatacttctaggatacatgtgcacaacatgcaggtttgttacatgtgtatacatgtgccatgttggtgtgcggcacccattaactcgtcatttacattaggtatatatcctaatgctatctgtccccccttcccccaccccacaacaggccccagtttctgatgttccccaccctgtgtccaagtgctctcattgttcaattcccacctctgagtaagaacatgcggtgtttggttttctgtccttgtgatagtttgctgagaatgatggtttccagtttcatccatgtccctacaaaggacatgaacttatccttttttatggctgcctagtattccatggtgtatatgtgccacattttcttaacccaatctatcactgatggacatttgggtcagttccaagtctttgctattgtgaatagtgccacaataaacatacgtgtgcatgtgtctttatagcagcatgatttatagtcctttgggtatgtactcagtaatgggatggctgggtcaaatggtatttctagttctagatccttgaggaatcgccacactgtcttccacaatggttggactagtttacagccccaccaacagtgtaaaagtgttcctatttctccacatcctctgcagcacctgttgtttcttgtctttttaataattgccattctaactggtgtgagatggtatctcattgtggttttgatttgcatttctctgatgctcagtcatgatgagcattttttcatgtgtcttttggctgcataaatgtcttcttttgagaagtgtctgttcatatactttgcccactttttgatggggttgtttgattttttcttgtaagtttgtttaagttctttgtagattctggatattagccctttgtcagttgggtagactgtaaaattttctcccattctgtaggttgcctgttcactctgatggtagtttcttttgctgtgcagaagctctttagtttaattagatcccatttgtcaactttggcttttgttgccattgcttttggtgttttagacatgaagtccttgcccatgcctatgtcctgaatggtgatgcataggttttcttctagggtttttatggttttaggtctaacatttaagtctttaatccatcttgaattcatttttgtataaggtgtaaggaagggatccagtttcagctttctacatatggctagccagttttcccagcaccatttattaaatggggaatcctttccccattgcttgtttttgtcaggtttgtcaaagatcagatggttgtagatgtgcggtattatttctgagggctctgttctgttccattggtctatatctctgttttggtaccagtaccatgctgttttggttactgtagccttgtagtatagtttgaagtaaggtagcatgatgcctccagttttgttcttttggctcagaattgtcttggcaatgcaggctcttttttgattccatatgaactttaaagtagtttttttccaattctgtgaagaaagtcattggtagcttgatggggatggcattgaatctataaattaccttgggcagtatggccattttcatgatactgagtttcctatccatgagcatggaatgttcttccatttgtttgtgtcctcttttgtttcattgagcagtggtttgtagtcctccttgaagaggtccttcacatcccttgtaaattggattcctaggtattttattctctttgaagcaattatgaataggagttcactcatgatttggctctctgtttgtctgttattggtgtataagaatgcttgtgatttttgcacattgattttgtatcctgagactttgctgaagttgcttatcagcttaaggagattttgggctgagacaatggggttttctaaatatacaatcatgtcatctgcaaacagggacaatttgacttcctcttttcctaactgaataccctttatttccttctcctgcgtgattgccctggccagaacttccaacactatgttgaataggagtggtgagagagggcatccctctcttgtgccagttttcaaacggaatgcttccagtttttgcccattcagtatgatattggttgtgggtttgtcataaaaagctcttattattttgagatacgtcccatcaatacctaatttattgagagattttagcatgaagcgctgttgaattttgacaaaggccttttctgcatctattgagaaatcatgtagtttttgtctttggttctctttatatgatggattacgtttattgatttgtgtatgttgaagcagccatgcatcccagggatgaagcccacttcatcatggtggataagctttttgaggtgctgctggatttggtttgccagcattttattgaggatttttgcattgatgttcatcaggcatagtggtctaaaattctctttttttgttgtgtctctgccaggctttggatgatgctggccttataaagtgagttagggaggattccctcttttttctattgattgaaatagtttcagaaggaatggtaccagctcttgcttgtacctctgttagaattcagctgtgaatctgtctggtgctggactttttttggctggtaggctattacttattgcctcaatttcagagcctgttactggtctattcagggattgaacttcctggtttagtgttgggagggtgtatgtgtcgaggaatttatccgtttcttctagattttctagttcatttatgtagaggtgtttatagtattctctgatggtagtttgtatttctgtgggatcggtggtgatatcccctttatcattttttattgcgtctatttgattcttctctcttttcttctttattaatcttgctagcagtctatgaattttgttgatcttttcaaaaaaccagctcccggattcattggtttttttgaaggttttcttttgtgtctctatctccttcagttttgctctgatcttagttatttcttgccttctgctagctgttgaatgtgtttgctcttgcttctctagttcttttaactgtgatgttagggtgtcaattttagatctttcctgctttctcttgtaggcatttagtgctataaatttctctctacacactgctttaaatgtgtcccagagattctggtatgttgtgtctttgttctcactggtttcagagaacatctttatttctgccttcatttccttatgtacccgaaagtcattcaggagcaggttgttcagtttccatgtagttgagtggttttgagtgagtttctaaatcctgagttctagtttgattgcactgtggtctgagagacagtgtgttataatttctattcttttacatttgctgaggattgctttacttccaactatgtggtcaattttggaataagtgtgatgtggtgctgagaagaatgtatattctgttgatttggggtggagagttctgtagatgtctattaggtccgcttggtgtagagctgagttcaattcccgggtatccttgttaactctctgtcttgctgatctgtgtaatgttgacagtggggtgttaatgtctcccattattattgtgtgagagtctaagtctctttgtaggtctctaaggtcttgctttatgaatctgggagctgctgtattgggtgcatatgtatttaggatcattagctcttcttgttgaattgatccctttaccattatgtaatggccttctttgtctcttttgatctttgttggtttaaagtctgttttatcagagactaggattgcaacccttgcttttttttgttttccatttgcttggcagatcttcctccatccttttattttgagcctatgtgtgtctctgctggtgagatgggtctcctgaacacagcacactgatgggtcttgactctttatccaatttgccagtctgtgtcttttaattggagcatttagcccatttagatttaaggtcaatattagtatgtgtgaatttgatcctgtcattatgatgttagctggttattttgcttgttagttgatgcagtttcttcctagccttgatggtctttagagtttggcatgtttttgcagtggctggtaccagttgttcctttccatgttcagtgcttccttcaggagctcttgtaagtcaggcctggtggtgacaaaatctctcagcatttacttgtctgtaaaggattttatttctccttcacttacgaagcttagtttggctggatatgaaattctgggttgaaaattctttaagaatgtcaagatacaaaatcaatatgcaaaaattcacagacattcttatacaccaataacagacaaacagagagccaaatcatgagtgaactcccattcacaattgcttcaaagagaataaaatacctaggaatccaatttacaagggatgtgaaggaccgcttcaaggagaactacaaaccactgctcaatgaaataaaagaggatacaaacaaatggaagaacattccatgctcacgggtaggaagaatcaatatcgtgaaaatggccatactgcccaaggtgatttacagattgaatgacatccccatcaagctaccaatggctttcttcacagaaatggaaaaaactactttaaagttcatatggaaccaaaaaagagcccacattgccaagtcaatcctaagccaaaagaacaaagctggatgcatcacgctacctgacttcaaactatatgctacaaggctacagtaaccaaaacagcatggtactggtaccaaaacagagatatagaccaatggaacagaacagagccctcagaaataatgccgcatatctacaaccatctgatctttgacaaacctgacaaaaacaagcgatggggaaaggattccctatttaataaatggtgctgggaaaactggctagccatatgtagaaagctgaaactggatcccttccttacaccttatacaaaaatgaatttaagatggattaaagacttaaatgttagacctaaaaccataaaaaccctagaagaaaacctaggcaataccattcaggacataggcgtgggcaaggacttcctgtctaaaacaccaaaagcaatggcaacaaaagccaaaattgacaaatgggatctaattaaactaaagagcttctgcacagcaaaagaaactaccatcagagtgaacaggcaacctacagaatgggagaaaatttttgcaacctactcatctgacaaagggctaatatccagaatctacaatgaacgccaacaaatttacaagaaaaaatcaaacaaccccatcaaaaagtgggcaaagtatatgaacagacacttctcataagaagacatttatgcagccaaaagacacgtgaaaaaatgctcatcatgactggccatcagagaaatgcaaatgaaaaccacaatgagataccgtctcacaccagttagaatggcgattattaaaaagtcaagaaacaacaggtgctgcagaggatgtggagaaataggaacacttttacactgttggtggggctgtaaactagttcaaccattgtggaagacagtgtggcgattcctcaaggatctagaactagaaataccgtttgacccagccatcccattactgggttatatacccaaaggactataaatcatgctgctataaagacacatgcacacatatgtttattgtggcactattcacaatagcaaagagttggaaccaaccctaatgttcaagaatgatagactggatataagaaaatgtggcatatatacaccatggaatactatgcagccataaaaaatgatgagttcatgtcctttgtagggacatggatgaagctggaaaccatcattctcagcaaactatcacaaggacaaaaaaccaaacaccgcatgtttttactcagaggtggggattgaacaatgagaacacatggacacaggaaggggaacatcacacactggggactgttgtggggttgggggggaggggggagggatagcattaggagatatacctaatgctaaatgatgagttagtgggtgcagcacaccaacatggcacatgtatacatatgtaacaaacctgcacgttgtgcacatgtaccctaaaacttataataataacaaaataaaaaaaaaaggaatgttgaatattggcccccacttttttctgacttgtagagtttctgctgagagatcctctcttagtctgatgggcttccctttgtgggtaacccaacctttctctctggctgtccttaatattttttccttcatttcacctttggtgaatctgacaattatgtgtcttggagttgctcttctcaaggagtatctttgtggcgttctctgtatttcctgaatttgaatgttggcctgccttgttaggttggggaagttctcctgaagagtattttccaacttggttccactctccccatcatttttaggtacaccaatcagatgtagacttggtcttttcacatagtcccatatttcttggaggctttgttcattttactcttttttctctaaacttctcttctcgcttcatttcattcatttggtcttcaatcactgataccctttgttccacttggtcgaattggctactgaagcttgtgcgtttgtcacgtagttctcctgccatggtgttcagctctatcaggtcatttaaggtcttcttggtgctgtttattttagttagccattcatctaatcttttttcaaggtttttagcctctttgtgatgggtttgaacttcctcctttagctcagagaagtttgttattaccaatcgtctgaagtcttcttccctcaactcgtcaaaatcattatctgctcagctttgttccattgctggcaaggagctgcattcctttggaggagaagaggcgctctgattttgagaattttcagctttccttctctggtttctctccatctttgtggttttatctacctttggtctttgatgatggtgatgtacagattgggttttggtgtggatgtcctttctgtttgttagttttccttctaacagtcaggaccctcagctgcaggtctgttggagtttgctggaggtccattccagaccctgtttgcctgggtttcaccagtagaggctgcagaatagcaagtattgcagaacggcagatgttgctgtctgatccttcctctggaagctttgtctcagaggggcacctggctgtaagaggtgtcagtcggttaggctactcagggatctgggacccacttgaggaggcagtctgtccattctcagatctcaaactccatgctgggagaacaactactttcttcaaagctgtcagacagggacgtttaagtctgcagaactttctgctgccttttcttcagctatgccctgcccccagagctggagtatacaggggcaggcaggcctgcctgagctgcagtgggctccacccagttggagcttcccggctgctttgtttacctacttaagcctcagcaatggtgagcgcccctctcccagcctcgctgctgctttgcagtttgatctcagactgctgtgctagtggtgagtgaggctgtgtgggcgtgggactctctgaaccaggcacaggatataatctcctaatgtgcttcttgctaagactgttggaaagcacagtattagggtgggagtgtcccgattttccaggtaccatctgtcatggcttcccttggctaggaaagggaattccccgatcccttgcacttcccgggtgaggcgatgccccgccctgcttcggctcacactccttgggttgcacccactgtctgacaagccccagtgagatgaactgggtaccgcagttggaaatgcagaaatcacccgtcttctgggtcactcatgctgggaactgtggactggagctcttcctgttcagccatcttggaacctccctgaacattttttttttaatgttttttggccatttgtatatcttcttttgagaattgtctattcatgtcctttgcttactttttgatggtattatttgctttttttcttgctgatttgcttgagttccttgtagagtctggatattagttctttgtcagatgcataatttgtgaatattttctcccactcttttggttgtctgtttactctgctggttatttcttttgctgtgcagaagttttttagtttaattaggtcccatccatttattttttgttgcatttgctttcagattcttggtcatgaagtccatgtctaagcgaatgtctggaacagtggtccgcaaactttttggcaccagggaccagttgcatggaagacaatatttccatggactgtggtgggggcaggcgatggtttcaggatgaagctgtttcacctcagatcatcaggcattagattcttaaaaggagcacacaacctagattccttgcatgcacagttcacaataggggtcatgctcctatgagaatctaatgctgctgctgatctgataggtggcagaactcaggtggtaatgcttgcttctttactgctcacctgctgctgtgtggcccggttcctgacaaggggttggggaccccttgtctcgaagagtttttctgatgttatcttctagaatttttatggtttccggtcttagatttaagtctgacccatcttgagttgatttttgtctaaggagagagacgaggatccagtttcattattcgacctggggcttgccaattatcccagcaccatttgtttaatagggtattctttccctactttgtatttttgtttgctttgttgaagattagttggctgtaagtatttggctttaatttctgggttctctattctgttccattggtctatgtgactatttttataccagtaccatgctgttttgttaactatagccttgtagtacaatttgaagttgagtaatgtgatgccttcaaatttgttctttttgtttagtcttgctttggctgcatggagtatttcttggttccataggaattttaggattcttttttctagttctgtgaagaattttgatggtattttgatgggaattgcattgcatctgtagattgcttttggcactaaggtcattttcacaatattgattctacccatccgtaagtgtgggatgtatttccacttgtttgtgtcatcaataatttctttcaatagtgttttgtagttttcctcatatagatttttcacgtccttggttaggtatattattaatattttattattattcttattttttgcagctgatgtaaaagggattgagttcttgatttgattctcagctttgtcattgttggtgtatgtcagtgctactgatttgtgtacattgattttgtatcctgaatctttactgaattcatttgtcagatttaggagctttttggatgagtatttagggttccctagatatacgatcatatcttcagtgaacagcaacagtttgtcttccactttacagatttggatgccgtttatttctttctcttgtctgattgctctggctaggacttccagtactatgttgcatagaagtggtgaaagtgaatatccttgtcttgttccagatctcaggggaaatgctttcaacttttctcccattcagtataatgtaggtggtgggtttgtcatagaaggcttttattaccttgaggtatgtcccttctatgccagtttcgctgaggtttttaatcataaagtgatgctagattttgtcaaatgctttttctgcatgtattcagatgatcatatatttgtttctaattgtctgtgtgatgtagcacatttgttgacttgcgtatgttaaaccatccctccatccctggtatgaaacccactagaacatggtgtgatatctttttgatatgctgttggattcagttagctagtattttgttgaggatttttgcatctgtgttcatcagggatattggtctgtagttttcttttttgttatgtcctttcctggttttggtattagggtgacactggtttcacagaatgatttagggagaatgccatcctttggaatagttttagtaagattaatattaattcttctttgaatgtttgatagagtttagctgtgaatgcgtctggtcctggagtgttttttgttggcagtttttttttaattactgtttcaatcttgctacttgttattggtctcttcagtttctatttcttcctgatttaatctaggagggttggattttatccatctcctctagattttctagtttgtgtgagcaaaggtgttcacagtagccttgaatgatcttttgaatttctatggtgtcagttgtaatatctcctgtttcatttctaattgagcttatttggatcttctctcttcttttcttggttaaccttactaatggtttctttattgtgtttatcttttcaaagaatcagctttttgttttatttattttttttgtatttttttgtttcaatttgttttagttctactctgatctttgttatttattttctttttctgagtttaggtttggtttgttcttgtttctctagttccctggggtgtgaccttagatattctatttgtgctcctgcagactttttgatgtaggcatttaatgctatgaactttcctcctagaaccacttttgctgtatcccagaggttttgaaaagttgtgtccctattatgagctttttccacccctttacctttagttagtgtgagtccttaggtgttagatgagtctctcaaacagtggatacttggttggtagatttttattcattctgtcattctgtattttttaagtcaagcatttaggccattcaattcaatgttagttttgagatgtgaggtactgttctattcatcatgttgttgcctaagtaccttgtatttttttctcattgtgttattgttttataggtcctgtgagatttatgtttcacggaggttctattttggtgtattttgaggttttatttcaagatttagaactccttttagcatttcttgtagtgctggcttggtactggcaaattctctaagcaattttttttttgtctgaaaaagactttatctcttcttcatttatgaagcttagttttgctggaaaattcttggctgataattattttttttcaggagactaaagataggaccccaaccccttttggcttgaaaagtttctgctaagaaatcagctgttaatctgataggttttcctttataggttacttgatgcttttgtctcacagctcttaaaattctttacttcatcttgactttagataacctgatgactgtgtgcgtaggtgaagatcattttgcaatgaatttcccaagtgttctttgagcttcttgtctaaatttctagatctttagtaagatgcctagatctagatgtctagatctttagttctttgagcttcttgtctagctgtctagatctttagtaaggccagtgaggttttcctcaattattccctcaaatatgtgttccaaacttttagatttttctttctcctcaggagcaccaattattcttagatttggtcatataacatattcccatatattttggaggctttgttaattttttaaaaattattttttctttgtttttatctgattgggttaattcaaaagccttgtctttgagctctgaagatctttcttctacttgttctagtctattgttgaaactttcccttgtgttttgtatttctttaagtgtgtctttcatttccagaaattataattttttttatggtatctatttctctggataatttttcatccatagcctgcattgttttttaaaatttctttaacttggttttcacctttctctggcatctccttgagtagcttaataatcaaccttctgaactttgagtagcttaataatcaaccttctgaatttatctgacaattcagatttcttcttggtttggatccattgctggggagctagtgtgatcttttgggggtgttatagaacctgttttgtcatgttatcagaattacttttttggttccttctcttttgggtagagtaatccagtagagaggtctgcaactaaaggcctgctgttcagattctcttgtcccatggggtgatcccttgatgtggtgctctcccactttcactacggatggggcttactgagagctagactacagtgattgttattgctcttcgggttttagccatccagtggggctaccaggctctaggctggtgctggagaatgtttgcaacaagtcctgtgatatgatccatcttcaggtctcccagctgtggataccagcacctgctctggtggaggtggcaggggagtaaaatagactctatgggagtccttggttgtaaatatgtttagtgtgcttactttctcgaatgctagttaacagtgaagctgtcacatggacagacaggacctctggttagctaggatgttgcaggcagtggaattacctgttgttttctctttcctgggagcaggattattccatcatgagttgctttaatggcctgagttggttggcctccagccaggaggtggcgctttcaagagagcatcagctgtggtagtagggggatataagcttgccctaagttgaccagggtaagtattctggtttctcaggtgattgatgggcaggtctacaaagctccggagtgtctgtcttttgtgttcagctaccagggttggtagagaaataccatcaggtgggggaagatttaggcaggtctgggctcagactcttcttgggtggggcttgctgcagccactgtgagggctggtagaggggcggtggttctcaggccaatggggttatgtttcagaggggattatggctgcctcttctgtgtcatatagttcaccagggaagtgggggatagctggtagtgaaaggtctcacccaacacccacgcagttggtgaggctggtcttgctcctgcagtgccccctgttcagatcttgcccaggtcataaagttcccactgagaaagaaaacatggctttcaggccttgccccctccctgtctgcccacattgtggtcagcagctcctgtgctcatatctgcagcagttcctggccaccccccagattttactcaagaaaatttgtgtccagttgaaattattacagatttcatttggaagcttggttcaccttgtgacccctccccagttctactcattgccttctttaaggatgcctataattataataagggatggcttccctggatttcagctggagattgggagtgcctagaaggctcttcctgctgctgcttctattttttattttgtgcagctccctaaatttgtttcagctctaggtaagtttaaatctttctcctgagatctggatattcagattcctcagtttgcatgtatgtttggaggccggtttttcccctctcacccttcgggaactcagttttttgtctgtctcccagagtttgcttcgtgtgccacttctttcaaaggatcaatgcattcttttgtttttttctggtatgtttctgtggtggttcttcaagcaaaagttcatggtgtgagtctccacacactgttctgtcattcgaagtgggagctacctcccctgtctcctatctgctatctccccgattttttttttttttttttttttttttgagttggagttttgctcttgtcacccaggctggagttcagtggtgccttctcagctcactgcaacctctacctcccaggctcaagcagttctcctgcctcagcctcctgagtagctggaactacaggatcacgccaccacgcccggcatttttttttttgtagttttagtagagacagagtttcaccatgttagacaggctggtctcaaactcctgacctcaggtgacctgcccgcctcagcctccctaagtgctgggattacaggcgtgaaccatcatgcctggccctgatgtgtttttttatttttaatttttttttgaggcagggtctcactctctaacccaggctgcagtgcagtggcatgttgccagctcactgcagcctcgacctcccaggctcaggtgatccttccacctcagtctcctgagtggctaggacccacaggcatgtgccaccacacctggctaatgagaaaaagaaaattaaatattaattaatgttattattaagagtatttattagaaaatatacttttaaaattaaatacctagcaatttcctaccatgtgctaggcactttttaaagcatgagggatataacagtgaagaaatcaaagacaaaaggcaaataagtaagtgtagagtacgttcaccttatataagttaagaaaattcgtgcatttaaatcaggaaaatatttctgctttgttttctctcaagaagcatatatttgaaattataggacgggagcggtggctcacgcctgtaatcccagtacttcgggaggccaaggcgggcggatcacgaggtcaggagatcgagaccatcctggctaacatggtgaaaccccgtctctactaaaaataaaaaaaaaattagctgggcgtggtggcgggcgcctgtagtcccagctactcgggaccctgaggcaggagaatggcgtgaacccaggaggtggagcttgcagtgagttgacatcgcgccattgcatgccagcctggggacagagtgagaaaaaaaaaattatatattgcgcttaattcctagtgaggatggatgactgccatttgagctgggtttttgtttttttttttttttaaagaatgatttcaaatacctaaaatttataatttaatccttctgtcagccttcctatacaggtactatttttatattttttatccagatgaggaaattgagacccaggaggttccggtaactcatttgtgatcacacattagctgttatggcagacataggatttgaactcaggagactatgcctgtggagcctgtggcttagactcactccaccttatgcatgtttcccctacttcacgaaagtggaaaggaataaataagtgcaacctgacagaaatacagcttctcttaagagacaccagaggacatctgccaatgtgtcttttgacaggtattttaaattaaccaggacagatggttgtcttgtcagttggtgaattccatttaatggaattttgatgatcctttcactcagaggaggctgctgaatacctagagttgagtatctggtagtctttttgtctgcttaaagagaatctgcaagaacatctgaattaaccatggggccacaatttaataggcagctatttcaatgtagcctttgtggatatttgacatgggctttcttgagaaagcattgtaggagaattagatctgtattgactacactgtctttcatgaatgttctgattctaattaggatttatctttacatattggggctaaattattttctgtgggaacacatctctaaaattaaaatgtaagtgaaaaaaagattcgatatgcaaatattttacttaaatacaactttctgtgaatgcagccaatgtatgaaataaagcacatgtagtgataagctaggctggctccagtctcatgcttacagtctgttaaaaaaatcgggcacagaaactgcctggcagcatgggctagcagagcaggcatggggccacgtgcctggggacccaagctctagccttcactattgacccctgggtatatcacttaacttttcctggccttagctctcagtcaaatggctatatagcttgacaaggaactattttacaaaacaaaataaaaatacacacaagcacaaaggatgctattagcaacaaccctgtagctgtctctcagaatcaacacatcttcacattttttcatatttgcctcgatctttaacaaaaaataattgcaaaataaatggaagttcccctcctggttcctttcctttatcaaccttgccagatgtcactattaatgtgattgaaagcattcgatccatgtccatgtacgtgtgtatgtatgtgtgcatgcttacatattaccacgtttgtatgtgtccatatacaagatagatagtagagagggcttatgtctagtggcaaaatgtgaagcctttggggacagactgcctacattcaaatcctagctatgactcttactagctgtgtaatcttgggcaatttccttaacttcttcacttcatttttaccatttgtaaatagagtgtctatttcatagtattgttctgtggattaagcaaattagttaatataatgtattagaacagcattgggtatgtagcaaacactcagtgagtgttaactgttgccttatgcggtttacaaaattatctaaatggcataatacaaatggattcctctgaaacttatcatttcactctccatttttcttttgaacacatttagatctagttcattagtttgaactactgcataataccacaatgtattcattcatttgctattgatgaaaacttggcttggttcagatttttgacaaacaatactgcaatatacatcttcatgcatacctccttgttcatggcttttaaattcttatggcacataccttaccacagaattctttaggaaatccttaattatccaacaactcattagtccaatcctatgcctggtcatcccaatgatggagataatactacattgtgaggcagcaaataatatttttggactgctctgttataagtaatttgaaggaagactaaatttggtttaatgcaatggtcttacgtttgtcccacctaaatcacttcagtcatgctggccacattttggttgcctgaatactccaagattttccctgactcatgccaccatttctgcttgccttttgcctggaagacctctttgtctttacacagttcctttacacaaggaactttacaacaaaagtttctgttccttataaatagaggttctatttacaaatgggaaaaatgaagtgaggaagttaaacaccttgcccaagattaaacagcaagtcagagtcttgactggggtttgaacttaggcagcttgtttgtttttctgtatctggctcttactcatcgtctctttttaacttaaatgttactttcttaaggactgtcttacctttgagggttccccattttgttatcaatcactacttcctgtttagtcattcagagttcttttcataaattgaaattacatatttttttggtctcctttaatttttgtcccccagtaaataataaataactccataaactctacttgttttgtcttccatcataaatcagtacccagcacaatgtgtgacactcaatgcaagtgcatatgttggtgttagtgtagcccctgtcacaatattaacttgtagtaaacttattgtggaccaaaaccccaaagaggtttgtttgtttttcacttgttcctgctaatctctgacttctcccttcttgagctcatgcagttagttttttggactcacatttatgtccttatgttcattaccattaaatttcattactatctataaaaggagagggttgaattaaataaccaaggtcactttctgcttctaaaaatgaaattggttattccagagcagcattatccaatagaactttctgtgatgatggaaaagatctatagctacactacccaatcctatagtcacaagccacacgtggctattgagtagttaaaatgtgactagtgcaactgagaagctggattttaaatttaaatttaagtagccacatgtggccagtggctgctttattgggtagtgccattctagaaaaacagtatcagaattttaaaagatgaaatggcatgcatagcatatggggagaaaccaacaagcagataggatggcctgtttagggtcagggtttatttattcatttttttttttttttatttaatagattaaaatattttttctttcactgagcatcagctatgtgctaggcacagtactgggtactgggatatagctttgaagaaggcagtcattacccttgctctcaagggtcttcctcttttaggtgtcaaacctaaaacatttcttcaaggtaagctatgagctcctggcaaaatgtattgctagtcttcagactggatttctgtgcatagtgtttttcatatctgtaatcttcgttagtctggattctagaacttaaggctctagaactcagccccagtacgatgaggagaacgaggggccaaatgttgatgaggcagaaggaatatcggcttggatctttcaaagaggagggaatttatggttgtatcattccatataggctggattgcactgtagctagtaccaagggctgatttctttacgtgttcattatgggacatctgggactcctggagcaagctgacagggcagcctttatgtagaactttgctggtgttctgacagaaggaaaagagagcatgatgaagcaggagctggcctcgaaagcatcttctagaagtgtatcccttttgcttaaagcaagttccatggctaagcaaggaagtggcctcccctaggaaaagacaacaaacatttgtgaatgataataaagtttattgtagtcttttcttctcatcacaaatatttggttcaatctctttttgattgagaaaatacactctcttctggcctttctctagggaggacaaacaaatgtcccatctaatcatggcaataggatcatagcccaggatcctgtgatgtgtctttctctaggtatttatttgattctcttgcttcaggtattcatgaaggaaaaaagcaaattatctgcttctcatattaaatattcattgtcagaacaaggccagaatatttaaatatactattaaaaacacacacacacacacacacacacacacacacatagttttggaaaaaggaagaatggaggatacacaatagttacttctagaaaaaatttgtgatttaatggaacagacattacaaggatccttaccttaaaagttgagcatgttctttagctccctggaaacagatctctagttcattgttttccatggcttatggtttcactttcttggggtccttctttttccattatagtcttgaaaaactctgtcagtccactctttacccatagaggttggaagcatgaggattattttatttcctaaacaatcattgactcttttagtctaagatagtgtgactgtttggctatgaaataagagtgaaacttggtgatttttatcatctatttaattccaatcagccatggtatgtaccaggaaccatactcacaattaattttgagtaccacaaacctatcaggatttaatggaaaaaccagactgttagtcacttttctttatctcgtccaactgaaaagattcactggtactaccttaatttgttcagatgctttaacaatgggtgggacatctatttccttgacttaatccttgcctcaaggctgagtttttttgttttgttttcaaggctgagatttaattggcctgcccaaagcctttttcaggtttatcttttattgctggagatgagaaaacgttgttgcttttgatactacaagctctggaatttctggactctatttcctttcattttcatttataaggtggccagttcattcctgttttttttttttttcttttgagatggagtcttgctctgtcacccaggctggagtgagtgcagtggtgcgatctcagctcactgcaacctctgcctgcagggttcaagcgattctcctgcctcagcctcccgagtagctgggactacaggcgtgcgccaccatacacgtttaattttttgtatttttagtagagacagggtttcaccatgctggccaggctggtcttgaactcctgaccttgtgatctgcctgcctcagcctcccaaagtgctgggattacagacatgagccactgtgcccagcctcttttctgttcttatcttgtattagtttgcaagggctgctctagcaaagtactgttgactaggtggcttagaaaacagaattttttctttccatttttggatgctaggagtccaaaatcaaggtattggtggagttggttccttctgagggctgtgagggaagggtctgttatggggctctctccctggcttgtagatggctgtcttctctctatgtctcttcaaatcattttccctctaagtggatctctatgttcaaatttcttctttttataaggataccagtcatactgggttagagctcaccctaccaacctcattttagcttcattacctctgtaaggccctatctctaaacaaagtaacattctgaggaattggagattaggacttcaacatatgaatttttggggggacacagttcagtgcataacacatctttttctcctggtctttgtctgatgcagccaatagtaaccaagacacactactttctgttttccaagctcatcaggtacattttcctcttccaatttatttaggatgacagctttagcaaatgtttcatccttgtgaagtatgaatcaaaatcagtctagcttccaacaatacagtctcctttctgcccactgcatggctccagaaaccaatgagatatagatatatattttgtgtatatatatatatatagtgtatatatatattttgtttatatatatattttgtttatatatatatatatttatttgtttgttgttgtgttgttatggtagtacctcacacttcctgtacgaattttgtatcaacaggaagactggatgttgttgcaacaaccctcaaatctcagtgacatacaatatcaagagtttatttcttgcttgtaatacatgttcatcatgaattgcctacctttctccttcacatttttcaccccctgggattcatgcaactgctataaggaggcttgctgttgctgtggcaaattgtgggaaaataagaaaggtgaagcatctactggcatttaaagctactgctcagaaatgatatgtgtcaattctgctcaaatttcattggccaaagtaagtcttatcgccaagccttaagttaaaggagatggaaagtacaattctcctctagggaggggcagcaaatatttgtgagcactgttggtcacagtctagcataatataatattttaatgtttttagaaaagttcggggagatagtagacagagtttaatgacttgacactaggtgagtgggaagactagggcaaagggtaaagagaaggactttggctttggcacagagatctaactgtagttaacaccagaagaatctatcctttatcagatgcttaacaggttaacatgtgagggtttgaagagttcttggcagagggggagggcggatagttggtgcaggctttgtattccaggacttcaagttgcagctctgccacttagtagctgtgtaaattttgtcatgttacttgacctttctgagtctctctttttttttttttttttttgagacaaagtcttgctccatcacccaggctggaatgcagtggtgtggatctcaactcactgcacctgcatctcccaggttcaagtgatcctcccgcctcagcctcccaagtagctgggattacaggtgtgtgccacaacacccagctaatttttgtatttttagtagagacgtgattttgctgtgttggccaggctggtcttgaactcctgacctcaagtgatctacttgcctcagccttccaaagtgctgggattacaggcatgagccaccatgcccggccctgagtctccattcctcacctctcaaagggaacagcagtgtcatccacctcacagtaatattttgagtaatatctctttacacagtagttgtatggaattgggcaacttggttatgtatacttcagtttcctcatctgtcacattgagataatactagtacacattttgtagggttattacaggatttagtgatttaaaacatttacgccaatgcttgtgataaatcctcaataaatggtaattattctcattgtagttagctgaggtgatacatgtaaagcttttagcacagtggcaggctcacagtgagaacacaataaatatgagacaatcattttctacactaacccttattaagaagtgcaagccgaagaagccagagtcagagaaataaagcagagaaggagggagaacaaatacaagagagttcattaccaagcaagccatagttgcctggcaagttgattactcagtctctgtatcagtctattctcacactgctataaagatactacctgagactgggtaatttataaagaaaggaggtttatttgactcacagttttgcttggctggggtggcctcaggaaagttacaattatggtggaaggtgaaggggaagcaaggcacatcttacataacagcaggagagagagagaatgaggaaacgccacactttaaaactatcagctctcataagaactcactcattatcatgagaacagcatgagagaaactgcccccatgatccagtcgcctcccctgacatgtggggattaccattcaagatgagatttgggtgggaatacagaaccaaaccatatcattctgcccctggcccctcccaaatctcatgtccttttcacatttcaaaatcaatcatgccttcctaactgttctgtaaagtcttaactcagtccagcattaactcaaaaatctaagtccaaagtatcatctgagataaggcaagtcccttctccctatgagcctgtaaaataaaaaacaaattagttactcccaacatacagtaggggtgcaggcattgggtaaatgttcccattccaaatgggagacattggccaaaacacaggggccacaggcctcctccaagtccagaatcctaaagggccctcagtaaatcttaaagctccagagtaatctcctttgacttcatgactcacattcagggcatgctgatacaacaggtgggttcccagggccttgggcagctgcacccgtgaagctctggagggtacagcccccagagctgctttcataggttggtgttgagtgcctgtggcttttccaagcacacagtggtaacctgttgctggatctatcattctggcatctagagaatggtggccctcttccatagctccattaggcagtgccccagtggggactctgtgggggggggctccaaccccacattttccttccacactggcctagcagaggttttccgtgagggctctgcccctgcagtagaattctacctgtacatccaggtgtttccatatatcctctgaaatctaggtggaggttcccaaacctcagctcttgacttctgcacacccacatgcccaacaccacatggaaactgccagggcttggggcttgcaccctctgaggccacagctcaagctgtaccttggtcccttttagccactgctggagctggagcagctggaaggcagggtgccatgtcctgaggctgcaccgagaagctggaaggcagtgtgccatgtcctgaggctgcacagagcagctgggccctgggcctggcctatgaagccatttttccctcctaggccttgggcctgtgatggaaggggttgccttgaagatctctgcaatgctgtggagacatgtttcccattatcttggcagttaacattcagctccttgttacttatgcaaatttctgcagccagcttgaacttctccccagaaaatgggtttttcttttctaccacatggtcaggctgcaaattttccaaacttatatagtctgcttcccttttaagcctaagttccaatttcagaccatctcttcgtgagcatatataactgaatgctttcagaataagacaggtcacctcttaaatgcttcgctggttagaaatttcttccaccaggtaccctaaatcatctcactcaagctgaaagtcccatagattcctagggcaggggaaaatgccaccagtctctttgctaaagcatagcatgagtgacctttattccagttcacagcaagttcttcatctccatccgagaccacctcggcctggacttcattgtccatatcattatcagcatttggtcaaaaccattcaacgagtctctaggacattccaaactttcccacatcttctttttttcttctgagccctctaaactgttctaacatcttcccattacccagttccaaagtcccttccacattttcagtttatctttatagcagtaccccactctgccggtaccaattatatgtattagtccattcttacactgttacaaagatactacctgacactgggtaatttataaagaaaggtttaattgactcacagttctgaatgactggggaagtttcaggaaacttacaatcatggtagaaggcaaaggggaagcaaggcacgtcttacatgttggcaggagagaaagagaatgaggaagtgccacactttaaaaccatcagctctcataagaactcactaaactgcccacataatccaatcacctccctcaacatgtggggattataatttgagatgagatttgggtggggacacagagccaaattatatctgtctccaggatgtttttaaagacaccatatgtagtcacagcatctccaaacagttcatgcagtaagggaggaagggagaaaaattcatctgttgactcccaactactattgttccaaatttcctacatgaaacatccacttccccagacttccaggttgcatgtgcctggatgccatatgagttctgagatatttcctgtgtcagtggcatcagggaagccccagagatggcatgaaagtaggtgaggaaccatcagagcaggcatgtgagcaacaggagtatctgagtacagtctccaaggcaggctgtaagtctgtggtgatgtggcggcagcaatctgctggatcaccgtgggaattgtgtaagctaatgagagggtgctctctggcttgaaagcaaagaaaatgcatgaatctggggttttatataaacatacttaccttttaagccccattttctcactttatatgtgaggaaataggtgctaatttggaaaaagttttatttagagttatacagcttgttaattgcagaataaaaattagaatccaggtcgtactaggaattagttttgatgttttctgatctctaggttgctagtttttgtttatttttccaacatttattttagattcagggggtccatgtgcaggtttgttacctaggtatattgtgtgatgctgaggtttgaagtatgaatgatcccatcatccaagtagtgagcatagtacccaaaagttagtttttcaactctttcttcctccttccccactctagtagtcctcagtgtctattgttgccatctttatgtccatgtttcccaatgtttagctcccagttgtgagaacatggagtattttgttttctgttcctttgttaatacatgtaggatagtggcctccagctgcatccatgttgctgcaaaggacatgatttcggtcttttttatgactgcataatattccatggcacatatataccacactttccttatctaatttaccactgatgggcacctaggtttagtccatgtctttgccattgggaatagcactgtgatgaacatgcaagcacatatgtcttttggtagaatgattttttttgggatatatacccagcaatgggattgttgcatcaaatggtagtttttttattaaaaatattttattgagacataatcataaagaaatgtgtacaaattataagtttacaacttgctgggtttatgcaaagtgaatacaactgtatagtcagtctctggactaagaaatacaatataccagcaccctagtcactagcaccggaaaagataaccataatctgacttctatcatcgattagttttgcatagtattgaactttacacaagttgaaccccacagtagaaaaatctttgttcctgctttaaaaaaaaaacactcaatattatgttaatacaatcaccaatatttttttcttttattttttaaattatactttaagttctagggtacatgtgcacaatgtgcaggtttgttacataggtatacatgtgccatgttggtttgctgcacccatcaactcatcatttacattaggtatttctcctaatgctgtccctcccccatccccccaccccatgacaggcctccatgtgtgatgttccctgccctgtgtccaagtgttctcattgttcagttcccacctatgagtgagaacatgcagtgtttggttttctgtccttgtgatagtttgcttagaatgatggtttccagcttcatccatgtccctgcaaaggacatgaactcatctttttttatggctgcatagtattccatggtgtatatgtgccacatttgcttaatccagtctatcattgatggacatttgggttggttccaagtttttgctattgtgaatagtgccgcaataaacctctgtgtgcatgtgtctttatagtagcatgatttataatcctttgggtatatacccagtaatgggatggctgggtcaaatggtacttctagttctagatcctagaggaatctccacactgtcttccacaatggttgaactagtttacagtctcaccaacagtgtaaaagtgttcctatttctccacatcctctccagcacctgttgtttcctaactttttaatgatcgccattttaactggtgtgagatggtatctcattgtggttttgatttgcatttctgtgattgccagtgatgatgagcattttttcatttatctgttggctgcataaatgtcttcttttgagaagtgtctgttcatatactttgcccactttttgatggggttgtttgattttttcttgtaaatttgttggcgttcattgtagattctggatattagccctttgtcagatgggtagattgtaaaattttctcccattctgtaggttgcctgttcactctgatggtagtttcttttgctgtgcagaaactctgtagtttaattagatcccatttgtcaattttggcttttgttgccattgcttttggtattttagtcatgaagcccttgcccatgcctatgtcctgaatggtattgcctaggttttcttctagggtttttatggttttaggtctaacatttaagtctttaatccatcttgaattaatttttgtataaggtgtaaggaagggatccagtttcagctttctacatatggctagccagttttcccggaacctcaaatggtagttttgttttaaattctttgagaaatctcctaactgctttccacagtgattgcactaatttacattcccaccaacagtgtataagtgttccatttttctccacagcctaactagcatttgttgttttttggctgtttaataatagttattctaactggtatgagatgctattttattgtggttttgatttgcatttctttaatgattagtcatgctgagcattttttcatatgtttgttggccgtttctatgtatcttttcgaggagtgtttgttcacgtcttttatgtgttttttaatggggttatttgttttttgcctgttcagttgtttaagttcctaatagattctggatcttagacctttgttggatgcataggttgtgaatattgtctcctgttctgtaaattgtctgtttactctgttgatagtttcttttgctgtgcagaagctctttagtttaattagcttctacttgtcaatttttgtttttgttgtaattgcattttaggacttagtcataaattcttacttttcaaggtcaatgtcgagaatggtgtttcctaggctttcttccatgattcatatagtttgatgtcttacatttaaatctttaatcaatattgagttaatttttgtaaatagtgaaaggtaggtgtctgatttcattctgcatgtggctagtcagctatctcatcatcatttattgaataggaaatcctttcttcattgcttatttttttttttcaactttgttaataattagatggctgtagatttgtggctttatttctgggttctctattctgttctcttggtctatgtgtctgtttttgtaccagtatcatgctgttttggttactgtagtctcatagtttgaagtgaggtaatgtgatgtttctggctttgttctttttgcttaggattgctttgactatggggctctatttttggttccatgtgaatttcatcatagtttttcctaattctgtgaaaaatgacattggttatttgatatgaatagtgttgaatctgtagattgctctgggcagtatggccatgttaatgatgttgattcttgcaatccaaaagaatggaatactttttcaaatctttgtgtcatctatgatttcctttaactgttttgcagtcctccttgtagaaatctttcacctccttggctagctgtattgctaggtattttattttttttatggctattataagtgggattacattcttgaattggctctcagcttgaacattattggtatataaaaatgctactgatttttttttaacattgattttgtgtcatgaaagcttgctgaaacagtttattagctcttatatccttttggcagtgtttttagggtttcctagatatagaattgtattgtcagtgaagagatagtttaacttcttttttgacctatttagatgcctcttatttttttctcttgtctgattgctctagctagcacttccaatactatgttgaacaggagtggtgagagtgagctttattatcttgtgacagttctcaaggggaatgcttctagtttttgcccattcagtatgatgttggttatggatttgtcatagatggcttttattattttgagttatgtccctttgatacctagtttcttgagggtttttatcataaagggatgttggattttatggaaagctttttctgtatatattgagatcatatgattttaaaaattctgtttgtgtggtgaattacatttattaatttgaatatgttgatagattgctagtttaattctatctcatcttcatccatccatcctttcatctatccatccattcatccactcacctatctccatggttaaagacctcccttatatctagtgctgggcaggtatttccacacagtaatggagtactaggagagaataactgtgagtcacttcttttgcctgactttatgctctcttctgctgtggcggttgggaaggcaagctgtctgtggagctgagccaatggggaggaaattggatgcactcaggatgtctgatagatggaatgactgtgttagtctgggccaagggaaagggaaagcagctgttccatctctggcttgagctccagtggattggctgtagcttcgaaatgtagagagaagatgaatttccaaggaggacacttggcttcgcttaatcatataggaccttagacacagcttccccgttgaaacaaataatcaaagaggactaatggctcactaactgcaaggtaccatgtaggaactgtgaattacaggcagatccaagtttgattcctgtcctttaagatatgaaagtatagttggaaaataagcaaatatgtaaaagattattaatattatactgttaaattagcagctaacagtattgtgcttgtctaagagacacctgttgtatcttagagatcttaacagtccatggagaagcatcagtgagcctgtaaactgcctgaaattgcatgtaaattttgtgtgtgtatgcattttactggggaaagggtctatttttgcatcatattcccaaagatgtgtgcagtctgtcacaaatttaagtccattgtatttcattctcatagcagtcttctttttcacatgagaaagccaatacccagagaggttaaatggcagaatcggtacttgaacctagacctctttgataccacaccttgggcttggctcatcttgctatggtgcactcctaccatagtagaggaaacagaggcaagcagtggttggtccattcccccagctttgatttgtacccacgaatggtgtgtgactgtgaccgctgctttgaacagaagtctgtgcttcagggtgaaagccagcaaggtttgggatcatttaaccttgagagcagcagactgaggatggcatgcttcctagtggatacctgaatgtgtaagacaaagatgatggcaggcagttttccctgacttcacagaggctggatgaggagtatagtttatacccaaggaagaacttcctaacttcaaagtggctactgagggagggattacattttcaaagcagccagatctggatatgtcttgaataattttgactgagattaggggaaggatacatagatctctgaagattttctttggtcattgttcttttctgtgattctaaatgcactttattttcctggtgtccagaagccagtggagagttaatcggtatgtatgagtcaggattctatgataatttcagctgcagctccaaaaggggcatttgacacctacactacttaacattgctgttcaccttgagaaacacagttctgcagacacctgaggaggtctgcacttatatggggcacccagggcttcagatactctgtgaatgtcttgacaccttgacaagctgcaaggctttagtgggcttaaagcactttggaaattacctgctgaggttctgttgcacaaattaagaccacataggaaattattatgttgggtttacttggctgatgcctgtggctgaatgaaagaaggggagagagtaggaacctttgcttctagcaataaagaactggagctaggttaggtagcttaggttagagggggcgtcactgtgagtgtgtgcattaaaggtggaattgtgtgtgtgagtgcatgcctatggctctgtaagtgtaaatgtgcagatgctcaatacccatgtgtctgcatgggcatgagtgtggggatgtgcctgagtatgaggctgttgggattatgtgtgcatagtaattaagacgtgggtttgaattccagacttacaattcacaagccgggtaggttaggtaacttacctctctgcacatcagttttcttatctgtcaagtcagaataataataaccacctcacagggttactataaggatgaaaataaaaaccatgtataaaaaatgctaagcatatgtccgggattagcaagtattgagtaaatggcagctgttgccatttgtagtgggagcaggtgtgcgcagatacatgtggtaaggatgtgcatatgtgtgggtaaacacgttggctttgtcctcagctgtcttagaagactctctgagtaaaagacttcccttcatgcaaaatcactggtgtgctctctaaaccaacttttctagagaagcatttcacaatgaggctcctctaatggagtcctctgggacccatcctttctaggacttgcctagctttctgctgggcttgttcagggttttggagtcttttttttctcactagtcatcattttccgagtcctttccctcggtggaaggaggaggtattctggaggaatgggtgatctgatttacactgggcccacttgctaccacctgagacctagatagaactttgccctttcttcctgcccattccctctttgttcttatgcttcatgaatctgaataaatgggagagaatatttgagttcctcctgtgttaagctccatctttaatcctcacttcagcttttcatggcctcagttgcctcttttactgcatggatttttgtccttttgttctgcactaatagtttggggtcctactgttgtttttctgataaggtaactaccagcagagtctagctggggaggaaatacagatatatgtgtaaagataatgagcattaatggtgtgcctgaatgactcccaggtggtgagtgctgttggaggtctgaggatttggagatcatttggggctggcaggatcctggaggatttgcagcaagaggggaaaagtgagtatggctgggaaaggctgagaagtgggggaaggcatatgaggcagcaggggatatgctgtcaagggacagtgtagatgccagtttgacatgagtaatgagttcatgtggcaagacagagagaaaatcctggaaagttaggttagagcttagctgtacaaagttttaagtacccggttttggagcttattgtcggcggggaggcatgggcttttgtatcatttagacctgagttcattcattaattcttttgtaagtcatttattgaaatgccaggtaccattccaggttctggtgatacagtggggaacacaaaggctagtctctacatttacagaacttacattctagtggattcaaaccctcgctttgttattttccagctgggtaaacttaaacaggttatttaacctttctaagtctcaatttgttcgattgtaaaatagggatagttggacctaaatgaaataatgtaaatcaaagggcctggtatatggctgctatccaagtgtgttagctccccgcttcctcttcctccctgccatccctcttcctctatcttccttccataggttttgagagtctttgttctctcctacatctgttgctctgacagaagagcactgtatcttctaacattcagctacaatttagcggtctccttaggtacttggcctaatgtatttgcttcctagaagtgacatctaattgatgtaggtcaagatggttcatcagtagtagaaattaacctgtaagtgcttgggaagttctccaggacaactgcaaattcagagcatagtctgagctcaagctggaccatgcctaaagagaacctagattaggagcttaggctgggagaagcaggaacagatgaggataggaagtagaatcagcagaggagaggatggggacaagaagaaataaaaaagtccccaggtgtagtgggaaattctaatggtaagagtggtccatatgtagaagtttattttttccttatgtatttgttgagtacctaccactgtgcagtcattgaggctacagcaatgaccaagagaataaattcccttatgaaggttgcataaaatcagaagagagagaaaacaaacacatgaacaaataaattacaagataatgttgaatagagacaaaggccattcgttcatttattcaatcaacaaaattttgagtgtctactctttactagttattgttttaggtgatgggactataacaagaaaagggacagtctttgccctcatggactttgcattctagcgtagacagtcaattaaccagtagacaaataaatatataataagactctgttagtgacaagtgctatgaagtaaaataaaggaaagcaacagagtacaggtgatagggatgtttttagatgaaatgcttagaaaagtcctcaagaaggagttaatattagggcagagacctacctgaggtgatggaagaagccatttcctactccaggagaaggacatcctgggtagatgaaacagcaagtatgaaggctccaagcttggtgagtttgaggaaaatgtagaagatcatggtgactaaagtagagaaggtgagaattgggagtagcaggagttaatgtcagagaggtaagcaggagacagatcatattgggccttagaggttatggagagaaatttagattttgttttccatgggtgggaagcagttggaggattttgagcaggacaatgatctatgattagtatttttgaaatatgactggctgcttttgtgtataaggtgaagaatgtaactagagagaccagataggaggagaggtgcaggaatccaggtgagatgatggctccgatgaggatcatcatgaaggatatggtgagaagtattcagatttgggatatatatattttataggtagagacaacaggatggattggatgtgatggattggatatggagtatgagggatcctgaggaatcaagactgcatttgtggtattaccattggaaagactaggggaggtgctgatatcattcagtcatctaaggtcatgttagatttgagaaatccattagatgtccacagggagatgtcaggaaggcattaggtcaaacaagtccagggttcagaggagagattgggctggaggtgtatttctggagttcatcagcacaagtgtgatatttgaggccaaggtggtgataagattatttagggcagcatctcttaaagtgtggttcttggagcaacaacagcagcagtggcccctggggatttgttagaaatccaatttctcaggcttctccctagaattactgaattagaaactttgggggtggggtctagataagttttaataattcctccaaccaattctggtggtaactgaaattaagtactggggagtgagatagagaggaggcctagactgatcccgggatctctagcaattagtattaggaagagaagaaggagccagcaaaggttactaagaagaaccaatttggaacttcaaagaaaaactcagaaagtgttttgcaatggatgctaagagtttaaggtggtgagcagtcgggtcaaatgctgctgagggttgacggagatgaggactaaaaattgtccaatggcttgggaaagatgaggattttattagtccattctcatgctactataaagaactacccaagactgggtaatttataaaggaaagaggtttaattgactcacgtttttgcatggctgggaggcctcaggaaacttacaatcatgacagaaggagaagcaaacatgttcttcttcacatgatgacaggaaggagaagtgccaagcagaggggaaaaagccccttataaaaccattatgtcttgtgagaacttactcactatcatgagaacagcagcatgggggtaactgcccgcatgattaaattacctccaaccaggtccctcctacaatatgtggggattatggaaactacaattcaagatgagatttgggtggggacagagccaaaccatatcaaggatctttttgcagccttgactggaacagtttcaatggagtggccagcatgaaaccttgtttgaagtaaggttaaaagagaaaggatggtaaagaaacagagacaagtatagccagctgtttatggggttagataaaaaggtacagtgacaaagagcagtagctgaatgctgactttgggtttagggagtttttgttttggaaggggagttttttcttaaggtcagagatattataacatatttgaaagtgggcaggggtcctgtagtagagtctgtaaagtatgatgcagtagaggggttgctaattgcaggaaggaaatccttgaataggagagaggggccgggatgccatatgtgagtgaggggactcattttaggagcagggtaagctgatccttggcatcaggaggaaagggagaggataatgaatatggatttatgaggttagtatacttgaagatgcaaagatgagctagttctgcctctattcttagtgaaataagaagtgaggtcatccactgagggcaagtggggggtgaaggtttgagtgagagaagaatgtgtgaaaagaggaaaataaatgaggccatgtgattggctagagcatgccttctcacatgctctccaaacactcacggtgggcaggtgagagggcagggcaggagaaagacagttagagcttctcctatatgggctactcctcttgccccagcagccacaggaagcccctggccgagcagagcaacctgtcagtgcacaagtgaggcaagcatagatgcctacgctgccctcactggggtaaaaagttaggcatttagcccagcgtcaaagctggcccctgtcatcatggtttaggataatctttaagttcaagaatcatcttggagtttctcattcagagaagatggtggtctgcttggtctgtggaatttctcaggcctgctctttattgtccattgtctaaaatacagcattactttatttacttcatcaaacattctgtacttattttttaaatcatgaagttctttattttcaccataacaagggatatatttctaaaatgtttaaaggaaaagttgataatttctggacccctaccctcctcccctccccctcccttcctctctcctttcatttttttgagacagagtcttgctctgtcacccagactggagtgcagtggtgtgatctcagctcactacaacctcttcctccctggttcaagcaattctcctgcctcagcctcccgagtagctgggattacaggcatgtgccaccatgcctggctaatttttgtgttttttatagatacggggtttcaccatgttgtccaggctggtctcaaactcctgacctcatgatctgcctgcctcggcctcccaaagtgctgggattacagatgtgagccaccgtgcttgcccccctttcctcttttctatacctctcctctccagtcctgtgtagccttcttccctacgttatttatttattttttacttacctgctcttatttttattatttctcctcattctagagctcacataggctctggagtctgatagcctggtgtgaatcctgccccccagtttgttattgttattctcctttaaaaataaccagagctccctgggtagaactgattacaaaatttggaacaggggtacatcaaggtggctctggggtatctgttttcagatatatctgagttagagcaaaaaagggccaagaggtaaactgaaagggctcccattggtcaatgtggaacaatttaattataaaaaagcaacaattattataattgataaaaataacttgctacaaaaaaatccatgaatacatgataatgctcaaaaagaatgtgaccctgagtcagtttttttaatgtgttgtgcctcagtttacatgtgtaaaacaggtagataatagtagtgtgtacctcatagtactgtggtaaggattaaggaatacagtgcctgcagagagattagcaagtgattgaaacatcatgcttaagtgtcagccatagttagcattattattattatacatctcctactactagcattattattagttgtattattccataatggtaatattattggttacagtctctactattaacattattattatttccaaagaatattctacaagatactatgataaatattccaagtacaaaaatttaaagtggagaaaaaatcaaatttactgagaactactattacctaggcactgtgcaatgctcagagttggaacgatcaggaattatagtttatgtttatacgtggatttgtttaatgttattcttccatactagatataagggccctgagtttagcttcctttaagttgtgatgttcactgctatatcccagttattggtatagtattcgttaagtaaacgaagtagtgaaaaacacccagaatcatctatcatctatgacacagtgtgagaaaatgtagcatagaagattgtaagatcacagccaatatttctgctgagagctagagggtgtgtgcgtgtgcacagctgtgcacgtgtgttttccaggtaagcatcccagaagaggatactccaagccctggtgggtggggggattttcatcaggttgagaggctggcaggaggcattctgagcagagatgcagtgctttacagagagcctggcacacaggagtgcacagtgctgagggactgagtggatgaatggaacaggcattgaggtgctgtcaggtcactgggtttgctggcttgctggggcacagggagtgcagatgatggggaatcactgatggttttaagcaggagcacttcagcttagatgcagggtcctgggagagactggtttgagctactgtggatcaaaatctgggtcactttgctgtttgtgttcacgttagaaaatttgatgttttcaaaaagactttttctttcttttcttcattcttttctgatggaattgaataatagcccaggttctggacttggacctggattcaagtcccagcttaggcaggactagcttcttgaccttggatcatgtccccacatgtaaagtgtaggaggaaatatctatttcccagggtattgtgaatcaccaatgaggtaatgcctggggaagaacttttcctgctagaggacgagaagccagatttgaaagatgggacctatttctttattcctcagagatggcagtgtacttggtctttaaccccaggaagtggagtcagactttgcttaatgtatttcttaaaggtgtgtttcctgttggaggagcaagcaagtcattgaggtgttagaactgggagcagagatacaagtagggctcttttagcaccttagagctgagttgtcctatataattgccgcaagctacatgtggctatttaaatttaaattgattaaaataaaagttaaaaattcaggtccttatttgcactagctacatttcaagtgctcagtaatcatgctgtattggctactgtgttggacagcacagctgtccttgtagaaagctctgttggacgcactgcctgacaaagagcagggaacacggcaacgttgatcagcagagctctgctaaaatcgtggtggtttggcagcaccttccagggcccgttgacattgtccagtgaggcctgcagaggacagagcccttgagtgaaagtgaaatgatgaaccgtcaatgttactatgttctttgtgctgtatttgcagatgggcaggatgcacaccacgttgtcaggttgcatcttgggagccaaatgctcaacattaaatgaatactgtctcttgctttcctgctgtgctttgttgctctttaaatgttcccagcagacaataatccagccgctgtctgcctgtatttacattttctgtcacgatagagagagtgggagctgtggcatggtaaaagcacttcaccatttctgtctttcccttgacagtgtcttctgagaatcctcagaaagtgaaagggatggaggtccttgctcaagtgacctgcaatgggatttgggtgggattcagctggataaattgccagtcatgttaatggacatgttcccgcactgccattccctgggcagagagacaaagtgacctcttctcactttctgcagggttcacaagaggatgtgcttaatatactgtagggggtagcatgagaaaggaagtagtgaaatggcctagaaaactcaagtggtctggaagcacggtttttaaaggagtcactcagagacatgcaacaaaacaaagagacaataaccaagatactttaccctcaagcgccatcgttataccaggaggaagattcagagagggaactatttattcactcaacaaatatttattgagtcactgccatttgccacatactattcttgtgcctaagttatagcagtaacaaataatctctgttctggtggaatttacatttcagtgagggaagaatagccaacacttattgagtgcagaccacatgctgggcacttttctagcccactcaatgcttataacaaccccctgagatgtacactattactgtcctcatttttcaaagggtcacttgcttggaattggcagaactggtcctggctacctggcttcctagtccacactcttgatcgtaccctgcactttactgtcactcctcaaactaggaaaggagaaggtcttcctggatgaagacagactgagcagtccctgccatctctgggagcaggaaccccatgtttaggacaggggactttgtaattggccttgcatttccccggtcccaggctcttgctcctctcctttggggcattttccaaacctgaagaatcctgaagctttctcagccttgtaataccattgagggcactgcaacttccatggttgcccctggccctggagtcccttagatctaggaatccttccctccttgatcctcaatggagagtccccttaacagattgctgctgatgctggtgtcccaagttgcagcatttgatttctttagccttaaataacttttcttaatgttgtcatgatgatgacaggaatatcagtgatgtcagaaatattctttttctagtacctccttggttgcaacaaagaaattcaaatctactttttctaatattttattttcattttcttttcattttatcttaattttattttttgtagagacagtatcttgctatgttgcctaggctggattcaaactcctgggcccaagtgatcctcctgcctcagcctcctgagtagctggtactacagctgggcaccaccatgcccagctctaatgttttattttctgttccttctgatgttccctttctgctttctgcagatttaacttttttaaaagggcttcaacctgctttttcagttccttctctgaactgacatgttttctggttctgagttttctcctctcctttacttctttctggcccctcccccaccccatcccccgttttaactttaagaacaaaaccaatttttaagctgcttctaatcctccctgggtttctgatgttctcattctaaagttcaaatagtagctttctgtgcacatgtgaattcctggagccttctcgcccctcatagtgtttttccctctgccttgatgcatgtctgattcttaatccacgtcccaaatacagaccatttagctttccctcctagaccccgggcttatgctattgccatttgtcttttctcctatctcaacttaagaaagtgtcatactgtgtcacctggcagaagggcttctattcatctctaactgctcacagatgatgacatttttccattgtgattaaactgacctccaggtctctgaagcctacaagcataatcaggacttatttaatattcctgattaggataaaaagggcagagacattttagaatcttccctgtcaagccaccaagaacatcatggtgtttcttttcatctctgtgaataatcctaagaacttttcagagattagagcttccttccttaaagagggattgctagtggtactgggtacttcaaagaaaatgtagatgagtcacccaaacccatcaaggttaattctacgatggaacactccaagtctttataaacttctctcaattttcagaattctgggaccgtgtttccacagagattagatggagtatttgtcaggggaactgatgaatacgtaattctgtgctcagttagccaccccttcctgcaaagtcctaagggaaatatatgatggagtcatgcttcttaaactttaatgtgtatatgaacctttcggggatcttgataacacatggattctgattcaggagattaggcattctgcatttctaacaagttcccagaagacactgatgctgcaggtctatggaccatactttgagcaacaaagggttagaggacaagaaaccagcgaaggagcattgttattactagctggggcttttctccatgctctggtgcattcctctattgaggaggactttgcagtaagaagggcttctttttccaagaggagactgttgtttacacctaggcatcagccaggctcttgcttggctctgttgggaatgaagtgctgtggcggacacatcctcccaagctggggaaagtgctgtgctatgtcttactgtaatggttataggtaaggaggagagttcaaagaggtagtagggggaaaccaagaggaaaatgactgaaatctttccaagcaagagcagaaattataatgcctttcctcgagactcagggatcttggctcccatgggtctactcattacctccccttatagcacactgaaaactccatctgtagtagtctgttctcacactgctaataaacacatatctgagactgggtaatttataaagaaaagatgtttaatagactcacagttccatgtggctaggaggcctcacaatcatggcagaaggtgaatgagaagcaaagtcatgtcttacatgacagcaggcaagagagcgtgtgcaggagaactcctctttgtaaaaccatcagatctcatgagacttattcactatcacaagaacagcatgggaaagacccacccccgtgattcaatgacctcctactgggtccctcccatgacatgtgggaattatgggagctacaattcaagatgagatttgagtgaggacacagccaaaccatatcaccgccttctgccccttgatatccctaacccatagcagtgctttttggaggtggaagagctgtggcaggtaggggagggaagagctcttcctttatattctattctttcacctagaatgtttctgtgtgcacattttcaatagatatatacatcaggtaatctacactgagctaatgtagcttctaaccaatctgtattcaaagactctagaaagctcaaagggcttgtagaaactattaaatccagtgactctgggtgggcacgggagctcacacctgtaatcccagcactttgggaggcctaggcaggtgtatcacttaaggtcaggagttcgagatcagcctggccaacatggtgatctcgccatctccactaaaaatacaaagattagccaggtgtgatggcgcacacctgtaatcctagctacttgggagactgaggtgggacaatccttgaacccggggggtggtggctgcagtgagccaagatcgtgccactgtactctagcctgtgtgatagagtgagactctgtcttaaaaaaaaaaatccagtgactctgaaacttttctgactaaaacctatttgtgcagggaacaagactcatcgcttatctgccaaacccaaccctactttctagacatgagttgttgtaacaatgagattactgtttacttttcctggtcttttctttattttcttttgtaattagttgtatatcttctttagccatcacctaaagctaggaatgaatcaaatttgagccttgagtcttctctaggtatcctgcttcagtccttgcctgctttcctcttaccccacagacccttatttccctgtaacctttgctggcttgtcctcagcttctgtatcttcaaatattgctctgagctctgtctcatcttctccacctcttcaggtgctctctggtcacatggctccaaatatcatctgtacactgatgacacttagatttatatttctaactcacaccacttccctgaaaggcagagttaaatatctaactggcaagctagcatctcaaacatggtatgccaaaactatccactctcctcaccactctggacatcttcttgccccaatcctaagccttttctatctcactaaacagctccatcatctactcagttactcaggcccaagatttaggggccattcttgaacactgttatgtttatgttcctcatctagtctattgattagtaccatctcctctacctccaaaaatatatcttcaattagatcacatctcactgtgtccatagccacaatcttattccaagctactatcatttcttgcttagaaaatcacaatagcctcctaactggtatcctgtcctccacttacgctccactctagtccatcctacaggcaacactcttatgctgaaaactgtccagtgacttaccactatgattaaaatgaagtgcaaactaaagacttttaaagttgtaaagttttaccttatctgactcctttctatctcatccatattattatactatttatcatccttgcttgtcataatcagaccagtcttctcactgtctgaacatgctatatcagtcagctattgctgtataacacactactctaaaactcaggagcatacattggtaagcatttattctctcttttataggactgcaagttgacggaatcagctaatctaggctgagcttgactgggagttcagctttaagttgttgggcttggctctttatagtagtttaagctcaaatctgctccataggtggtccttctggagcccagaatgatggggcagcacatactcagggcagactcttttctttgcaaggcggtagcccaggagggcaagcctattgcacagcatgttttaagcctttgcatatatcacatctatttatgctccattggccaaagtaaattcatacggtcaaactcaacatcaggggccatggtaatatgttctgtccacagtgggagtagggagggaatatatttgctgaatgacagtccagaccatgatactccaagcttgttcctgcctcagaagctcttttccttactgttccctctgcctggaatacagttgcccagatcttcacaagtctgccactcattatttagtttatgacttatgtgttacctccttagagacatctttgaggacctttgccttggctgaagaagccttctctctaccacattaccctattttatcttttccatcaccctttttttgaaaccaggtatcacttcatttacttgttttgttcatgtgtttattgtctgtagtcttctgctagaatgtacaattttgaacgacaggatgttatcttgttcacagaagtgttccagtgcctggaacagaacttgtcacataataggtgatcagtaaatatttgttttttgtccagccatctaatttttatatgccttaaagcccaactattgaaaattataagtctcacacattgatccaagtatgtatcaccacacatggtagaattaaccaaatgacccattacaatctaaatggataattatggagcttattaacatcaatttataagcaatcataacagcaatcgaaagccatgatcaactgaagatagcactgacattagtgtgttcttcctcaaaattgcgggctttaccaccatctgcacatgttcatacacagtaggaactttgaatgttgctaagtagttgagtcctgaataaactaaaagcacattaattttagttgactgttaacaaattacagtaacctacttagtaggttactagtaagtaatctttggctgtatacaaaatagcaccttgaaatgggatgccatttactcatgcaattaataaaaggagctttgtttttccatccagtttagacccatcaagacaacccttatggtctaccactgggtgtgggccacatttgaagggtgattgatctggtgcaatgccataatcttctagatgaggacattgaggctcaaagcagggaaatgacttgtccaagaacacataggaagtaatggctgaactatgaaatattttattcttgtcctctgactctgagcttagtgttctttctgcttctctgtgctggacctccatgtaaagtgaaaatatctttgcaaggaaaaagaatttcttacctgtctaaagtctgttaactctaattatttaactaataagaagataggtgagcaaggagagaaattatcctatttaaaaggggggaaactgagacactgaggagccaaacagtgacagagccccactagaatccatgtcttttgggtgagggaagacttctgtagtcacctggactgtggttgcagatactccctatcttttgacagtgtctgttggcagagggagaagcacagggtctgctggacctttgaccttacttcttactatagttcatagaatgaagttctttggaatcattacacaaaaatctccaagtttttcaagaactctaaggtgacatggatgagtggaaagatgtgatttggagtcagacagatttgggttcaaatccttctccccacttactaggtcagtaatcttaggcaagtaacttaaccactccaacctcagacttctaatctgtaagatggagatattaatattgtcctcccttcacatatgtagaaaagcatcgaagtatgtggcatacagagccacttaatagatagtggttatgattatttaaaagtggaattgtgacagatttcacacacacacacacacacacacacacacacacacacacacgtggaattgaacattgcccttttctcatcctattgtttttgccaagtgtgattttcagataaaggacattgaaggtgaaatcttatttacaagatatgttctagatcatttttagactgttttctcagtacactcaccagtttttacattgtttatttctctgtagtggttttggtaagtggaaatccaggatgtgtacgatacacagcttcccaggtagtttgttcctggttctacaccattatatcctgaaggctggaaacaaccttgaaaagacttttgtgccattcccatggctgaagttaacaacttgtgcacactattccaggctgataaaaccctttcattttctttgccctcgaaaggagaagtccctggtggtgactgcagttagctgattattggtctgctcccctttggctcacagatatgtcttgttcacaattacatgcctgacttcctttttatagaacacctggcacatataataatttttgagtattgcctcagagtgatgggttgtgctgaccaggaaggcaattgaattatttaaatagtgagaaaatgttaagtagtctgtgtgggcaatgtatctgtgtataaagatatatcaatgtatggttttgcatgtttgggaatattttgtacgatacattttattagtggaaacagaatgtgctgaatcttttgaaatatgcatctaaacatgatttcttcagcaagaggaacatgtcttggtcagcaagataactaggtcatctaggcatgatgaaaaggaagagctattcagtttggcaccctttcattcaaaagagagaaggaactgagatggaattcagatgtcttagtccattttctgttgattataacagaatttctgaaactgagtaaattataaagaaaagtaatttatttcttcagttatggaggctaagtccaaggttgaagactgcatctatacatccataaatggattaatctattcatgaaagcagaacccttatcacctagtcacttcctaaaggccccacctctcaatatgtcaatcttggaaattaaatttcaacatgcgttttggaggtgacaaatgttcacatcatagcagaaggcatttattgcagagggcagcacttgaggtcatgggattatatggggatacaagtgatctgagtatcagaggaaaaacctgagtttgtaagttttaggccttcttgagcatggcagctgtgtatggtttcccttgcttgagctatagttgggaactgcatgtcctcaagctatgtgtcttcatttgttctgtctgttggcatcactgaatgaaggaaaagctggctggggaggtggggaaatttgtattcttagtggctttctgatgggttggattgcaaagctccaattactttctttacccttgccatagctaaagaggggtgagcttctactaagagttagccctccaacatgtcagttcagatgcaaaaccttcattctatagccaaaatttttgtcctcttgctccatctgcagtggaattaggaaacccagtattcccttaatgacttagtgttgcacctaggatagaccacctaagaatcattaggtggtctttgtgatatggtttctgtctacatgtccagcagtgtcttaccactcacctccctgcttcctgtactccagccacattgaggtccttttgattccttgaatacctcatattccctcatgcctcttgggtacattttagatattttgtctgcaagtaactgccaacactcaattagcttaagtatctataaaatttatttatttcagtagcttttgggatacaaagtagtttttggttacgtggattaattgtacagtggtaaagtcagagattttagtgtacccatcatctgagtagtgtacattgtacccagtatgtagtttttttaattccttattccccttcccacccttctgccttctcagtctccaaaatttattataaattttgtatgcctttgcatacccatagcttatctctcacttataagtaagaactcatggtattttgattttccattcctgagttacttcacttagaacattggcctccggctccattcaagttgctgtaaaagacattattttgttctttttatggctaaatagtattccatagtatatgcgtgtatatatataattttctttatccactcatcagttgatgggcacttaggttggttccatgtctttgcaattgcgtattggagcatattctatcatccatccatccatccatccatccatccacccagccacccatccatccatccatccatccatccatccatccatccatccatccatattttgacatatatttactgaggggctgttataccctaggaattgttttaagcaatagggttagaatggagaacaaagcagacaaaacctctactctcatgggatttataatccagtgatagaaacagacgttaaatgattataagtaatgcagctattctagggctgtttgatcttggttgagtgataattctttgtacagttagcttttagggcagggatggaagaaagcaggggatgtcacacagtatagtgaacagctgggactatggcgggcgagaaattactagcacgttttgtaaaagagcaaaaaagttcaatgttttcatattttttctcttttaaaaattaaggtataggttgtgtactgtgtctcacgtctgtaatcccagcactttgggaggtcaaggtcggtggatgcttgagcccaggagttcaagacaagcctgggtaacacaatgagacctcatctctacaaaacattaaaaaaaattatccaggcatagtggtatgtgcttgtggaccaagctacttgggaggctgaggtaggaggaatgcttgagcctaggaggttgaggctgcagtaagctgtgttcatgccaccacgcttcagcttgggtgacagagaaagaccctttctcaaaaataactaaataaaataacataaaattaaggtgtaattagcatacaataaaatgagtagatattaactgttattgatgagtttttataattttatacacccataaaaccatcaccctctaaataaaaatatttttattatcccttcctgacacttcatctaccccccactatttagctttgcctgtccttgaactttagatgaatagaatactactattcactatactttttgtatttgctttcatttttctcaacataaaatttttagatgtagccatgttgcatatatcagtggcttatttttattgtcagctagttttccattgtatgaaaatattatttattttgggtaaatatttaggagtggaattgctgggacagagagtagatgtaactttataagaaaccgccaacgagttctccaaagtggttatttattttacaatcctatcattaatgtataggagttgcagttgctatattctccaacattcagtattgtcagtccctttgattttagccattcaaacgtatatttagtattatctctttgtggtttaaatttgtatttccccgatgactaatgatgtttagcatcttttcacgtgtgttttgtttttattcctatgtctcagtgcagggtccattaaagtcttttcttcattattattatttaaaaaatggacttgtaggagttctttattctggctgcaagttctttttcagatagatgcattgcaggtacttttcttacagtctctggcttatctattcatattcttgctggtatttctcatgaacagaaatgttaaattttgatgaagcccagtatatatattttttcttttgtggctttttgtgtcttttctaagacatcatttcctactttaaagccatgaagaaattttatcttgtagaaatttatggcttttatgtttagtatataatgtacctcggaattattattattattattattattattttatcattttgagacagggttctcattctgtcacgtcactcaggctggctgcaatggcaagatcatggctcactgtacccttgaattcttgggctcaggtgatcctcccgtctcaacctccccagtagctaggaatacaggtgcacaccaccacacctggctaattttttgtattttttgtagagatggggtttcacaatgttgctcaggctggtctttaactcctgatctcaaggaatccacctaatttagcctcccaaagtgttgggattacaggcgtgagacaccatgcccagcctggaattaatttttgtgtgtgatataaaataatggttggggttcagcttttaaaacacagctccccagatgttctggcactatgtgttgaaaagacttttcctatttcattgactttgtcaaaaattatttgtctatgtgtgtgtgtgtgtgtttgtgtgtgtgtgtgtatatatgaatctatttctattccgctgatctatagcttatccttatgctaataccacactttgctattactgcagttttatggtaaatactgaaatcaggcagtagaagaattccaacttttttttttttatgactgcttttctcttctaggttcttttcattttaatttacattttaaaataagttgtcaatttctttaaaaaattttgctggtattttgatttggattgcattaaatctatgcatcaattttggataatgcacatcttaaaaatatttttaatactaatacaatattgagttttccatgactcaatccatcaacattgtctatcattccatcaatttaggtttctttaatatctctcagcattgttttgtagtttttagtgtagagatgttgcacattttctgttggatttattctttttcttttggagttggggtctcactctgttgcccaggccggagtgtgatggcatgaccatggcttactggagccttgaactcctgggctcaagtgatgctcccactccagccttcttagtagctgggactacagacacatgccaccatgcctggctaagttaaaaaaaaaaaaaaaaaactctttttagagatgaagtcttgctgtgttgctcaggctggttttgagctcctggcctcaagcaatcctcctgcctcagccttctgagtcattgggattacagacgttaatcaccatggccagctttttgttggatttattttttaatattagatttttaatgctaatttaaatggtattacacttaactttcatttttattgtttattactatttcatagaattgcaattaacttttatatattggccattcatcttgaaattctgctgaatccactgattttggtagtttttttcttttttaatgtggcagattctataaggttttcttcatttacagtgttgtcatctgtaaacaatagcagtcttacttttctcatcttttatcttttatttcttttcttgccttattgcactgatcagtacttacagtacagtggtaaatagaaatgatgctgaatatttttattccaattttagttgaaagcattcaatatttcatcaagtctgatgttacctgtagatttttttgtagatgccctgtatcagaatgagttgtcatgtattcctactttgctgagagatttaaaaaataaaatccttggccaggtgtggtggctcacacctataatcccagcagtttgggaggccgaggcaggcggatcacctgaggttgggagttcgagaccagcctgaccaacatggagaaaccccatctctactaaaaatacaaaattagctgggcgtggtggtgcatgcctgtaatcccagctacttgggaggctgaggcaggagaatcacttgaacccaggaggtggaggttgcggtgagccaggatcgcaccattgcactccagcctcagcaacaagagtgaaactccatctctaaataaataaataaatacataaaatccttaagaatggtgcattttgtcaagtgtcttttttgcatctgttgagaaaacctggcaccaactctagttcaagtcagctttggaagtagtcatttcaacagtaggagctgtaagagggcaaaaatttataaacatggtttgtaaagatggcaaagaaaaactgacttttctttgagaattttctctgtaaaataaagttataactggtgagaccacaacattacttttcactcaaattattgtccttgaagcagaaaattttgtatatggcccacgtatcagaaattaccataattttaagatcttatcattaactatgtctgggtgaagtagaagaaaaaggaaaaaatgggtgctgtgcttgaaatagaagctataacattaacagatgacacacacacacacttttccttatttgattcaatttttccttccggaagaatggtcttaatacagtacagtataaagcaaacaggagaaagaaaaaattaagccctaatttggttataacaggaagagggcctcaatgtgctttaaacaatttctaatcctgagcccagatgaatctcatccaaagaaacagaacaaatttagttttggtcatccaacttctatgctataatcttagaaaaatcaaggagagtgagggatgtgctaatggcttctatgctatctgtccttattatttttaatggagaaattttgtattccaaaaagcataggatagcagagcctagtgatcttaatatctcttcttggtaaaattctgaattaaagaaattaaacagatggtaacattagaaatgattcactctgctggagctagttcaagaatacactcatatgtcatattttttttcctcatggctttttgaaccctggaaggtggaatcagttcagtttggtctttgtgcccctacattaatcacatttgagtctagctctaactacatattttcttgtaatttgtatttttaggtgccggtctccttcattaggccaccacctctttaaaaaccagggccaagtctaaaagatcaatagccaattcaaaatggcttaagtaaaagggagaaattaattagctcttgttattaaagttagtgttggatgtaacctgcatcctcctggaataaggtgctccaatgatgtcatcatggcttaatctcactttctctccatctctttgctccactctgtcttgggctggctatatttaggcaggctgtccccataggagcaaagtggtccctaggatcccaggcttatatcatattttctcaggaattccagttggaagatgctactcaagttgtttgctttgttttgttttgttttgttttcatcaataagcagaacaaaacttctggaactgtgtctcattggtttgtcatggggcatatacacatccttaagccaaatatgtggtcaagaggatggacggtgttgatggaccagacctgaaccccatgcctacccatagagttgcagggtggagtgaacacctgcatcatatgggctgaaagtgggtgagtggtggatctccagaggaaaatcactgtgtagctaccaaaaaagagggagtacatgacaagcaggaaaaataaattcaagtacctccaggttctggactaagttatctattgctatctcacagacaagttgactttgatttcagtagggcctttaacagtgtctcagaaataagacagttaaatgtgagcgtgttgataatatagttaggcagatttatagtttactgaacaaacatatcctaagaatgttgattcatgaattgatgttgacctgaaggatgaaccctagggccatgctatgtggtttgtatatataatttctgggctgacatttctcatcagcaacttgcacgaacacgtcacagttgtatttgtcaaatgtttaggtcacctgctcctagaattttgggtttcacagtcttggaaaattgtagaaaaaattatttaggaaattatgcagggtctccaactttttatttttgccaaggaaggatgtacatatattaactgtgatctattcatttcactaacattttactaagatatgacattttaatatttaaaaaagtatatgatgtcataagaaaagacagttccaagaaaggaaatttggctgccttatactgacattaaaataaaataatgtaatggatataacacaaacaatcgtaacataagaattcaattttcaaaattacagtgaatctcatttctgtaattttctctctgaagatttgtcatttggagatcatagactggagccttaatgttagcctgtggatttgattgtcttttagacttagtgaaaagttcaggtccatatagctctgctgacaaaaatagaagaaccacactcttaatgctgttttattcaattcaaatatttcgcattatacagagagtggttgagaaacaacttccccaaccccaagccacatacatgtacatatctggcctgactcatcatcagccgtttctgctccctccttttccctgcaggggagggaagaagctgtggtacccggcagtaagatgtgcgggaagtatgatagggggcgctgttacttagagggctgctctcacctgagtgctcaggtaaaaacccagctcattttgactgaagcaggcagaaaactagctgagagaatgctgccaatcaccagcatcctggatccagttgtagtcgcctatttgggagctgctgctggaagtaatgaagagctgagagaaattgctccttcactgaatgttagaaccaagcctctcatttcattatctccatggactgtaaccagaaaccaaaactgaaaggatggaatttcataggggttaatataaagttcttccaaggggtctaacacctcagctgtacaacaacaagccaaacttgagagcatttcatgtaaaaaagacctgtgtgggtttttgtttttttttgtttttgtttttgtttttttttttttgagacagaatctggctgttacccaagctggagtacagtggcacgatctcagctcactgcaacctctgtctcctgggttcaagcgattctcctgcctcagcctcccgagtaactgagattacaggcatgagccaccaggcctggctaatttttctatttttagtagagatggggtttcaccatgttggccaggctggtattgaactcctgacctcaggtgatccacccaccttggcatcccaaagtgctgggattataggcatgagccaccacgcccagccagacctgcggtttttttttttttttttttttttttttttttttttttttttttatgagacggagtctcgctctgtctcccaggctggagtgcagtggcgtgatctcggctcactgcaagctctgcctgccgggttcatgccattttcctgcctcagcctcccgagtagctgggactacaggtgcccgccaccacacccggctaattttttgtatttttagtggagacggggtttcaccgtggtctcgatctcctgacctcgtgatccgcctgcctcggccccccaaagtgctgggattacaggcgtgagccaccgcgcctggccagacctgcattgtttaatcgagtcaagttcaatatgatccagaggagtctatgtcatctatcttaggccacctgaatagggacataatgtccagatcatgggagatgatagttgcactagagcagagttactgatattttaggtcagataattccttttttatttatttatttttttgagatggagtctcactctttcgcccaggctggagtgcagtggtgctatctaggctcactgaaagctccgcctcctgggttcacgccattctcctgcctcagcctcctgagtagctgggacttataggcacctgagatggcgccgggctaattttttgtaattttttttttttttttttttttttttagtagagacagggtttcaccatgctagccaggatggtctggatctcctgacctcgtgatccgcccaccttggcctccgaaagtgctgggattacaggcgtgagccaccacaccaggccagaaaattcttttttgatggggtctatcttatgctttgtgcattaacagcatcccgggcctccacccactcactgccggtaggttcccccagatgtggcaaccaaaatatttccagatactgccacatatccctgagagaggggggaaatgcctctagttaagaaccattgcactagactccatagtggagctcgtattcagttctgggcaatgcattttacgaggaaaattcacaaactggtaaagtccagaggaattgcatggaccagggtgagatgtatgaacaccatatcactagtatattggaggaactaagactgttcagactggaagagaacagactctggtggtggtgatagagatagatgttggggaaggatatcccagctttacctccatccttccttctctttcttctttctctcccaactttttttctctgtaactcctttctttcttcccctttctcttttctctggcttcattttcctttacacttagttttttttttttaaatataattttaaaattgtgataccatatatatatgtaccattcagtgacattaattacattcacaatgttgtgcaataatcaccactatttccaaaattttttatcaccccaatcagaattcactcagttttatcttcctaccccatcactgggtatagagagacttctcctggctgccttactataatcccccaccttgggtaaattccaccatccatgctcagtaggaatggtgagactcagctgcttacagcctttcaaatttctattagccagctttagctggactcttattatcttcctttggtgcttatatatcccaaatgctttctgaccctatatacataccagagcatctgtttcaaacctttccatttttcttatttggctcactcttttactgcccataaccttgcctttatctcagtaaaaatttaggttatgtgaaatgagtttccttaactcttttttcctctggaattccaccgtcatcacctctcttctcatcctttaggctcagcctctgagagccatgtgattgtcttcctttctaaaccgattttacctaagcccatggaatctcctgcctccaaaacctgatttgagagccatgttctcctttttttgcaattttggtatgttccttctatttcctcttaacatgctgtcttagtcagcttaggctgccataacaaatcatagaacttgatggcttaaacaacagaaatttaacagttttagaggctgagaagtccaagattagggtttcagcatggtcaggttctggtgagaaccttccccctggtttgcagatagcctcctccttgctctatcttcacatggcagagagagaggggccaagctccctggtctcttcttgtaagggcacttattccatcacgacggctttgtctaacctaattaccttccaaaggccttgtctccaaataccatcatattgagggcttcaacatacgaattttggggtgatggaattctgtccctgcctcctaaaattcaaaacatcccttcaccctgatatccccttatactgtcactaatctccctcttctccaggtcatactctaagctgtggcaggcattgtcctcccacgagacccatcatggtgtcgcctgattcagaatgtgtcctgtggcctaataaatccaaactccttagcatgacatttgagaacttccatgaatctggctccaaaccacttttctcatcttccactacatcacgctcctgattctaagttcttcctatcctactgacccttagtgtatgctaagctaaggagaggcattttgagttagaaccaactgacaatagagagaggttgtatcaggggtagtgagtgcctgtccctgaaaatgttcaaaccaaagccaggaaaacaatccctcagagttattgtagagagaattcccaaagtagtgggaagatggttagaggtcctctcaggccagatttcttagtgttggtacttgacatttgaggctagataattctttgttgtggggagctatcctgtgcattgtagatgtttagcagtattcttgactgctactcactagattacagtagtgcccctaagtggtgggaatgataaatgtctcaagacattgccagatgtcccctgggggcaaaactcagttgaggatgactgttttagagtctcttctattaataagaatctgtaacattttgttcttctattttctaggtaataagtacttaaaaaattggtggaagtacctaaggttgggagaatgaagggaaagatgagaaggaactgatgttcgttgagcctaccatataccacgaaaatctgtgagatagagaattttatcccatcttacagatgaggaacttgaggctcagaaaaattatgcagctgttaagcagtgtagctaagtcccaaatgtggacctgcctgacaaactctgtcttcctctactttcctcttgcttttatctaaatgtatctccattgcttttaactcaactcttacattaacctgcctccctttatgaactacacatttaaaatttgggagtattttggtatttgcttcttgtaattaacttttccatagagccttggctcaacactctcctatagggctgacctggagtctcagacattgaaaggatccatggtccacgtggaagaagaagatcacattgaaatgctgtacacttctacttaatgctgctaatggtttgttgtgagactcagtgtcaccaggattcacaaacccgtgaataccaatggaactacagtattgctaataaccataaaacatctattcttgcatcattctgtccaagcataacctctcgtgttttgtgcgtcatctcaggaatctaagtctttctggggttccttctagggcatctcaccactcagtccgacagcttcatccaccactgggcaggttgttctctcttctcaactctggccagttcaagaagctgctggaggaggtttgtcattgccagggctgatagaatcctctctaaatcaccacctctgtccagggtgctgcgcctgattggcctccagagatgcaggtctttagagatactgttggagacagaggtgtcctccccactttgaccagaatccagccctctgggggagcagagtgttcctgggtccagaaggactcttactccaattacaccacactttgtttcctggactctatccctgctttgcccagaatccacagaatctcttaaggaactatcctgtctcctgtgtgttcttatacctctaaacatagtggctccaaccctgcccaaaggcctggggaggagagagagatacttcattctctccctacaggctactatcataatgaaaaaagagaaacactccctttcctctccccagatgccaaacaaaggtctcagaacatatagcggctatatggtgtgggttgggaggtaggttgcttacagctatagcactgggcctcaacttagctggccaccatgccctcttaggcaaatgaaaagaggagattgacactagattggagaaatgccaacatttttgcaccatcagtgaaagatttcagctggagtgtatgtagccgtaatgttgttctcaagtgtgtttaactcatccttttggttgacttaactagtgtggctggtccaattctctgctactcagtctgtgtccaggatgccactgatcagccagctttagagttgtgaaaggagagcccaagagacatttgggtacacactggtactggcacaaatgcagattactaatagttttatgttccagaccatgagcccctagactttttctgggaaaagtgaatctaatgactgttgtagtttctctgtcctcaagggcatggatggaagaaggcacatggagtgtgtccagccagtggaggacagagagggaatgattaattagggcttacggtgatggatgtcagctcctagatctatcaggcaagaccttgagatttccatctgggattctttgaaataaaaataagatttcttaggatttcaagcaagattggtataggcatacattcagctagtttggaaatctttttatctttctactttatttttaccactaaatctgaagtatggtgcctaatcccatttgactgtgtctgttaaagatttaaatgccactgccagattcccaggtctcacttggcccctttggaaaatcgggtctggtggaaggaaaactcggcccaacatctctaaatgcgcagcttctcagagtgccaaaagccgctattgtgtgctgtcccgcgggtataaaaattagctctttttcatgagtgttcaagctgctgccttatttatctgccaaagattcagactcatcttgctgtccaaactgcaggcatgtctggcatgagagtgtgtttgaggttgtgaggtggtggaggaggaagaattttattttgcatctgcacataaccactgttgggttgcctgttgtcatgaagtgtcaatggtaaggtgcagtttaacataacatgacattaggttagacaatgtgactaaactcaccccctcaggaactatagcctcaatacagtagccagtcacttgggcttaagacttgttctagtggatacaagcagtcacagttcaaggctacctggcgtcttggagcacctgcactacctgggtgaagagaaaaaaaatgtggagttgcagtcttcagaaatagttaccagtgtgcatctgcacagtaaacttatgaaaatacaacatacgcttcaagctttttgcattctgcttttcttgagaataccagggttcattttcttgaggaatgtcagaaatattttgtagtctcagcttaatcttagatttgtttgtaaagctccacaaacaaacccacaacttgggaagtttggcaaatgctcagtccaggagatctaaatcttgactcagttcttcaagttttagcgaaggaatgactttaaaatgtcttcttgcttttacatattttgaaacaaactctgggagaaaatgtatttggaagggatcttggaagctagctggttttgcatgtgtgataaaacaagatgcttataggtttgctttaaaaaaataaaacctcgaaacttgaagtctgatatccctggggccatttgataaatgttgatggttttgcagagccacacattatttccttttccttttcacatttatttctttgaaagacatacgagagtctgaactttgaagggacctggtagcctttgctaagaaaaggaaacttctcgggagagaaccttgtgagtgccttaaatatctttccaggtgggcaccatcacatgagtgatttttccgatgtaaagttgcccactttgtggattagtctgtggtctgaccatgtctcttagagtcaattgtttgatgtgttgtttcaagccaggttcatatggagcagagtgccctttggttttttatttgttccctaattgtttagaaatgtgctcattaaaagacaaagtaaacacggttcaggtgttgtgctgaaggcagggattgtggggtattgcgagggagacaggagagatgagagaacacacgtggtccttcttttagataaaagcctgtcccagaaacaaaggctgttggaatacaaaagctctttgtacactgagcacgtctgcggttacggatgaaccctctccaatggctgctatcaaacttgtcatattttattcatgagttgtggtgtgcctggatgaaataagaaaagcaaagcttcaaatcataattagggcataaaaaagataaaatagttattattttgacatttttgaagaatttttaaatctccccgataattcatttgaaaaagttgcatggaacgactgggtgtgtggcatgtatttatgctggttggagtctcagtcacacccatacccacagtgacagactccatgcgtatggtgaataagagcgtaattaaggagagggctacagccatcgttacacataaatagaaacgttgacaggcatctttgcatttctcacgctcacattattattctgtggttgatcaaaatattgctttcctgttttttacatttttgtcttttttagagaacatggggtctggatcatttggtatgcctggtatggggggacttgagggaatagtggcaggaaaaacttaaaagtatacctgcacctacagatgttgtgggacagcagcacggggttgaagaaagacactcgtcctgttggtttacatcatgaatttttaaaagtaagccgaaacactttaaaaaaagatacgccaaccttactggaaagacaaaaaagcccaactgttgttccatggctttctctgtggatgcagggcttagtgactcctcatttattgactaacttacccggagacacctatcacccacaccatccatatgctcatggcctctctcctccctggggattcggcgtgaggtatttatttactcagggtttatctttgtcctgctggggtctatccacccattctcactgctgggttgtaagctatttgagaagcgtggtaagagcaagccctcccactgtagccaccgcatgtacccagcctgcatggggttgtcctaccctggcactcaggcatggaggaaagtgagagcgacattttcaaaactggtcatgtgcatgatcacatgtgttaatatttgttgtgtggattctgggatagaaatattctcattagtcaccactttatgaaggagacaccaagattcagagggattaaatgaccacccagatattagtgttggagtattaaatatcacccagatactaagtggcaggactgatggtgcatcccagatcttctgatccccaattctacttcaacactggaccacgttctgtgacctttttcatatcatgacacataaggaaaatggctgtatttgtacattacacggaaggaaagagaagggactgtttttatgccaaaagtgctctgccgagccacagcgagggctgagggactcatactacagtgacacctgtaactcaggccctggcaggccagctgagaagcaccagggtgaggctggcgagcctagaggggctgggaagaacctggaagggcaggaatggagggggtttgtgtggggcctgggtgagtgtgtgtagtattagcataagttagagatgtgctggggagggtcttcaatcccaggtgcatagggggccagccaggtaacagctgagtgatgtgcactggcaaggtaatgcagccaactggcaacattgtgccatgagctgcatttcttcaactctgcattcactgcactgttgcctgtgggaatatgggctctgcgttgccaggtcatctaattttttaatggagatttgaatttttatatgaaatgtttcaatttttatgctgtatttcactgattccaaggcacacacacttattcacataacagctatccagaacttttttattttgcaaactgaaatgctatatccattaaataataactatattttagggtaggattggattttgccttataggcaattggtataattatgtaataaattacatatgtgttacaattatggtgtctcttataatcaacagctttttgtttatttcttagggtatgtcaaatgatggtgtattttataatctatggcactgtggacttggtgaaatatggtgggttgggtgagtaacactgggagctacaccaacatgctgaggctgcatctggcctgaggctggtcagtatgctacttttgacctggagccaggatagtcaccaagataccaagacctgaggctgggacaccagttctcagctgtgactgcccatcatgtttatttgaaacaaataaataaatattgacacctggcctacaccccagacctttttttttttttttgagtctctcagggtgcagactgaaaatcacatttaaaaaatgttacccaggtgattctgatgcacagtgagtgctgagaactgctcagctggagggagttgggaggaggaaaaggtgagatgttgagtctgtgttcacaaaaggctgagggggaaggaaactacacgtgagagtcaggtatttgttgatcttgttgaccaaaatctccaatcaaggaatgagaactgggggctgctgtttaaattggaatgagggctgggaaggatgactcatgcctgtaatcccagcactttgggaagccaaggcaggaggatcacttgaggtcaggggttcaacaccagactaagcaacatagcaagatgtctctacaaaatttaaaaaattagccaggcaggatgacagatgaccatagtcccagctacttcggaggctgaggtaggaggattgcttaatcccaggagttcaaggctgcagtgagctatgaacatgctattgcactctagcctgggtgacagagcaagaccctgtctttgttaaaaaaaaaaaataaaatgaggcagatacaggagaaattctaatgctactgtatactgtaggcattgtacttgcatggtaggtttagggacaacgtacagatagcttcagaaaggcttaattttctaggttcatacaggttcagaagggattaccaaggattaccaatggattaccagtcatccatccatccatttctccaatgtccttcagtacctgctctttgtgctatgtgtggcaccagacaccacagcacagtggtgagcttccatgcagcctcacactaggataagcccaaagaaggaaaagctgtggtatggtaattaacatagaccaggaggcctgctttagctgggggctggggtctagggaaatgacgtttcagctgaagcctgagtgatgaatggcaggtaaccaggtatggagtgggcgaaagtgtgtttcaggcaaaataatggcctgaccggagaccctaaggcaggaaggagcttgtgtattagttggtggaatctaaagaagggccaagaaggaggccaagaaggagggaagaggtgaggtgggagttgggcctggtgaggtctataggagtacattgtgtagagttttgttggtcatattaaggggattcaatttttattaaatttgcatttttaattgcagataaaaaaacacacaacataaaattgaccactgttaccatttccaagtgtgcattccagcagtgttaagtatattcatggtgtataacagctctccagaacttttttattttgcaaaactgaaatgctatatccattaaataataactccatattttaggaggattggattttgtcttagaggcaattggggtcattgaagggttttgaacaaggcagtggcatacgtaatcagttgtgacacaagtatgtaccaggagctgtaagcacaggtaagctgcacctaagctattcaagggagtgaggaaggtgtaggtagacatctccatacttcaggattgatgtcgagaatgacccttccctgggccccctgtcaaagcccaaacactgggctggatggcagtaatagtgcagcactttatagcagtgagaggagcaactattttcatgtgaagtcatgtcatttctactctaaactgcaggcagggtgaaagcagggagtgcaaccagatagtgcctcaaagaggaaggtcctcatctgactgggcatgagctgcttgttttattggaaaggaaagacacaaggtggttggcattcagggcgtggcaaggttttccccaccaactggcttttagccacatattttatgtataattttgccacagcatccttttttggtatttcatttaaacagaagatctcaccatgattaaagaactatctaaaccctctagtgtgtaatggggacagggcaaggttgagagagcaacttcctggggtcctgctttgaatctctcttttgtcaacatgtactttggcatcccttctctctcaatctttgactggatggagaaaaatcatttcttattttgagcacttacctttaaaggaggctttaaatcctatttcctattgacatattttttttttttttttgtttcagacagagcctcattctgttgcccaggctgaagtgcagtggcacaatcttggcttactgctgcctctgcctcttgggttcaagtgattctcctgcctcagcctcccaagtagctgggattacaggcgtgcaccaccacgcccagttaattttttgtatttttagtaaagatggggtttcactgtgttggccaggctggtcttgaactcctggcctcaagtgatctgcctgccttggcctcccagactgctgggattacaggtgtgagccactgggcacggctgctgttgacatattgatcaatcacgatagtctgttatgctgctgtgtgccagccactgtcctggtgtgtctgttgttggttccttcaggtgggttcttggtcttgctgacttcaagaatgaagctgcggaccttcgcggtgagtgtaacagctcttaaaggtgacatggacccaaagagtgagcagcagcaagatttattgtgaagagcgaaagaacaaagcttccacagcatggaaggggagctgagtgggttgctgctgctggctggggtggccagcttttatttccttatttgtccccacccacgtcctgctgattagttcattttacagattgctcattggttcattttacagagtgctgatggttgtgtttacaatcctttagctagacacggagcactgattgggacgtttttacagagtgctgattggtgcatttacaatactttagctagacatagagcgctgattggtgcatttttacagagtgctgattggtgcatttacaatcctttagctagacagaaaagttctccaagtccccactcgacccaggaagtctagctggcttcacctctcactgggtcttgattatgtaagagtatgacagacaccctgtccttgaggggctattggcctaggtacagtgaagagggaaccagcaatatatcatattcattcattcattcattcattcattcatgcactcaacaaatatttattgcacatcatgtgacaggcactgttctgagtgttaaggatgcagcagagaaaagacagtccctgtctacatgaagcctatattctagcaaagatggccaatggccaatcacagtaaacaagtatactaataaatgagtaactttagattgtaatatatactatgaaggaaatataagagctatactggagagagaaagagagagagagagacttagggggagagttgactttacattggggaaggcttccccgcagaggtgacgtttgagctgaagcctaaatgaaggagccagccatgcaaagataatattattattaataatcactcacattattaatgacgaacacttcatatgctaggtactattctaaattctttatattcatgagctcatttaatccttataacaattgtgcaaaggagataggtattatgagccacagaaaggaaaatagaggttaaatcacttggccaaggttatgtataggtccagtaagctgagagttgaatccaggctgttgtgctccgaagcccttgttcttgaaacagccagccaaaaggccccttggatcaaacaagtttaaagggcacaaggatggcccatgtgggtgaagctaccaaaggaggccagagagcatagccagggcctttcaggccatggcaaggagttagggttttattcaaatcataatgggcagtgtggagagctggataatgctgccctccttcccagtgatggccacattctaatctccataacctgtgactatattacttcaaatggtaaaagggactttgcagatgtgattaagttaagggtcttgaggtgagaagattatcctggattccaggtggggcctgtgtaatcacaagggttctcataagagaaagacatgaggatcggatagaaaagtgatgtgaagatggaagcagagagagatcataagattctatgctgcttgtgttggagatggaggaagaagacacgacccaagggaagctgaaaaaggcaaggaaacagtctcccctagagcttccagagggagtatggccgtgcccccatcttggtttttgtcctgtgaaacctgtttcagacatctgacctccagaactgtaatataataaaattgtgttgccttaagcctctagggttgcagtaatttgtcacaacagccataagaaactaataaagcaactctttgaggactttaagtaagggattgaggtaatgtgatttaagtttgaaaaggatcttcctgattttctgattgctacatgggatagagagagaaaacgacaaagactaagaggaaaggggaaatgaggagaggggacaggaggggaggcgaggagagacaagtggaggcaaactgacagtgaggggctgatgcaatattctagtcaagaagattgggggtcacagtggaaatggagctcagggcttgctgatggatgaatgttctttgaggcactctgacaagtaagacagaaggcagaggagtgcacaataaaggagcctctagacagccccggaggtaggaggacaacaggaagaatgcagtgtcaaaagggcagaatgtttcaaaaggaggcagagcacgactgtttgggaagttaccaagggttcacttagtggtcaggccaccgtctggccattaactttggcacaatgtagagaataagatttgtaagagtgggtggtattggtcagtgcagctaaaaatactggccagatatttctctccagactgagtccatcttaatcaccacagtacagagcctggcacagagaacatactccacaaatacatctttgaatgggtgagtgattgaattttggattcgaggaggaaaatcaccctcagctggggtgctagaacttcatggagttagaggaattgggttgggccttgagagatgcgcagggcttggataggcacggagatggctggaactctgggagggagaagggttgagatgttgtccccacggagccccccacttgtgcctggctgtgcttcagacccttcccatgtcttgcgctctgagatctgacaagtactctaattggggttgcacaaggatgaacttacaactactcttggtatgggtggttcagggagctgaaaagaatatctgttgtctaagttagatgatacccaagtagaaaagactgcgtgggagcctaccagcatcctttgaaatgaattatcacaaagtctttatttaatacactgaaggaataatttatcgaaacagattcaatgttcttaccctaggacacgcaagaaccaaattatttgcaacaatgatcaaagaccaattttcccccaaattgacattttcatttcttttaaaaaagcttcagtaaatgaggattatcattttagccctcagttatggctctcatttggaagggtttgaggtgggaaattggttgagaaagatcctgcagccagatagcaacaggccgtgagctcaaggagcaagtggcatttccagtgattcattttaaggggggacattaatgtttaatacagtcagaataacatctctaaagaggaggtccatttttaaagaaaaacagcaagtctgccaaaggaaaaaaatccaccacatccatagccccttttctggacagatgcacacatttcttggagcttctgttcaaagcctggagtttcaggtgacctgtttcctgtccggaaagcctcactgtccttcctgagcacaaggttgaaggctgataattgcatagtttccccaggaacctgaatgcacaaacaccctgtggccaacacagatagataaatagtgagggagacctcctcagcagtgactctggaactaattagctaacaaggcatgtaattagattaatgcatgtgatctaagagctgatgatgtgctttttaggacagtggaaataaaggagctgaaaagaaagcattatattgaggagctctgaattattattcctgtcagaaataccagctgggagggtggggtggtggtgagcatgagggtagctattcatcacttagttcctgctggttcatcagggactgacattgcttcatgactcctggctgctgtggaaaataatttttcccctccttctgatagcaaggtgagaggctcctgtattatttatttggcacacattgtagccagatctgcactggacagaggggtctttccagaaacaacctgcacagttgtttctggaaagacccctctagcttccccccggctctctccttgggctcaactggagagaagaaattacatatttgaagcttactaagccccctccatctccccaagtgcaggcttctgcaatgcagagggtccccctccccaagtactgagtcatgtccctcaccactgacctctgggaccccaataaagccaactttacttctcactctccactcctttcctacttctcattaattcctttgcctccatctgaggtaatgctgccctgttggtccctgagtgtcaaatctgtgcagtttctggggtgaaatattgctgaggccaccaaagtcatttctcactgagcctctgacagtttgctaattaataagattttggtcattgcatcctatgctgaagttggaccaatttcccaggggtgggaagtcagacattaatccactaaaccaactaaattacttgtgtgtgagagaagacaatttcttcaggagtattttcctgtggtttgacatatcgctttgcaggctatggacttttaaaagcactttctagtctgatgacggggaagcctagattcctgatagaaaagtcatatgattaagataccccaagatacctctaagttctaaagatactcttagagctgtttgcgtatcatagagaggggatgccagctctattttgaagctggggaaaaatctatctggtgctgttttctgtcaggcttaatacaagcttattcagaagagtgtgtctttctgcttctgtgtgccacaactgtctttttgcccgcggagccacaggagcttacctttgaaacattagctgttcaccctagtaattgctccatcctctaatttaatgaaaacccattaaaccgaaacaataattaaaatgagacatcatctctgtaggaggtttgcatattaaaatcactgtgcctttcaatgcaggcagatttttattcttgaaaaacagcatttgaagtaacatgtaaaaatgatttataatgaataatcataaattacagagcttggcagttgaacatgatgccctactgtttactattgaatctgagtagatgtggcaaggtcagggccaatacagcatttaaaaatgtctctttcatgcctgagaattaggaccgtgcacaaaagggaatgaattataattagatcagcccaccaaacttttaaagcaggctagagatgacacccttaatatacagagtagtttagactctgggaggaggagtgttgctacgtaggggaggcatagcattggagtagagaagtaatgatgctctcgtgttggggactagggaagccaaacagaaatatacacaataagctacaaagttggagtcagagacacatctctgctacttgctagaggtgagatcttggataagtcacttattttctataaaccacagattcttcatctttaaagtgaggctattaatgcccatttaattggttttatgaatttgaaatactatcatgtatatgaatatgcttagaaaatgttaaagtcctgactttaatgtctagatatgggcatttttttaaagcatctcagaaatgtcataaggtgcctattacctaaatattaggcacttttcattcattcattcattcattcattcattcctgaaccctggaaggtgagtgttacagatgaggcaactcaaggatgaaggaaggaaaacagctacctaaggtcttacagcaggtacttggcagagctgggattcaaacactggtttgtctgagccaatagatggtgctgagggacagtggtgccttatgattggctttagacagatctgggtttgaattccagctagactagttagtagaacacgttttaactttttgtatctcatctgtaaaatggagatagcaatgctgacaccactaggctgctatgaggattaaattagcatatataaagtccttagcttgacatctagcaaaaataaaaaattcagaactgtttggaaattggctggctggacttagattggagtggctggaagtcccatagtctctgcccaattttcaatttttgttttaacagaaaagagttagaactgaccactaaccatgcctccaaccctggctggcaacccctgctcacctgctcaatgctctcctgctgggccaccataaccaaccatcagtgtgacctttacttcagccccagctgcagcaccagggttcttttggcatggtggctgctgccatagcttggtaccccacccatcctacaggacccagggcctgtcctggctgtataccaaataagctaacagatgtcatgtgctgcttatgtggaagacagttttgagagtttaacatgtacttattgatttaatctttatactatccccatgggtagatgtggttttattctcatttgtaaaaatgaggaagctgaggcacagagagattaaattatccaaggttatatacttgataagatgtgaaattggattttttttttcttttttttttttaagatggagtctggctctctgtcacccaggctggagtgcagtggcgccaccttggcttattacaacttcctcctcccaggttcaagtgattctcctgccttagcctcccaagttgctgggattacaggtacatgccaccaggcctgactaatttttgtatttttagtagagatggggttttgcaatgttggccaggctggtcttgaactcctgaccttaagtgatctgcctgcctcagcctcccaaagtgctgggattacatgcgtgagccaccacgcccggcttgaaactggaatcttaaccaaacagtgaggcttcagagcctgagctcttaaccactaccctacattgcctcttacctggaagattaagtccctgatgagggactcactctctggtcctgctccaggtgatttcagacctatgatgacatgacctaaacatgacctttttttcccctctctctttcttctcttctctctctcctttccttccctccgttccttttttcctccctcccctcccctcctgtcccctcccctcccctcctgtccccttccctcccctcctgtccccttccctcccttcctccctcccttcctttctccctccctccctccgtccctcccttctttcctccatccctccctctcccctcccctcccatcccctcccctcccatccagtccacttactttccctccctccttcccttccttccttcctttcctccccctctcccatcttctcttctctccttcctttctttcccttccttccttttttcctccctcccttcctctcctttctttttttctttccttctctcctctctctcctttctttctctctcttctttcctccttctctttcttttcttttcctttctttcttcttagagatagggtctttctcactatgttcctcaggatagactagaattcctgggctcatgttatcctccgtctcagcttcctgagtagctgagattacaggcatatgctaccatgcctggctctacttttcttatatctctgaactgaaaagctgagcaggatccattcacttttgtttgtgtctttattactagacttttagatcttcatgaatagaaggtgtgtcttagttttttgtccacagtgctggttcagggaatgctcagtaagggtttttaaagttaagaatgaatgaacaaatgaataaatgagcggatgggtggttagcagagggcagggcaaggactgccctcatgtctttataagaacatcgagagcatctcttgctggaactgatgttcttgcttgcacccagcaacctttggtgcttagagttttgtacactatgtgatgagtacaccttggggttctcagattcttgacaatcagtgtgtattaaaatggcacctgaggagggttgctggtcagttattgccaaaaaaaaagaaaaaaaaaccctgttgtcctcactgatttaaggatacacaattgtgggactgaaagcaaggtgattggtgcttattttcttcttttgtaggatgtccttcttgtttctcccatttctatgatgagctcatatattttagcataaacattgtagttttttttcttacaataactctcagagaagatttggaaaattcagacatgtggaaagaggaaaaatttcacccatgttagctcccaattgctgacaaaattgaaggccatgcctatctatctgctatgcatcacaaaataaattttatgttaccatagacttggtatgatgctgtatgtactattgtatacctgtttcagagtattggctggacatttcctatgttatttcaatgcctttcatatcattatattacaatatataattttccatggggtgtatatatcctaatttacttagccattctctaccattggatagcttcttgactatataatgcactcttaatcgtattataaaaatcttttcaccactctttttgctttttgttctcctgtcttgtgattcagatggagctggcattcatactttaactctctctttattcctgtgtttctcactgagatgcggtgggaggtatggggatgagggggatggggataaggggacttgattgctggtgggtggcagtgtggagaggcagcctaaagaggagtggctacacatgtttaatttcttagcaacagggaatgcattgattttcctactagtattgtcaaatgtttttaagaagagctcatctgccttatagtacctaattagcaaaattatgggggtaccagaatctcttttgatcgaatggcacagtaattacaaaaaattggttaataccatgtgtcacaggatgccttaggtttagtcccctaatggaggagttagggacattgaactggctttattattccttaggcagctcattacttgaatgtactttttctcaacaggtttgggttatatttgtgtgtatttggtaaacctttttttcttatattgtgttccagactttggagccaagatgtagtttattaatgtgacaaagatttgaggcttaaccaggtaccaggcactgtgcttggtgtagtgtacatgttggtaggcaattcttcatggaacttacagtccagtggggaataaatatagcacttggctgggggccgtggctcatgcttgtaatcccggcactttgggaggccaaggtgggtggatcacctgagcccaggagttcaagaccagcctgagcaacatggcgaaaccccatcttctaccaaaaatacaaaaattagccaggtgtggtgatgggcgcctgtagtcccagctacttgggaggctgaggcaggagaatcgcttgaacccgggaggtggaggttgcagtgagccaagatcacaccacgatccagcctgggcaacagcctgggtgacagagtgagatactgtctcaaaaaaataaataaaaataaaataaaattttatatatatatatcacttaataaaatgattacacatgtaaatgattctatacataatctctgacaattgtgataagtacaatgaagataaataaagacaggaacctgagttggcctggggtggtcagagaaaactggtctgaggagtagcaattaaactgttatcagaaaaggagggagagaagacaggttgctgcagatgggagtgtaccaaaatgggtaggaacgtggccctgggaagaagggatattagttaggcttgtggtgctagaatgcgggagtgtgggctgtgggggagaggaaagggaggaggatgaaaaataagcagaagcatcagttgaatgccatggaatatcacagtcgactctgctggggcaagagtcagctttgtctccactcgtcatgtgaccttgggcaagtcatgaaacctctctgtgcctcagttccttcacctgtaaaatggagatgtgttggtatttacctcataagggttgtacaaatagattgttcattcatttattcaataaatatttcctgagtgaacacaaaagtgccaggcactgggtgtatcatggtgatttacccttgatttatatcaagcactgagatcacacattttggtgaatagcaggtgtaacacagttaagagtgtagctcatggaaccagctttccaggttgaaatctcagcaccaagccttcctagcccagtgtcctttagaacattatttaaattctgtaagctttagtttggtcatctgtaaagtaggaataataataataatgtcttctaaagttattgtaagtgcgatgacatgtgcagggcattagccctgcccttggcacagtaataagatatacaggtttgatttctctcattccggcttctggaacaaatggaggtttaatggaatattattgtgaacttgttagtggagatgaaagtcccttacacgttaactgggagtcttctagtgacttctgtttttttgaaagctgcttggatcaataacatctgacatccttaaagaagggtcacaagaccaaatagtgggacatgtgcctcccatcctccaaaaccagaaattgcctcactgatggttggcagttctgaattgacaaatttcctctacattcagaaatgaaaagccaactgtcatttcaaattaagaaatgttgctttaccttttggggccattcttaccatgagcttatgtggcactcaggctagaaggttgtggcctgtctatatcaggagtttgctatattttgaggttcacagtgtaattactgaaatgttgcctgcattctctaccagtcaaggctgaggcgggctgccttggtgcattttttgtttatatgtttctggctgctgctgcttttcccaccttgatttgctgattcttcgctgtgaactggtggggattctgcctcttggtctgctttgtgctaatgtggtaccccttggccaatcaggggcctgagaatttgctccaatattaggttaagtagatgctttctctgctgaacttgtagtaagagatacacttgcagaaaaagaaaaatgccagggtaatgtataacacgtgagttcacagccatacgatgctgctgcagtgagtgccctcttctccctctctcctgcctagtaagtgcttattcatgtttttagagtcaggttcaattatatcctccatgatgttatccccaatctctatgggcctcctctgtttttttgtgcactgccctattctgcaactattgtcataaggaaactgtcttgcttacgtgtctatcctctagggcagaaactgtgtttttacttttatttccccagtgccaaccacagtgcctggcataggggaagcaaggtatatgcttgttgacaatgaaattcaccaccatcctcactctatacatcagggaagagggaaatgaagttgcttctatttgaggcagagaagagtgtgtgtttacctcatttaatttctttccttctccaatctcctcccttcacccagcacttttttttttttttttttttttttgctgatgtttaatcatcatattagcatttttagtctttctttaaaaatgactaggtagagccgtcttatcctgggaaagaaaaagcacttcactcttgctgctgagttagcacttcttaactagaacatgcaaaacctgagcatttggaacgccattttcccccgttttaaaaatgtgaaatattcactttaagtggttgttgtgtgcgaaactacctttatgcaatggtagcctccaagtacacccccagggttacaaaatggaaagcctcacggacagactaaattcaaatacttgaatcatgtttaaaatatctaggaggaaacaggggaaagagatggagtaggttaacacatgtaggattgagtgtgagcagtgggaagcaccagcccacccagttcctgtgttattcattgctcatatattctgttttttttctctctctctctgctgcatcagcttctttgatgatggtgtgattatgaggactggagctgaggttaacgaaaagggagggggctcagcaaatgggaggtttccagagcccacatgcttcctctattggaaatactcagaagcaagtaatcctggctacaactgtaattcaccagttaatttggtgagcagtgatgggttttattagcatttctcaaggatagtatatgtggggccagaatggaaatgaaatggatgtcaatgatgggtgttggtttagggatgacatgactgtcattctgaaggtggcatgatacgcacattatgacttggtcctcccatcccattgtacttgtaagtaacactcttattcaatcctttttatctgtgttcaacacacttatgttccacgtattcaatctatgtttagcatgtttcacaggtttctaacttgctctctatatttagcacttcttatgggctttatctgtcccatttgtttttcctgttatctctagcagaattgaatattcttaagtaatacagcaaatacatactgtagtggttgaatatggaagtacaatattcactataggttcccattaattgggtttcattggttgctcttttaactccaggaaaaaagcaggctgctgcaaagtaggtgacatatcactatttttaagagttgacaactttatgttttatgttaatttggaaaatcagcagaggagaaaaattgtagaatctaggtttcttaatagatggaatttgctctcagtgctctcttttgctatgcagctatgagcaggatcaagtgattaactgaaatgaaatgtcaagactaggaaagaacttggagatcatggaatttagtggtcttaattttcagatgtagagtgtgaggttcagagaggtaaggtactttatccaaagtcacacagctagtcatctgcaaaactcaaagtgatctcagtcctttgaaacctgtccagtgtttctgcctgcatattgtaagaaatagaattactttgttggtgtttttttaacatctggatcatggtcaaaatttacttgaaagggcttctctgagagtgagaatgcacataaagcctcagtgtatcaaaacaggtgtttcttacatttcactctagtgagtgctaatggggtctctttacttcagtgtgccaatcatttttaaaaagaaataagaaaagtcaacataagaaatgtttcattttcttggaggattgagtgagcagaagtttggtaggactagatcagactgttaagtgggggtgtcctgcaaagaagtggggtttatttagcaccaaacatcattacaataaattttcatggccatgagcatttgagaaggacccatttatctcctggttttccaaaagatatattactttctgactataatatatatggttacttgaagtaacaatataaatgagaaaaataaatggaaaatacattaattaattcagtaaacctttattggatgcctgttttgtgccaggcactaagaattgtggataaaacaatggataaataagtatgcctgccctcatggaacttacagtctagtgggaaaagaaaggaaataatatgaggtaacaagcttgaaacaagactgtgataaataatatcagcaaataataaatggattacaatacatatattatgacaagtcaaatgaagaaaatacccagactggagcattagagagacattaatgcagagtctgccttggagaggccagaagattgcatttacagtgaaagctgaaggagaaggagtcagggacgtgaaaaggagagagaagagcactgtgggcagagggacaagcatgaagatctgaggtgggagtgggcctggtgtgctcctctagtaaccaaggagaagagtgtgaatggggtgggaaaggcaggcaagaatcagtttgtgtgcaactttgcaggcatgctgaagggactggattttatcctatgagcaatgggaagccattggaggattttaagcaggaggctgaaatgactcggacttagggtttaaaaagagcacgttaactacagtgtgaagaatggtgaaaagaaggcagtatggaagcaggaaggagatcattggaagtgccctagggagcaatgatagtggcttgggcaagagttttaagagtgaagttgggaagaagtggacagattccagacatgggagcccacttaacttgtttttagactggatatggagagtggagaaaagggaaaaatcaagggcaatttctagttttttgacttgaggaacagggtgtgaccgtttactaagactgggacctttgtgagaaaattgagagtggcgggaagagaacaggcttcactgtaggcacattacaatttgaaatgcttgaaggtgaacgtttgaatttactgcataagggagaggttagggctgcagatataaagttggaggccattggccatggggttggatgatatcactcagggagaactgagtgagagatgacgatacccatagctgataggatattcatatccatttcctccagcaggcattgctgatcgcttatggctgtcttttctttgggcccaagctttacaatcctgaaattcaggcatctgctaccaatcagttgatttctaattgatgagtaaagaagaaaaaagtaaaaagtaaacatataacttaattttaagacttgaattttttttggcattacttgtaggtaaatttattaagatgatctttgcttagaagtaatgataatagggtgcagtggctcacacttgtaatcccagcactttggaaggccaaggtgggtggatcccctgagctcaggagttcaagaccagcctgggcaacatggggaaaccctgtctctaccaaaaatacaaaaaaaaaaaaaaaaaaaaaggcgggcatggtggcacacacctgtggtcccaactacttgggaggctgaagtgggagatcgcttgagcccgggaggtggaggttgcagtgagccgagatcatgccactgcacttcaacctggtgacagagtgagaccctcatctcaaaaaaaaaaaaataataatgataataaaaataatattaacaaacattttctaatactctttagtttacagagtgatttgctcacacatttaataggttttaaatgtcatctggaatatctttggctgggattttgtagaaggcatagaagcatttttcaagatgctatctcttttctcaacacttgataaaagctgacagcatgccacttaagaattaagtagcgaaggccttgctactattgtgcaggtaggttttatactggtagactggtctgcctgggttgggtgtctccatggtggaggacaaacattgctttctgcgattcataccctagatacttgcagatgggaaagactgtgctgttcttttctgtgttataaaattgaagcagcaattcaaaaaattatagaaggctaaggtgggaaggttctaagagatcacctagtctaccccctcattttgcagatgaggggactgaggcccgaggtcaagaattgaaggatatcttattcagaagccattctttaggatgagattcttcaaggtccgtataccagtctgtgatattgcttgggcagtgcagcatttgaagttctatgtttttcaagggcttcccatgtagtcctggagaaataaccatgtagttatcttgcagtcagaggagatggtcaggatgtgagaggaggtcaccaaacacacttctaatgttcatttatcatcctctgaataatcttctctaactttgctcccttagtgcccctttctgatgccagaaaaatgtagtgtaaaataatgagataacacccagtttatcatgacaagggtgagtctgggtatgaagtgatggatgtctcttgttatgctgatattggagaaagaaacattcttgtctaggagcaggattagctggaatcacacacctctaggcctgctgaatcggcctcaacttcaataaatatttcatgaggaaagtcatccattgcatgcttatggagaaattccaggcacgggtgtggagcatgagcatgccttgtatttattcgttaagcaaaggcagagttgtctggcattattagtgctagtaaatatctgctaggtacaaagcaaggacaggtttcctatatccattgtggggagaaggaagctgtgtccatggaaaaagtgaaattggaggatgctgagtggcatttgggtcttattatcccaagattctctgaatttaggaccacatttatccgactacctctcaccttatttacagcaacctaatctgtttgcagcaaactgaattgctcagcgtcccgtcaaaattcctgccagaaaatcactgtctggccaattgggaacttgtcaaagtgacaagtgggcatggtgacagagacagcatttccgggatttgcattgaatgaatgcagctgtagggagtggggaatggtgcctgaaaatgaaaactattgacagaagaggaaaatgaaacttgcaatctggattctttggacatgacatttttaaccatggatcttttttcctcttccttctcatctcccctctcctctttctcctatatttcttctctactccttctccttcctcttctcctctcctgtttcctcctgcttttcttcttgattcctagacatagaaagagagatccatgcagctcctcatgtgagtgagaaattaattcagctgttccggaacaagagtgaattcaccattttggccactgtacagcagaagccatccacttcaggagtgatactgtccattcgagaactggagcacaggtaagaaagctctttctgcttttgaaaatctccttagagttaatgggttatacaaaatgtcttgggatttagagtttgtagccccatgaaaactttcatctaactgaggcctcatttctgttgaacacattcatgaatttactttgcattaagaatttactttggtcaaagtggctttcttgtttgctctccaaggaccaatcatgagtatctttctcgtctgtcttctggtagactttgaataaaatcacattctgtcatatttagtcatcaagcaagttagttagttatgtttaacaaccttcaataaacatttacagtgtgtttatgtggggattatacttgacactgggaatattaaggtgaatagtgtatgatcttcatcgcaaagatcacataagctagtagggaagatagacaaataaatataataaagtattgaagatgcaatgccagaaggttgtaatcaggaaataaaggtaagagcagtcattctgctaagtgttgtggtagccaagaaatgctttggaaaagaagatagttgtataaggaaaaaaatgtgagtattctacatgctgaatgcgaaggagtaagggatggaagaataacatttcagaaagaggttgctatgattttaagaagcaacacatgggtaggtaagtcgttggaacataaaagtgtgtatggggaagggatgagagtttggggtgggcgatggggctggtattatagaggtaggtagaagccagatcatcgcaaagcttcaatgccatgttaaaaacttgtactgaagtcccctaggcaatgggttttaagtttaagaaagatcactcaatcattgaattcaaattaataatcattaggtaacctaaacaattttattttttaatactgggttcctctgtattagtccactgaaaatatttatgaagcacctactctgttctaggtgccatgcgaggttttgtggagaaatcaaaggaacaaaatcttctaagcatgtatggtggagtttggcaatgcaggaaacaaggcataaccacacaaaaagctgaagaataaaaaagagtcaataataaagaaatagtagattggtgttacaatgaagtatggagctaatttcaaaattacataaatgtgttaagttcactgaattaaatgcattaggttagtggttgaggaagaccatacagagagagtgctcttgaagcacaggcagaattccagcaggtaagggaagaagggtgttacatcaaacagaaggaacagtgtgcacagtcacagaggtgaagaaatatagagaaatgcaattttgggagtgggagcagcaaacagaccaatttggctggaacagaggctctttctatgcagacttttggtagttgtaaggatcaacagttttgtctttaatggttgtttgttctcagcctcaaagcgtggtgatggaccctgatcattttgtgggggtgttgtcattacaatctggctgttctgggtcagcccagagaaagcaaggtgatgtacatgtctgtgagagatatgggttcgttcaaaggtgttctgtatgctggagaaaggtataggttctcattttccaaggattgagtgtcaaggcaagtctcagcttcacaaccctaccttgccctattggccttgtggggttgggtgtgaatgcttctttggtatgagggttatacaaatgcccaaagtaggaggtagatcttgagatacttctcaatgaatgcagaggagagcttcccacagcaggtgagaagcatgtgaaacagttgctattatattagaaagagcacaggtttcagagtcagtctgatggaggctggagttccagttctagctttgtgacaccagctcttcaatgtcttggaacttcaatttccttgtctgtaaaatgtgtgtaataatctattttcccgggctgctctaaggaagaaaaaggattgtgcatggtgagtggccatcccttgacacatatacatttattctccttgtctaagtgtgttttgaaactgtatttgcagggtttctcttttggatttttttttcaataggaaaggttttaaaaaaacttttttgttgccatgtgaggctgtcttttatatccctagtaggtttctaatagagcccaaggatgattgataggagagtcatttgatcatttttcattgtaatagaaaaacttcagaattttttttttttttttttgagaaagggagaagaggctgggcactgtggctcatgcctgtaatcccggcactttgggaggccaagaagggcggatcacctgaggtcaggagttcaagaccagctgaccgacatggtgaaaccccgtctccacttaaaatacaaaaattagctgggtgtggtagtgcatgcctgtaatcccagctactcgggaggctgaggcaggagaatcgcttgaactcaggaggctgaggttgcagtgagccaagattgcaccatcgcacaccagcctgggcaacaagagcaaaaccccatctcaaaaaaaaaaagaaaaaaaaaggcggggggagaagaaaaccgtgtacaggggttgaatgcctttagccaaagaaggtgaggcatagaggtctcttaccactagggaatatatctgagtcacacagcaccaaagtatattagcagtagaaattatctgagtcacaagacaccaaagtgtgttggcagtggagggtatccaagttacatgccaccaaaatatgttactgggggcaaatccatatgggtctacagcaagacccatatggattttcttcttgtgtcctcagaagaaaaatttatctgaggggcataaggcagaaggagagaccgaggcaagttttaaagcaggagtgaaagtttattaaaaagctttagaggccaggcgcggtggtttacacctgtaatcccagcactttgggaggccaaggtgggcatatcacaaggtcaggagatcgagaccatcctggctaacacggtgaaaccccgtctctactaaaaatacaaaaaattagccgggcatggtggcgggcgcctgtagtcccagctacttgggaggctgaggcaggagaatggtatgaacccgggaggtggagcttgccgtgagccgagatggcgccactgcactccagcctaggcgaaagagcgagactccgtctcaaaaaaaaaaaaaaaaaaaaaaaaggaaggaaggaaagtacacttgcaagagagccaagcaggcaccatgaaagacaagtacgaaaaatctcaaacctcagatcctgactgctaaacaaaataaatatgaagaagtagatactagatcccctctccctctggactttatgatgccctgttccatgtgtgtgtagtctgacaaggcaaggtatgaaagactgtggatttgtaatgtaatggctgggggtaatagagaaaacctggtttctactctagtagagaagatctacttaaggagactggaatgtaagaaaatagagaagaatatataatggcatatatttagaaattagtctattcattataactctcctcccctcgccaaatgttcccatctgcaataagtgagaatctttcataattttcaggttacttttattatttaccaggataaaagtatctagaggagcaaattatcctgtagaaatttggcatggacatttgaccacgtatataagttgaccaaggatttggggcttttctttattcaatagcagaagatccaggtatgtggtagatagattgttggcttaaaaatcagacacccaggttctttttgtgattctcccttatgtgattctgattgtattactagtgatgaagataagttaaataagtatttgaaacaattgggatgtgatgggcattattagattcctagataattttttatttttataattcagtagcttttagtataatcacagaattgtgcattcatcaccacaatcaattttagaaatgctcattaccctcaaaagaaatcccataccttttagctgtcacccacaatttccccataagctcccaagccttaggcaaccactaatctactttctgtctctgtagatttgcctattttggttatttcatataagtgaaatcatacactgtgtatccctttttgactggcttctctaacttagaataatgctttcgaggttcattcatattgtagcttatgtcagtagttcacttctttttattgcagaataatgttacattgtttggatataatacattatagatatccatttatcagttggtggacatttgaattgtttccactcttggctattatgaataatgctgctatgaacatttatgtacaagctattgtgtggacatgtttttatttccttgggtatatgactaggactggaattgctggatcagatggaaactctgtttaactgtttgaggaactgccagacttgtccaaagtgactacactgttttacattccccgaagcagcgtttgagggtttcgatttttccacatccttgtcaacactagttattatctttctttttgatgatagacattctaatgtgtatggagtgataccttactgtggttttgagttgcatttgcttgatggctaaatgatgttgagtatcttttcataagcttattgacgatttgtgtatctttggagaaatgtatattcagataatttgcccacatttaattggattctttgtctttctatcattgatttgtaataatcatgtatgttttagaggcagtcacttatgatttacagttttttcccccattctgtgggcgatcttttcattttcttggtggtgtcctttaagcacaaaggttttaaaatttgatgatgtccaatttttttttattttttattttttgtgattctgatgtcatatttttgcctaattcaaagtaatgaagagttactcctatgttttcttctaaaagttttataggtttagctcttacatttatctcttagatatattttgagttactttcttctaaaagttttataggcttagctctcacatttatctcttagatgtattttgagttagtttttatatatcatgtgaggtaggggtccaactttattcttttgcatatgaatatccaattgtttcttcaccacttgttgaagactgcttttcttccagtgaattgtattggcaccctgttgaagatcaattgaccataaatatgagggcttatttctggtctcttactgctatggaatctttggggtgttgcttttctgaccagaaacctgtggctggtggtgcctttgcccgagttttgctagggcccactgggctcgttctacccactcggcctggcaggctgcactcagctcatggtactggcctaggtgtcatgcctccaagggagatgggagtcaggcatggagcagcaaggggtgtgtgagtgagcaaggggtctggcccctgcacattcagatacaccggctgctgccacggggtgggcagctccaggtaccggcagggttaccaactctctgtgaggttgtggctggaccaggtacacctcaagcagcttccaccagcaccggggaacacggtggcacctggaagcttggagacaccaggaactgcaaggccccaaagagggagtcacagccctggctcggggagcccaggtctgtgctccccaaagggctgcagctcttctcttctctcctctttgcccccaatgtggcaagcaaggagaatgtttcagtcctgtttgtgttacatcttttttagcctcattcagtgagtcccaagttcttgtcctgcaaccaggaagaatgaggtacacagacaagtggagagtgagcaagatgaagagaagctttattgagcaatagaacagttcagtcttccacaggagtagctcctttcctcagccagggtgtcccaacaggtgttcagctcctaatagagaggagaccctggagtaggaagctcctctctgcaggcaggtcctgctgttgtctctgcagctctcagcagagaggaggccctagagtgggtggcttctctctgcagcgggttatcctgatgtctgcttaagtttcagcagagaggaggccctggattgggtagctcctctctgcagctggtccttctgatgtctgctcagctctggctgagcctggggcttatatgggcctcagaggggaggaagtgcatgccagttggcccatgggcagccatggataggcctcgaaaaggcactacaagttcccattcctgtctgtggcactggcagccatcaggccctccctggcctgaaggcgaagcctcactggggagccagccacttccacccaggaactgtctacctcctgctgacattcatggtgcccagactgcaggtgccaagggatacctgcaggcaaatgctgagctgacttcagcctcacctcagcttccctcctatgctcattggtgcccaaaatccagagagggctaaggtggcagagggctggtgtgtcagcactgccctgagtatgtgcacacccagccaggctgtgacagtgccggaactcggccccgactttgctcaaagattggtgcaggtgcttatttcagacagaagccaggcagtaggagcaggcatttctgagcctacaagtgcagtggggtccttcccaggtctccaagagtgcagggatgcgtgggcccacagctgcagctgtgaagggaagggttggggctcttgcctgcttggtgaaacaggaggcctgggtctgcagccacagtttgggcagctgcagctgagcccagcgaggtaggactcctacctgctctgtggagtgggaggtctagatctgcagccatgacttgggccctgctcctgcctgctctacggggcaggaggcctgggtctgtagctgcaagtgggcggctgcagctatgcctggggaacttctaccccaacttggaaggggcggggcttctgctttttcaaggctcccagtggctccacaaagcctgcaggcctggccacgcctccctgctgcacctggtgtgatggtagcggctgctccagacagcctgccgctactatcattacttctatttcattgatctatatgtttatccatatggaagtgctgtttgattattgcagttttgtagtaagtttggaaattgatgaatcttccaagtttgttcttcttttcaagattgttttggttattctatttcccttggattttcatatgaattttaggaccagcttgtcagtttccgcaaataagtcagttgagattttgatagagattgtattgaatctgtaggtcgtcagtctgaggaagcattgccatcaaaacaatgtcaaataatttgattcctgaacatggggtgtctttctactttctcaggtcgtctttcatttctttcaattttttttgtttgttttcaaaatctaagattttcgtggcttttgttaatttattcctaggtgtatttttttatgctatcatacatggaataattttcttaatttcaatttttggttgctcattgctactgtatagaaaggaaattaatttttgcctattactttgcatcctgcaaccttggtaagcttattgattagttctaatagtttctagtgaattccttagaatttttccatataagattatgtcatctccaaatggagattgttttatgtcttcctgtcctacctgctgcctgttagttcatttttataccaaattgccctggccagaacttccagtacaatgttgaatagaaatggtgagcagatatctttgtattgtttctgattttaaagggaaagctttcagttttcaccttgaagtatgtcagctgtgtggattttcacaggtactcttcaccagtctggaggtttttttttttttttttctatttgtaggtgttctttatcatattggagaagtctctttctattcctagtttggttagtgtttctgttatgaagggtgttgaatttcttcacatgctatttctatatctactgagatgataacatagttttaatcttttattctgttgatgtagtgtattatactaactgattttcagaaagctataccaaacttgcattcctgggataaattccacttggctatgttccataatcctttttctattttatggattcgatttgatagtatattgttgaggacttttgtatctatatccataagtgaggtattggtctgcagcttgctttctttccatgttttaatatgattttgatatctttcttttgagttttagctgatttttaagctatattgaatagcttttttaagctaacatttgctgattgcataccacgtgccaaacattaattttttttagatgatcccctttgacttgttaggtatataattgtgtaagctgaaaatattgaaaatttttcctttcttcaatttcaatatttatattagcgatttctttttcttgttttatgatatggtctggaatctccataatagtggtaaataatatatgaacaaatcaaaggtgttcattaaagtcaggaagagggcaacagataatccttttttctttccaactttaataaggtcctctgtttaataaactgtctagtagtactttctaatatctatcactgtttctatctgtctttatctatctagtcatcatgtaaaggaaatctaattttattcctattttactgaaagattaaaaaagaatagctgttatattttattaaatatcttttcagtgtgcattttgagatacttttgtgtctgcccccttttatctattaacataagtaattacattaatagaatctataatgttgagctatttctgaaatccttgaataaacttacattaactaatgctttagttaggatctttgtatcattaaataatgatagcaatagcaatattaataaaagcagtagtagtaactacattagtttaagcactgaagaattataggcattgttttaaatactttaaacttattaaacatttaaatgttttaatacattaataagtgagatgccatagatttttctgtgtatttgagttaattcaaggctttttgaattttttatgtgctagactatttaaaaaatatacattgtatcttttctacaagtgtttctgatagaatgagcctgaaaatagatgcaaatgtaattagatgtaaataattacatgtaaacataattagaaaaggacagaaaatattttgtatagaaaatatttgggctgaaaagtacaaaaaatatttaggctgataatttggtcttggggaagctggaaaatattttattattgaaatgttcattttccacttcttttgtggtatggtttctatctaattacttttgagctcttcttgggatcaatttatgtttttaagaatcctatatttcattgatattgggatttttttggcaagtagttggacgttatagtctcttttacttaataaaatttttatatttgtgatttttatctcattttatttctaatgtgtgatatgtgtgttttcttcttttcttggccaggctcatcatgggatcatgtaatttattgatcttttaaatgaaacagttcttagttttattgatcaagtggactgtttttcatttcaaattcattgattcctacttcttaccttatgttggattatcttgttggtatttttactagcttcttccatgtttagttcatttgtcttcagtattttctgtttactggtaaaaccactgatggttttatgtttccttgtgaatattgctttgaatacagcccactgatattgctatatagtgtttttattttctgtacttttctatagctcttaatttcattttggcttcctctttaaccctggttaaagcagtgtttaaatattccaaagtgattaaattaaaaatgcttaatgggtgatttctggttttattgttaattgagggcataaaatatgtgcgtcagatttttagatttttgagttgcagaattttttttcctggtgatctttcacatgctcaatatttttgatacatttaaaaataatggattgcttttgaaaatgtatagataaatacagacatatgactttatatgtagcaactttgagttgtgttatttaacttctatgtgtattgattaactgattgattgctcaatccatgacagtctgagagaagtaggttaatggctcctattgtaattatgtaagcatcgtaggtattgtaattatcattttttcatagtctccttggataggtttaagggtcaggctgaaaatgtcatgtataatctgtatcccatttcattgaacagtactgggaaattcagcctagcattgtgccaaggatgagagaacatggatattggaaacattaggcagtctctgtcttgattggttgaggtgttacctattgagtctgaacccaaatacgtggaaatagcataggtaacagactgcctcaaataggggtttctccaggtaataatctcaagcacatagtatgcactcaataaacacattttaaatgaaaaaaggatttgtcttcttcatctccagttagagctgctcagaattttcatgactagtttcaaaggttcacatggaatacattgtaccagacaaaggtattgccctgggtgtgctacacatgggaggctgtgcaggatagtgaagggggcaaaggttttggcatctggaggctgaattgataatacctggtgatttttctgaggattagtatttgtaaaatacctagcatagtgcttggcatacaaaagaaactcaataaaaaagccataatgatgatgatgctgatgatactgataatgacgatgttatctagatggaaatttgatgctgaggggagacagggtgctgaggagtggccagatgagaaaatagtcatcccacacaccacccccagttcggtgattaaaggaaaataatgactatcacccaaacctggtaatgttcgattttcagttaaaagtcatctttgctgatgaagcacaatgagggaacagcattctggatctgatcaccttccctaatcatcatgagcaccacaggaagtaatcatgcccctgccttttccaaagctgtcaaccagagaaacttcatttactgttttggaaatcactgtttccaatctctgctaggcttcgggctactctcaggcacagccattattgaattagaagacttcattcagtggctgagttcccttctggccaaaggcagacatctctctcacctggtgggaacccagtagccagagttagaactcttgggagtttgtgtttctttaaacgaggagtgaacttcttggcaaagcagtatctggaaactccctaggtaactgagccaattgagttcccatggatatcttaagtgggcagataaaacgaaacagaaaactgaaatataaagactattaaaaatgtacctggaggtagtaattgaaataggctcttttatgtaatggaatgggtactctgttattaattccaatgtatatttctaatgtgataaaattattttttacagtagcaatagagtgcattagcagagcaacaaagatgagtctgtcttgctgaactatcttaatgacattgcagatttaatgtttattttttcggattcaaatgtgttaatatagagctttgttaaaatggaaagcttaattaatgcagattaaatctaattgaacactctgccagtatatgtaactctataagatataatggtaaatcttctgttttttaattttatttctaaatgatagataaaattaagttgaagcacaattagatgggaagttgaaagctagggttctaagaaaaagcttcccatggaatccttttctgaggagatgaagaagacatttttggcttcctaagaaggcatctccttttttttttaaacaaaatttttgtttttcaaaagatactcttcagttttctgagctctcatggtggaaataactttctactgtgatgccaagtagacttgggttcatttcctggatctatcaattgctagatgtttgagcgtttgcagttatctttaatttacctcagactcagggttcttctaggtaaagtgaaggtatccattgattaccacatcatagagttattggaaggattaaacaagagcagttcctcatacatctcgtatatcaaggctctcagtaaatgtcatttttcttcctgtcctcatggctgctttagatatttcctacttcttcctaaaattcttcataagggaagaaggtagatgttgggaccgtcccaccatttgaaatagtaattagcttttcacatcaagatgttgttatagataatctaaaacaatgaattgcccaaatggaatgcattctgtaattcctaaaaaagcatgtttaccttcttaattacagatgacttaagctcatatttaaattattttgaacttttataaaattgattgaagaatatcagaatgtagggtaggaggaaaggggagaaaattccagaagtatgttacatggtttgttgaagccatgtaactttctccttgggtaattctttcctcaatgagatacaacattggcttatattattataaagtagatattttcaattattaaattactttcatttgggaatgaagggagcaaattggagacttgccctaaaaaatctatcctgcttttgaagtatgcaagcaagtctccacacttcaaacaaatattgggtgtctatgattagagagtctttagagttaggactatgatccgagtagaccgtaagctgtcttgtcagcatcattctggagataacaatgcaaaactatcaaatactgtgtggtcatagatgctgggctacaattgtgagacatacaagagtggagacagtcaaagaaacactgccaagtattgttagtgccctgataggaggaatacagggagcaaggcaccctacctcgaccaaaaggagtcagaaattctttccaccaagagttatgcttaatatgttaaatagaaggataagcagatatcagccaagatgaatggaagagggttctgaatgcagcatgagcaaagaggtgagagatgagggatgacagtgcattaaaagaactgaagaaaaatttattattggagagtggagaaagcataggtaaggaagaggcaaggtgtgtcaagaaataaacctggggaggcaggcaagaggccagattgtgaataggtttgtaagcaatgcgtaatggtttagcctttaggcccagggcattgggagccatggaaaggatataagcacaggcttggtggcatgattagggtggtactttagaaagaccacactggctgcttagtggagaatggcatggagggggcaaaattggagacataaagacaggaggttgctggccgggcgcggtggctcgcgcctgtaatcccagcactttgggaggctgaggcgggtagatcacgaagtcaggagatcgagaccatcctggctaacacggtgaaatccagtctctactaaaaatacaaaaaaaattaggtgggcgtggtggcgggcgcctgtagtcccagctacttcggaggctgaggcaggagaatggcgtgaacctgggaggtggagcttgcagtgagccgagatcgcggcactgcactccagcctgggcgacagagcgagactccatctcaaaaaaaaaaaaaaaaaaaaaagacaggaggttgctgcagtattctagaatcgagatcctagataagaggacagaatcctgcactatttcagataatggtggtgccaattgagggaagttaattctggagtagactggatgtagttctatattaggggatagagaaggaggagtcaagggtgatgcccagggttctggcttgtgctactggaagttagtgtgccctgggcagatagagtggggtggtgaatagcttttttctttaatcattgtgctgtgtgtgtcatatggccaattctttgcatttactttgtccaagttttcagttgaataaattaccacaaatacagaaaagtagaaaggagtaataatagatgggatgtattttccagtaaatggttaaaagctgaaaatgtgggccatctagagatgctgccaaatgctaggagacaagacatctggattctgagattccatcatttttatctttatgcctagcacagtgtagacatagcttcaaggaaacgtttaaaggatgtatacttgaggatggacagttaggctatggtgtgcattgggaagtagcaattttcaggcagaaatgaaaatgagtggaaggatctgatgtccagaaaatgaggatgttttctgcaacacactaattaagtaaaatttaaatcttcgtcagaagaaatgaagctgttcagatgacttttgaccttaattgaagccaagaagtatcatagcaatagaatataatactttgggcaaattgctcttgcttgtatatgtgcatgttagattttggattgcctagtgtttgagaaatgaaaaaacagctaatgtagccattaacctttacttttttagtataaattcacaatttcattaatatttttgcataaaatcatttaagctcaatggaattctcctagagaatttaaaaaaactcttctttgacatcctttggaattagttgtgaaacacttgcatttctgggtaacatgcattcgttcatttggttctgtggtgagaaatgtggacagaatgttgttgctgatgaaagatagatttaactcctgacttgctgatttctgggtgaaaggcacctcaggctgtcagaacattggtgagggtggtgcaatgacagtgattctgggccaggagtcagaagacctggactcaaggctctgctttgtcaatgaatatccatgagaccagacaggtcctccctggacctcagtttacttctctgtcaaattatagttcattaattattcatcagatactaatctgctttggacacttatctgtgggctaggaacattggtggattctttagcagcgaaggtgtgtaaggggcctgtcctcagggagcttttattctagtggggtgagtcagatgataaatacggacaaaattaaacctaatgataaacgtcatggaagaaaataaaacagagggatgagggataggtcagtagagaagagaagctggagagggctttatgaagataggacgtttgtcctcaatctaaaaaagaggcagctatgaaaaaatcagaaagatgagtgtcccagatagctgagacagtaagtacaaagactctgtgaaggatccagtttggtatgtttaggagacagaccaagagctagtgcatttaaaactttgttagttgagggtgatgaaagggagtggttttagatgaggagatgctgacagcaatagcttccttgatgatttcacagtgtgagagaccgtgtatcatgacaaagtgtgatatttatacaaggccatattatttcaggacaacagttacttactaagtgcaggctatgtgcaaaggaagtctacccatccatccatagtgttccttggaaatccaaatttcataatttataaaactataacaattacattttttagagcaaatgcacacactttttttctaaaggacattttagttctcctttcccccttcttattgattgacttgattataaataataataatactttggtaggagtgaattggtagttcaccatttgaagcattatcagttcatctggagacagccagaagtatgtatgtgtgtatgtatgtatgtatgtatgtattattactattatttttagattcagggagtacatgcacagagttgttacactgttatactgcatgatgctgagggatatggagatatgaatgactttgggatacagatggtcccatcacccatgtggtgagcatactatccaataggtagtttttttagcccatatccccctctctccttcctccttctagtagtccccagtgtctgttttgctcacctttatgtctatgtgtattcaatgttttgttcccacttataagtaagaacatgcaatatttggttttctgttcttgtgttaattcacttaggatcatggcccccagctgtattcatggtgctgccaaggacatgattttgttcttttcaatggctgcgtagtatcccatggtgtatacgtactagattttctttatccaatccaccattgatgggcacctaggttgattccatgtctttgctattgtgaatggcactgtgatgaacatactagtgtatgtgtcctttcgatagaatgaattcttttcctttgaatgctagtgggattgctggttcaaatggtagttctaagttctttgagaaatctccaaaatgctttccaaagtgattaaactaatttacattcccactgacagcatatagacatgtccttttctccacagtctcaccagcatctgttatttttgacatttaaaaaataataggcattctgaagggtatgagatggtatttcattgtggttttgatttttcacttctctgattattagtgatgttgacttttaatatatatttgttggctgcttgtatgtcttcttttgggattgtctattcctgtcttttgtccatttttaaattggattatttgttttttgcttgttgatgtatttaagttccttgtagattctggatattagacctctgttagatgcagagtttgtgaatattttctcctgttttgtaggctgtcttgccaataatagcctctcctgagaggtggagagcctcatctctaagatgggtgcagcacaaaagtgggggaagtaggtggtgtgtgggaatgagaaacgatgaggatgtgcccgtggctggaaaatgcagcctgcagggcaggaactgcaaagagatggggctgatgatattgagagtgataggcatcctgtctggatttgttaataagcagtgactaaatgttgaaactgcaggccatagttggcttgtagaagggctttccttggttgtgatggcttccacagtatccttccacaattaaaaaaaacaaacaaaccatgagttagtttccaacatttgaaaattgaagtgatttggtctaaaaaatccagctttccaccttctcatcaaaaataggtatgtatttttcagattgccacagtccctagttctctcagttgtcttcccatcaccataaggtcatgtgtcaattgctgctgtgtggtttcctttttaatgaatgtaaagttaggagaaaagtgaaattcttaaactcatttctttattcaaagaagaaaaataaagggacttaaaaggtagcttgttttttaaaaaatacgttagacttctagcctacttctgtcatgtaagatgctgcctggcccctgtagccactgaagattttgactccctctcaaggttatacagatacaaaatggcagagccagaatgcaaagccccatctgaagattttgccctttcagaccttttgcccatttttaaatcaaattattagattttttccccatagagttgtttgagctccttacatattctggttattcatcctttgtcagatgggtagtttgcaaatattttctccctttatgtgggttgtctcttcactttgttgattgtttcccttttccgtaaagaggttttttaactttatgtaatcccatttatccgtttttactttggttgcctatgcttgtagggtagtactcaagaaatatttgctcagtctaatgtccctagagagtttccccaatgttttcttttagtagtttaatagtttgaggttttaggcttaagtctttaatgcattttgatttgattattgtatatggcaagagataggggtctagtttcattcttctgcatctgctggtccagttttcccagcatcgtttattgaagagactgtcctttctttcccaaatgcatgttcctggcaccttcatagaaaatgagtttcctgtagatgtatgaatttgttcttgtgttctctattctgttccattggtctatgtgtctgtttttatgccagtgccatgccatttgggttactatagctctgtagtataatttgaagtcaggtaatgtgattcctccagttttctttttgctcaggatagctttggctattctgggtcttttgtaattccatataaagtttaggatttttttttctatttctgtgaagagggtcattggtattttttataggagttactacattgaatttgtagattgctttgggtagtgtggacattttaacaatattaattcttccaatccatgaatgtggaatgtttttccatttgtgtgtgtttgtcctcttcacattcttttatcaatgttttcaagttttctgtatagagatctttcacttttttggttaattcctaagtattttctttttgtatctgatgtaaatgaaattactttcttgatttctttttcagatcgttcattgttggtgtacagaaatgctgtttttttttttgtatcctacaagtttactgaatttgtttatcagttctaatctttttgtggatcctttaggtttttccaaatataagattatatcatctgtaaacaaggataatttgacttaatcctttccaaattgtatatcgtttgtttctttctcttgtctaattgctgtagctaggacttacagtactatgttgaataacagtggtgaaggtgaacatccttctcatgttccagatactggagcaaaagctttcagttttttcccattcagtactatgatagctatgggtctttcatacatggcttttattgtgttgagataaatgttccttctatccctagttatttgagggtttttatcatgaagggatgttgaatttgatcaaattattttcagcatcaagtgaagtgattgtataattttttccttcattctgttgatatgatgtatcacattggttgatttatgtatgctgaaccatctgtgcatacttgggataaatttcatttggtcatgatgaatgatctttttaatgtattgctgaatttagtttgctagtattttgttgaggattttttgcaacaatgttcatcagtgatattggcctgtaattttctttatttttttacatgtctttggttttggtattagggtaatgctgccctgatataatgagtttggaaaaattccctcctctatttttcaggatagtttgagtaggattggtattagttttttttaaaatgtttggcaaaattcagcagtgaagccattggatcctggacttttctctgctgggagatttttcattacatcttgtatctcattacatatcattggtctgttcatattttgggtttcttcatggttcaatcttgggaggttgtatctgtctaggaatttatccatttcttctaggtgttcaaatttattggcatatagcagcctctaatgatcctttgaatttctgtagtatcagttgtaatgtctcctatttcgtctctgattttatttgttatctcttttttctcaattaatctggctaaagatttgtcagttttgtttatcctttcaaaaacgaacttcttctttcattgatcttttgtattgtttcttcgtttcaatttcattggtttctgctctgacctttattatttctttacatctactaactttgagtttggtttggtcttgcttttctagttctttaagatgcatcattaagttgtttatttgaaatttttctatttttttcttttgatgttggttttgatggttaataccgagtgtcaacttgattggattgaaagattcaaagtattgatcctgggtgtgtctatgagggtgttgccaaaggagattaacattagagtcagtggggtggcaaaggcagacccacccttaatctgggtgggcacagtctaatcagctgccagcatggctagaatatgagcaggcagaaaaatgtgaaaagagagactggcctagcctcccagcctacatctttctcttgtgctggatgcttcctgccctcgaacatcggactcccagtttcttcagctttggaactcggactgactctccttgctccttagcctgcagacagcctattgtgatacctgatgattgtgtgagttaatatttaataaacatatatatatatattccattagttctgcccctctagagaacccttactaatacattggtgcttatagctataaacttcctttttgctactgcttttgctgtatcatgtaggttttggtatgctgtgtgtccattatcatttgtttcaaaaatttttttcaattttattcttaattgtttatccatttttgagatggagtcttgctctgtcacccaggctggagtgcagtggtgcgatttcagctcactgcaacctctgcctcctgagttcaagcaagtctcctgccttggcctctcaagtagctgagactacaggcacgtgccaccacatctggctaatttttgtatttttaatagagatggggtttcgccatgttggccaggctggtcttgaactcctgacatcaagtgatgcacctgcctcagcctcccaaagtgctgggaatacaggcaattttattcttaatctgttgatccattggtcatttaggagcctattgtttaatttccatgtgtttgtatagtttccataattcctcttgttactgatttctaatttttttccatcttgggaagagaagatacttcatgttatttcagcttttttgaatgttttaagacttgttttgttgtctgttatatagtctacccttaagaattatccatgtgctgaggagaagcatatgtattctgcagcctttggatgaaatgttctgtaaaaatctattaggtctatttggtctatagagcagactaagtccaatgttttctttgttgatttctatctgaatgatctgtctgaaagtacggtgttcaagtcttcaattattattttattgagatctctctttgtttttaggtctaataatatttgctttacacatctgggtgttccagtgttgggtgcatgtatatttacaattgttatattctcttgcttaatctttatcattatataataaacttctttgtcttttttatagtttttgccttaaaatgtattttatctgatataactatagctgctcctgttcttttctggtttccattggcatggaatatctttttccattcctttattttcagtctatgtgtgtctttataggtgaagtgtgtttcttgtaggcaacagattgttgggtcttggtttttgtttgcttctgtttttgtttttacaactcagccagacacttcatgtcttttgaataaagagtttagtccattcacattcaatgttaatgataaataagcatcattaactgtgttcctgccatttgttatttattttctagttgttttgtgctattctctttcatctttctttttttcctgtcttccttttagtgaaggtggttttctctggtggtatgttttaatttcttgcttttaattttttgtgtgtatctgctgtgtttttagatttgcaaataatgtcttataacccattattttattttaattattattattttttgagatggagtctcgctctattacccaggctggggtgcagtggtgagatcttggctcgctgcaggctccgcctcccaggttcatgcctcccgagcagctgggactacaggtgcccaccaccatgcccagctaattttttgtatttttagtagagatggcatttcaccgtgttagccaggatggtcttgatctcctgacctcgtgatccacctgccttggcctcccaaagtgctgggattacaggcgtgagccaccgtgcctggccaacgcattattttaagctgatcacaacttaacaccgagtacataaacaaacaagcaaatgaaaagtaataaaaactgcactttaacttcatcctctcactttttatcttgctttgttttatttatatcttattgtactgtttctgttttgaaaagttgttatagttattagttttgcttggttcatgtttttgtttttctacttaaattataagtagtttactgaccacaattccaatattataatatcctgtgtttttttgtgtacttactaataccagagagttttgtaccttcagtgattacttactgcttattaatgtcctttttttttttttttatcagattgaagaactccctttagcatttcttataggacagttctggtgcttatgaagtccctcagtgtttatctgggaaagccattatttctccttcatgtgtgaagcatttgtgtgtgtgtgtgtgtgtgtgtgtgtgtgtgtttgtgtttgtgtttgccagatatactattccagaataaaagattttttccttcaacactttaaatatgtcatacttctgtctcgtggccagtaaggtttccactgaaaagtctgctgccagatgtattggagctccattgtatgtttgtttcttttctcttgttgcctttaggatcctttctttatccttgacctttgggggtttgattactaaatgccttgaggttgtcttctttcagttaaatttgcttggtgttctgtaaccttcttgtacttaaatattgacaacttcctctagatttgggaagctccttgttattatccctttgagtaaactttctccccctacctttctctttacctcccctttaaggccaataactcatagatttgccctttcgaagctattttctagatcttgtaggtgtgcttcatagtgttttatttatttatttatttatttgtctcctctggctctgtcttttcaaataccctgtcttcaagttcactaattgtttcttctccttgatcaattctgctattaaaatactttgatgcattcttcagtatgttaattaaatttttcaactccagaatttctgtttgattcttatttcaatctttgttaaattaatctgataggattctgaattccttctctgcgttatcttcaatttctttgactttccttaaaacaactatttcgaattctgtctgcaaggtcacatatctctatcactctgggtttgatccttggtgcattatttagttttttttttttttgttggggtcatgttttcatggatggtcctgatgcttgtgattattcctcagttcctgggcattgaaggtatttattgtagtcttcacagtctgggcttgattgtacctatgcttttgtgaaggctttccaggtatttgaagggacttgggtgttgtgatctatgtttttgttcactgtagctgaatctgcattaggaggcaccctaaacacagtaatgctttagttcttgcagactcatagaggtaccaccttggtggttttggatgagatctggagaattctctggattgccaggctgagactcttgttctcttcccttattttctcccccaaaaaacagagtctctctctctctgttctgaggctgtgggtggggagacacagcaccctgtggtcaccaccactgggactatgttgagtcagaatgaagccagcacaacactgggtcttgcccaaggcctactataaccgctacctgtctgctgcctatgtttgctgaaggccctagggctctgcattcagcaggtggtgcagccagccaggtttgtgttcttcccttctgtgcagcaagttcccctgggccctgggtgggtccagagattccatctgggagccagggcctggagtcagaaaccttagaaatctacctagtgcattatctacctgtgactgagctggcacccataatgtaagacaaagaatcgtcccagttttccttccccttttcccaggtggaggaatcttttcctctgtccaccaccaccacaggcccatggaagtagtgccaggctaccactgatgttcccttaaggcccaaagtctcttcagtcagcttgtggtaaatgctgcttggcctgggactcatccttcagggcaatgggcttctctctggcccagcttagttccagaaatgccatctaagagccacagcctggaattggggaccccaatagcctgcttggtgctctatcccactgtggccaagctggtacctaagctgtaagacaaaatcctttttactctttcctctgcttttctcaagtagtaggagtctctcctcatagctgtgaatgtgctgggtcatgcctgaagccagcatgtctcagagtctcatccaaggctcatccagggtccgtgggctctttagtcagcaggtgatgaatactgcctggattcggtcctttatttcaagtcagcaggttcccctctggcccaaggtatatctagaaatgtcatctgcgagctagggcctggaatgggggcctcaggactctgcctggtgtcctatcctactgtgactgagctggtatccaagttgcaagacaaagtcctcttcactcttccatttcctctcctgaagcagaaggaagcagtctttcttggagctgtgagctgcactgcctggggttgggggagggctggtgcaagcactcccttggccacactagctggtgtctaactaggtcacatggcccccaggttagctggctctgagtgcagcacagtattaggacttgcctacgagttgcagtccttgtggcttagactgcctttcaggtttatttaggaacccagagactttaacccatggtggtgaggcttgctgaaactcagattctgaccattgggattggggattcccttctagctagagcttgactaaatgctctcactgtgggcattggctgaattctgcccgttggcagcgctgagttccaatgcaaagtcccacaatcattgtactccctctctccttagtgcacagattctttttgctatgtggctgctgctgggggctgagggagggatggggtcagcaattcaagactgtctttcctaccttcttcagtgcctctttcagtgatatgaagttaaaaccaggtactgtgattggtcacctgattttgggtttttataaagatgcttttttgtgtgtgtgtagatagctattaaatttggtgttactgcagggaagataattgttgtaggcttctattcggtcatcttgcttcacctcctcctgaagaatttgaaataggattggaagggcacttggagatttttaccagtgaataggggtttgggtgttggtgaagtgtttttgtttaagtagttttattattgatattctaactgaatcaacaaatatttttaaaatcctttttaaaaaagtatggttggcacataattgtacatatttacggggtacaatgtgatgtttcgatatatgtatacattatgtaattatcaaaccagggtgattagcatatcaatcatcttaaacatttataatttctttgtgatgagaacattcaaaaacctcttctagctattttgaaatatacaatacattattgttaagtttagttatccaactataaaatagaacaccggaacttgttcttcgtatctagttgtagctttgtaaaagttgaccaatctctttccctctctccttgcttctccttttcccataatctggtaaccactcttctactctctacttctctgtgaacagctttttagattctacatgtaagtgagatcatgctgtatttgtctctgtctaccaggcttatttcacttaatgtctttcaggttcctctaagttgccacaaatgacagaattttattctttttttatggttgaatactattccattgtgtgtatataccacatattttaaacacatttattcattgatggacatttatactgattccatatcttggctattgtgaataatgctatatgggagtgcagatatctctttgacatactgatttcatttcctttgtatatgtactcagtagcgggattgccggatcatatggtagttatatttttagttttttgaggaacctccatactgttttccatgatggctgtactaatttgcattcccaccagtagtgtgtgaggattcctttttctccacatccttgccagcacttgctatcttttaattttttgagagtatccattgtatctcattgtagttttaatttgtatttccctgatgattagtgatgtcaagctcttttttttttcatatatctgttagccatttgtatgcaaatttgagaaatgtctactcaggtcttttgcctatttgttaactgggctttaaaacatttttcatttattttatttatttttatttttccataagttattggggtacaggtggtatttggttacatgagtaagttctttagtggtgatttgtgagattttggtgcacccattacctgagcagtatacactgcaccatatttgctgtcttttatccctcaccccctctcactcgtctccccaagtccgcaaagtccattgtattattcttatgcctttgcatcctcatagcttagctcccacatatcagtgagaacgtatgatgtttggttttccattctgagttactttacttagaataatagtctccaatctcatccagatcactgcaaatgctgttaattcattcctttttatggctgagtaatattccataatatatataccatagtttctttatccatttgttgattgatgggcatttgggttggttccatgattttgcaattgctaattgtgctgctataaacatgcatgtgcaagtttcttttttgtataatgacctcttttcctctgggtagatacccagtagtgggattgctggatcaaatggtagttctacttttagttctttaaggaatctccacactcttttctatagcagcattactagtttccattcccaccagcactgtagaagtaactgggttttttttttaaatgagtttttgtagtttcttatatattttttatattaaccccttatcagatgtatagtttgcaaatatattctttcattttataggctctttgctctgttgattgtttcctttgatgtgcagaaggctttagtttgatacaatcctatttgtctgtttgcttttattgattatgcttttgagcttttatccaaaaaatccttgccttgaccactgtcatggagatttctcacgtgttttcttttagtagtttcatagtttgggtcttctgtctttggcccattttgagttagttattgtatacgttaagaaataacggtctaattttattattttgcatttgggtatccagtttttccagcatcatttattgaagagactgtcctgtctccattgtgtttactcaacacctttgtttcaaatccttttccattgttgcatgtctgtttttatgccagtatcatgttgttttggttatcatatctttgtagtatgttttgaagtgaggtagtgtgatgcctctagctttctttttgctcaagattgttttggctatttgagattttttgaggttccatattaattttaggatttttttttctatgtctgtgaagaatgtccttagtattttgatagggattgcatggaatctgtagattactttaagtagtatggacatttaaacaatattaagtcttccaattaatgaaatttgtccttccatttttttgtgtccttttcaatttctgtcatcaatgttttatagttttcattgtagagttcttttacccccttggttaacttttcttctgggtaatatttttggtagttattgtaaattggattgctttcttgatttctttttcaaataatcaattattggcatatggaagtgttactaattttgcctgttgattttatagcctgagaccttatcaaatttattagttcttatagtttttgtggtgatgtctctgaggttttatataatatatataaaattatgttgtctgcaaacaaggacaatttaattttctctgttttagcttggatgctctttatttctttattttgccttattatttaggctaggacttccagtaatatgttcaacaaaagtggtgatagattgtccagattatcttgttccagattgtagagagaaagctttctgcttttcctcattgtgtatgatattagctgtgaatttgttatatatgacctttattatgttgaggtatataccttctatacctaatttgttgagaattttcaacataaaggagtgttaaatgttataaaacacgttttctgcatctattgagatgatcatatttttttttcctccattctgctcatgtgctgcattatgcttattgtgtttcacatggtgaaccatccttgcatccctgggatgaatcctacttgataatggtgaaggatcttttttgatgtactgttgcactctctttgacagtattttgttgagaatttttgtgtctatattcatcagggatatgggtctgtagtttatgttattgtttttgcttttgttattttgtatatgtgtatccttttctggctttgtcagtgtaatgctggcctcatagaatgagtttggaagaattccctctaattcagttttttaaaaaatattttgacatgaattggtattaattcttctttatacagtaaagcaacatgctaagatggttatttttagagagagctcttaggtagttgtgcaaataattaatttagcatgctggcatttatgttgttaattaaaggaggaggtcagttcagaaatcatggtttggattaggtactcttcaaattgtacctaaaagaaatagcagaggggccgggcgcggtggctcacgcctgtaatcccagcactttgggaggccgaggcgggcggatcacgaggtcaggagatcgagaccatcctggctaacacggtgaaaccccgtctgtactaaaaatacaaaaaattagccgggcgaggtggcgggcgcctgtagtcccagctactcgggaggctgaggcaggagaatggcgtgaaccccagggggcggagcctgcagtgagccgggattgagccactgcactccagcctgggcgacagcgagactccgtctcaaaaaaaaaaaaaaaaaaaaaaaaaaaaaaaaaaaaaaaaagaaatagcagaggaaagagatggaactagctgaaagctaaattgattccatgtatcacaccttcaaaacagagcttatttttgaagcttcattatattgttttctgcaggttactccaaggacatttcatttttcttatgaccatgggtgaccatattttctaaagtcagagtctggggaacatatactctgataaataattttaggctgacgttagagataattcttaatccagaagattgggtttagtctctgaaatcatggaatccttgggatgtgttgttcactaactggaaaataggacaatacattatcctagaataactttccttgaaagtctgtatagtcattgtaggtttagcagaattggccctgtagaaatagttagtagatatacatgatgagtttgaagaggacgtgataaaaaaaaaccattgctggctcatttgtctcttttagttctgctccgatttgattctgggtactcagctctcagctttgggaatatggaataatttatctctttctgagtattatatattcagtgtcttgagtttatcttgattcaaaccaacaagaggtgggaatgctccttagctatttccagcattcaaaacatgattatgtatttgttaaaaagagaaaatgaattcattttgtgcctttttactccagcattgttcacagatgaatcttgagctaaaaactggagctgttggtctgtgtacccttaagtggtatcagctttcagggtgaatttgcacttctcttgagacataatgaaaagggaagtgaatttgattgatccttagtatctattaataattttaccttcattctctaattttgtctttatcacaaccaagatatgtaggtattttttaaaatttcaacttttattaatttaatttatttattttgttatttataaataaatttatttatttatttatttatttttttgtagagatggagtcttgctctgccacccaggctggagtgcagtggtgcgatctcggctcactgcaagctccacctcccgggttcatgccattctcctgcctcagcctcccgagtagttgggactacaggcgcacaccgccacgcccggctaatttttgcatttttagtagagatggggtttcaccgtgttagccaggatggtctcgatctcctgacctcgtgatccgcccgcctcggcctcccaaagtgctgggattacaggcgtgagccaccacacccagcctaaaatttcaacatttattttaggttcatggtctatatgtgcaggtgtgctacattggcatattgtgtgatgctgaggtttggagtacaactgatcctgtcacccaggtgctgagcacagtacctactaggaagtttttcagcccttgcctccaccctcccaccgctctaaatagtccccactatctattgttctcatctttgtgtccatatgtacccaatgttcggctcccacttataagtgagaacatgcagtgtttggttttctattcttgtgttaattcacttaggataacgtccttcagctacgtccatgttgctataaaggacgtaatttcattcttttttttatgtctgcgtagtattccgtggcgtttatgtaccacattttctttatccagtccactgttggtgggcacctagattgattctatgtctttgctgttgtgactagtgctgtaataaacttgtgagctcatgtgtctttttgttagaaagatttgtttttgtttggatatatacccagtaaagggattgctgagtcaaatggtagttctgttttaggttttttgagaaatcgccaaactgctttacacagtgactgaactgatttacattctttacgttctcaccagtagtgtgtaaatgttctcttttctctacaaccttgccagcatctattatttttttgactttttaatagtggccattctgattagtgtgagatgggcccattgtggttttggtttgcatttctctctctgctttttgtttgtttgtttttttgtttgagacaaagtctctctctgtcgcccaggctggagtgcagtggtgtaatctccactcactgcaacctccacctcccgggttcaagtgattctcctgcctcagcctcccaagtagctgggattacaggtgcctgccaccacacctggctaatttttgtatttttagtagagacagggttttgtagttttagtagagacagatttgatgttggtcaggctggcctcaaactcctgacctcaggtgatccacccgcctcagcctcccaaagtgctgggattacaagcataagccaccgtgcctgcctgtggtttgcatttctctaatgattagtgatgtggagcatttttgcttatgttttttggccactcgcatgtcttcttttaagaagtttctgtacgtgtcctttgcccatttcttaaatggggttgtttttggcttgttgatttaagtcccttgtagattgtagttattagaccattgttagatacatagtttgcaaatattttctcccattctgtaggttgtcttttacgctgttaatagtttatcttgctgtgcagatgctctttagtttagttaggtcccacttgttaatttttgtttttgttacaattgcatttggggtcttagccataaattctttgccaaagtcgatgtccagaatggtatttcctagattttcttctaggaattttataatttgaggtcctacttttaagtccttaatccatcttaagttaatttttatatatggtaaaatgtaggggtcctgtgtcattcttcagcatatgcctagtcatttttcctggcaacatttattgaatggggagccctttccccattgcttatttttgtcaactttaccaaagatcagatgattgtaggtgtgtggtttcattttcagggtctccattctgttccattagtttatgtgtctgtttttgtaccagtaccttgttgtttttattactatagtcttatagcatagtttgaaatcaggtaatgtgatgccttcagctttgttctttttgcttagtattgttttggctatttgggcctttttggttccatatgaattttagtaatttttttcaattctgttaaaaatgacattggtcgtttgttaggaatagcgttgaatctgtagattgctttgggcaatgtggccatttaaacaatgttgattcttcaatccatgagcatggaatgtttttccgtttgtttgtgtcatctatgatttcttttaacagtgttttatagttgtccatgtagagatctttcgttttggttagacttattcctaggtattttatatttttgtggctattgtaaatgagatttagttcttgatttggctctcagtttgaacattattggtatatagaaatgctgctgatttttgtacattgattttgtatcctgaaagtttactgaagtcatttatcagttataggagtcttttagtggagtctttagggatttctaggtatggaatcgtgttgtcaacaaagaatttaaatccttcttttcatatttggatgctttttatttatttctgttgctagattgctctggctagaacttccagtcttatgttgaataggagtggtaagcatgggcatccttgtcttattccagttcttaaagggaatacctccagtgtttacctgttcagaatgttgttggctgttggtttgtcatagatggctcttattactttgatgtatatttttttccatgtctagcttgttaaaggttttcattatgaagagatattggagtttaccaaaagcctttgctacgtctattgagatgatcatatgatttttgtttttagttttgtttatgtgttaaatcacatttgttgatttgcatgcattgaaacaactgcatctcaggattaaagctcacttgatcatgaagaatcaagttcttgatgtgcttctggtttcagtttactagttttttgttgagaatttttacatctatgttcatcagtgatattggcctgtagttttcattttttgttgtgtctttgccagatgttggtatcagggtgatgttgacttcttagaatgagttagggaggagtccttcctactctagtttttggaatagtttcagtagaattggtaccaactcttctttgtatgtttggtagaatttggcagtaagtctgtctggtctagggcttttttttgcttggtaatttttttactgactaaatttcagatcttgatgttggtctgttcaggatttcaatttcttcctaattcaatcctgggaagttgtgtgtatccaggaatttatccatttcctctagattttcgagttcgtgtgcataaaggtgttcataatagtctctgaggatcttttgtatttctttgatatcagttgttatgtcacccttgtgatttctgtttgtgcttatttggatcttctcttttttttccttgttagtgtagctagcagtctatcaatcttctttatcctttcaaaaatccaatctttggttttgttgatcctttgtatggattcctggatctcaatttcctttagttctctcctgattttagttacttattttcttctgcttgctttggggttagtttgttgtcgcttttctattcctctagctgttatgttaattgttgatttgaggtctttctaacttcttggtgtagacatttcctctttatactgcttttgcttcctcccagatattttgatatgttgtgtctctgttttaaagattttttttttgatttctgccttgttttaattgtttattcaaaagtcattcaggaactagttgtttaatttccatgtagttgtatgattttaagaaatcttcttggtattgatttctatttttatttcactgtggtccgagagtatcattggtatgacttgctttatggaaaagcatgtggttgatcttagagaatgtctcacgtgcagatgagaaaaatgtatattctgtgtttgatggatggagtattctatagatgtctattagtttcaatcagtcaagtgttgaatttatgtctagtatttctttgttagttttctttttcagtgatctaatactatcagtggagtgaagtccccaactattatgtgtgactttctaagtctttttgtagctctaaaagcacttgttttgtgaatctgggtgctccatttttgggtgcatatctatttattataagtaagtcttcctgttgaattgaacttttcagcatacgtaacgtctttctttgtccttttttaatgtggttggtttgaagtctgtttcatcccatataagagaagcaacccctgctttttttttttttttttttttttgtcttcggaatcaggaaactgctattcagagaaattgagtagtttgtccaaagtcatacagatagaaaatggcagagccacaatgcaaaacaaaatttgaagattttgaaatcagattgggaagacatttaatatttgaactggtgagttatctttaaatatcatttctcatctcttacctttagtattacttcatggtagtaattacagttttgctgagttggatatgttgagattgatgtaattctagcctgacttagggcacttatcattgtctagcttggggagcttcccaaatgggtcccaagggccactgggcatgtaagccgcccttagaaaagaagagttataagattaaatacatttgggaagcatgactctctttcttggaaaatcacaataaatattagcatattgagagctcttcaaatcatgtcataaagtattagtccctgtgctaggtacttcaaatgtgtggtggcatttaatctgtacaaaacagtaaggtattattaccctcgcatcacagatgaggaaactgaagcacagattgttggctgctttgccaagagtcacccagctagtaaagtgatggatctcagagtcaaacccaggtatctggctcctcagcacattttcttaaacagtatattttactggctctttaaacttacttacccagcatttcccaaacttacttttatcatgcagtgctttggtggtatttttaatgccatttatttgacctagcgtgctaacaaacactggaaaatgctgcatgtacagcattgattcgaggccatgatggactttcagtctagataaaagcggcagagtcttggacccctgaacatagtggaacaggtgaggttgtcagagaacagtcagtgagaggaaaggcttggtggcgtttaacccaattacagtgttgcattcatgattggtacctgtactttgtctttctgaggtcagtaataaaacatctcctgaaaaaggccgttgtttacatgctgcaaagatgtccagtgcccacttgggcctgtggtccactgagggcaatgtgtgggagctctctacttgtcaagattcagaggcagaaagggggctggacaactgcaatgtctgtttctaaattgttacatgagacttttaaaattgtctaaaagtttcagatgagggtaagataaataacctctgagctgtccagtaaatgaaaaatataacattcagcctttatcgataagttccccttctttaagccagtgtagaccccagaaatgggtgggttatatctggttgaaattcaggcaccttaaaacttgaagaaagccatgagaatttgtcaatatctttacccacttttttgcaaaggatttgaaatatggtaagtacagcaactccaggggttaaaaatagtttcatttttcatctttcagaggactctggggacataaagcactattaactgtagttgtatggtgcctaagggacaaagagatgatccgcttgattccttgagctcctttcaggcagacttcaggaggatctttagtaagtcttactggagagtgagataaggttctcaatctagactgtagtgacaatggaacttggaccctatatcagttttgaaggctggttttatggccccaaatttctggttacaggaatgttaagcagcatttttcagtgacaactcttaatgctttgttgtttctgggagactagaatagttgcttattcttgtgcttggagaacagtgatgttttgaaagcctgacataaggtaaccacaggtatatacagaatgtatgaggctaatccttccctgacaaatattagtggaaggcagacagtcctgtatgctctggaggcctgtggccggtttacacccattctgctcttttcttctctaaaatgttattaaatacctattataaactaggtgctgtgctaggagctggggagattgagatgtacccttgtgagaggcaggtcactcaacagttacagcacaccataatatgtgttacaaaagaaatgagtaatatcatgtcactcctttggttagcactcttaaatttcttctccactaattcataataaaatccaaagtccttaccaaggctgtgtttctgtgagatctggctctttcctgcccttctgacttcatctcctgcccctactacattgtcactgagctcagccacagtggcctccctgttgttcacaggcatgtccagcttcctcttaccctgccccaagccctttgtacctatttctcttgtcaaagaatagaatacccttttcctcataggactcattgattacttattcagacctcctttcacagatttacaccttattagagagccttccttgatagctgtctctagcgtagccccttctctgcccctgccatgctatatccccattaccctgatttatgttttataaacttgtcacctaacaatatatatttattttgtttctttctcttttctgttagataaacaactcaagtgcagaaactttatttggcttgttcactgctatatcccaagcactttgaacaatgcatggcaccttgtagatgccccatcaatatttgccctattgagaagcaggaagagaaggaagccattaacccttccagggaaagtcaagggaggctttatagaggagatggcatttaaactgggacttgaagcatgagtcagagtttaccaggtggagaagttgtgggttgcagaggtaggtggagggagggaacgattatggtcatgatatcaaagacaaaggcacgatgcattactcctttccctcctccacccttctccttcctctacctgtctctagaatacaaattactatccagcttaatttctgggagagtttaccactgagcagcttgctctcaggctcctacactacagtaagatgtgtcaagtgcctgattgagcttaagtatgattatgatgaggttgaggaaggtgtggatgtattcattcttctgcagtgacattatcagctcataaccagctccttatatgaagtacacagggatttcacatgctggcagagggattgtaaaacatcttgaattgattgtagggtaataatgtccatctccaaaaggacttgttatgattataatatgtccaactgttttcatatgtttaaaactcaggatgaagttagatctccacttggggctttttctcactctgacacattggaattttaatagagcctcagcagctagatctttaaagtgagataatgttcaaacactttaattaaatttttgaaaagggcagcaataacttacataccaacaggctcagcctgggttctgtagtgattcacatattgcttaatctgagtaccagggcttctctcttgttcatttgtatgttactggggagcacttgcttagcaaatgaagaagagccatcagaaagctcttatttaataccctcaaagagattagctgagggcctctctctagttcccactgggtaggcagtagtactacgtccagttcttttccatttttctcttttcttctgaaaggcttctaccaaggatattaaagtgcttaatcaggccactgtgtttagttaagttcatactgggtccctgagtgtccccaagtcagtctaggagtggacaggagcagatgataactagcagtgaagagtagactgagggtcagggggcatatacgagaatgactcataggcaaaatagtaggttggaaaccaggcagacagactccaggagacacgcagaagttgaagaggtaagctcaagggaatggcttggtaaactggcataatcaggactcagagagcacttgggtaatagacattaagtcctcacagaaagaaatcaaatagatggtatagcagatggaagccattagcaatcagatgatcaaattttctaccttcatttcctggcagggcttgatatagcataaatgcctagtatattttggttgaatgaatgcgacaaactttttttttcttcggagacaggaagccttttgtagagcaagagtcattcttggggcaggtatgcccagggcctgcaggtgtgggtgggtgaaacacctcagagatgttttaatagattcatctgtttaaaatgaaaattgtggagcttgatttttggcagattttgacagttcaccagtgtcaggggtagcaaggtagttcttacagtccttcatgtggatgatgtaggtgagtcttgaagagtgggtatgatttgccaggtgtccaggagtagaaaaacattccagtcaccaggaacagtggttaccagtgcaggatggggaggtaaaggttggagagaacgctggaagattggaggtggtaagatcattggaagtcttatgtgctcagctttgcttaaagaccttggtcttgtagtaagatagactgaatgaatgaatgatgcagtggggagtaaagaggtctaaagtaagtgtagtttgcagtggggagcatgagctctggtggtacacctaagagcttggcttggaaagctgaagagaacagttctgccagtgacaagggtcataaatgaaccatgaaggaaaacagtacagtaaacagcagaaaatacaaggtctgtatattagtctgttttccagctgctgataaaggcatacctgagactgggcaatttacaaaagaaagaagtttaattggacttacagttccacatggctggggaagcctctcattatggtggaaggcaaggaggatcgagctgcatcttacatgaatggtagcaggcagagagaatgaggaagatgcaaaagcagaaactcctgataaaaccatcagatctcgtgagacttatatctaccaccactagaacagtatgggcgaaactgtcgccatgattcaatgatctcccactgggtctctcccacaacatgtgggaaatatgggagtacaattcaaggtgagatttgggtggggacacagggtcaaaccatatcagtctggaaggggcagcagcagtaggactgcagggagggtcacatggaaacattgagtctttttccacacatgcagccaaatccccttggacttcagaaggcacagaagacatggctgaatattttaattgcttggagagcttttaaatataaaattcggaaattgttataaaatctcctgaatctgagtgcttgggaatttggtctgggaatgtcagttttaaataagtttccaggtgattctaatgcaaatactctgccaagtatgtgggaatcacaggagggtagctatactgtatgccctctctcaaaaaggccatagagaggaaacagccacccaaccagtggtggaaggcgagccaaggctcatggaaatccttcagaaatgcccctgcacctgccccgaagaaagcctcacacaatctaaattggttaggatacaggagtgactactgaagcaaatactcaaacaacaatgatttaaacaagatggaagggtaatactctttcatgcagcagtttgaatgtgggtagttaatatggtctggctgtgcatcctcacccaaatctcatcttgagctgtaatccaaattgtaatcccatgtgttgggagagggacctggtgggaggtgattagatcatggaggtgattccccccatgctgttctcatgatagtgaatgtgttctatgagatctgctggctttataaggggctttcccccacttcgctctgtgcttcttattcctgctgccatgtgaagaaggacgtatttgcttctccttctgccatgaatgcaagtttcctggggacttcccagccaagctgaactgtgaattaattaaacctcttccctttataaattacacagtctcaagtatgtcttcattagcagtgtgagaacagactactacagtaaattggtgccaggagtgggttgctgccataaggatacctgaaaatgtggaagcaactttgaaactgagtaacaggcaggggttggaacagtttggagggctcagaagaagataggaaaatgtggtaaagtttggaacttcctagacacttggagggcccagaagacaggaagatgtgggaaagtttagaacttcctagagaattgttgaatggctttgcccaaaatgctgatagtaatatggacaatgaagtcgaggctgggatggtctcaaacagagatgaggaacttgttgggaaatggagcaaatatgactcttgttatgctttagcaaatagactgttggtattttgcctctgccctagagatctgtgaaactttgaatttgaaagagataatttaggatatctggcagaagaaatttctaagcagcaaagaattcaagaggaagcagaacataaaagtttggaaagtttgtagactgacaatgcgatagaaaaaatccattttggggagaaattcaaaccagctgcagacatttgcataagtaacaagcagccgaatgttaatcactaagacaatatggaaaatgtctccagggcatgtcagagaccttagcagcagccactcccatcacaggtccagaggcctaggaaagaaaaatggttccctgagccaggccattgcttcagagggtgcaagccccaagtcttggcagactttatgtggtgttgggcctgtaggtccacagaggtcaaaaattgatgtttgggaacctctgcctagatttcagaggctgtatggcaatgcctgcttatccaagcacagtttgctgtacggacaaaactctcatagagaacctctgctagggcagtacagaaaggaaatgtagagtcagagcctccacacacaatccccactgggtcactgcctagtagagatgtgagaagagggcaactgtcctccagaccccagaatggtagatctaccgacatcttgtgccatgaacctggaaaagttgcagatactcaatgcctgcccattaaagcagctgggaagggaactgtaccctgaaaagccacaggggcagagttgcccaaggccatgggagtccacctcttgcatctgtgtgacctggatgtgagacatggagtcaaaggagattattttggagctttaagatttgattattgcctcattggatttcgaacttgcatgggcctgcagcctctttgtttttgctaatttctccctttggaatgggtgtattaagccaatacctgtacctccattgtatctaggaagtaactaacttgcttttcattgtacaggctcataggtggaaggaacttacattatctcagataagaatatggacttggacttttgggcaaatgctgaaataagttaagactttggggaactgttgggaaggcatatttgtgttttgaaatgtgagaaacacatttcaaacctgggaggggccaggggtggaatgatatggtccggctctatgtccccacccaaatctcatcttgaattgtaattcccatgtgtttggagagggaccttgtgggaggtgattagataatggaggtggtcccccatgctgttcttgtgatagtgagtgagttctcacaagatctgatagttttataaggggctttccccactttgctctgcacttcttcttcctaccaccatgtgaagaaggatgtgtttgctgctttttccatcatgatcataagtttcctgaggcctccccagccatgctgaactgtgtttcaaacctctttcttttataaattacccagtctcgggtacgtctttattagcagcatgagaatggactaatatagtagtccagagtttatgtgacaactttacaggaccgagaaactaggttcttctatattatggccctctgcctgtagtccttgatgattcagtcccattacctcactatgccagcatgaaggagaacaagaagaagtcaagagcattctccttacatgcattactttcactcatgtcccactggtgagagcttaatctcatgaccacgcctagctgtaaggaagatggtgaatgtgacctttattctagatggccgtgtgcttcactaagattcaattactaaaggaaaggggagagtgcacaccaggggacagctggcattctctgcctccaacattcttcagattttcactcacagggtcctgaactcctctctggacactcctctctggttaattattttttattgcacaattctggattaggaaccggctgggggattgacaccccttcaggaaaatcacccaaaggctgacctatagaagctggccttccctgaagttattgccataaaaacccctccaagcaagaatcagccttagtggaactaatctcggtatttgcctgatacatcttaaatttgcttgttcaggtgaacaagacctttgcatggaggagtgagacagactggacgtcagtagagagattatatttagctgagttgaagggaagggaactaacatttgctgaaggtatacttttgtgtgttaattgttttcgatatgcgataacacattcacccagaagacctgagtgtcagatctggctctattgctcactggcagttagtttaactataatacctttgagaggtttatgctggaattgccaagacacagccctggttttgcaataggagtgcggaaagaaccatggcttggtttatctgagtcgaaatattttcatgtgttaagatggggattctaatagtgcctgccaagacacgaacattaatgtctaatttccaattccatggacccccttatactatgattggaagagcctgagtgaccagtgtcaaagtaaacttatgtttttattcttgtgccaaagctctgtagatactgtcagtgctcattattgtgttatcaaatgaagcaggagaaagtaagtctttctttctgtatggcttggagggattttcaaggcttataattaggaactatttctcattgacggttttagctagggatgtaccatatttatatgttgctcacataaaagaccaattcaggtgtttctggctaggtatctgtcctgggaagctcttcttctagtggaaagttagaggcctagactctgtccacttcgtcattcttccatcttcaacatgtggtattccaggtgtttctgagggttgtctttattccagcaaccagaaagaggattgcatgtaggaggtttagggtcagccttggaagcagtacacatgtatcaattacttctgctgacatttcattgtccggaactcaagcatatggccacacctagtattattagcaagaaaggctgggaaatgagtcctagctctgtgccaagaagaaaagtaaattggttatgattttcttccaccctaagttaatgtgtactatcttatttttaaaaacacaatattctctgtgggggagtgatgaggttgtgcaaaactgtttaagtgacttccttctgttgtgatgggcaccatagattaaaaatatcttagtcccaaagggagactgctaaccgctgttgactctatgctacctactcccaacagcctcagcatctctttattggtgctagaaacttcatttcctttacaacatcctagacatagtgtcatggagcagaaagggcatctttagtattatataaacttgggtttctatcttggatctaccacttactggttgtattttcttggatgactttatatctttgaacttcagcttcttcatctgtaaactaggtataatcatatctgcccaatgggcatactttaaggatttaagacaatgtctggcacataggcactcaataattgtcaaatgttattattatttagatcccacgctttctgtcctaagtttaaagggcatgatttaaatgagatattctgaatatcttgttaatcttgcatgttctactcttggaatatctattaaaattagccatatttgaaatgtagtctccacatataacttgcaaacactagaaacccagaagagagttaataattgaaaaaactctcaagtttgtcattaccttaatgattggtatgaggagccattttcctagcacttttctaaaatttaacctagggagcttgttcatgctcaattcttgtttgggatcgctgcaggtaagggatttgtggaactgtcttggggttcctcttacccagtaattcatgatctactatattctgacttctgcctgccttctggccttcccactctgagatgtccacccagtctcacgtaggacaggagaactcaatatttttaatgctgttttatgctcatcatttgttttttcttttcagtcagttttagtgtctcactttctatctgttcttaagttttcatttttctgcaactgtgacaggtagaaggtggatttcacaattctaacctgggtgaatggatggcttctgttaatttattataagaataactcaatccgtgaggaagatgagaaccatgagccaagattttattgggaaaaaactatgattcaaaagagaaagtccagaggatccagtctttccttttttgcaagtccaaaagataaaatacatttttccattgggatgtcgatcactggtttggcttccttggctaggcctcttaggagagaagacagtgatttatttttttaactttttcttttacattaattttaggaagttgcaaaaatgatacagcaagtcttgtatatctctcacccagtttcctctaatattaacatcttacgtaaccatgataaaattatgaaaatcaggaaattgaccttgctgcaggactatttttttttttttttttttttgagacggagtcttgttctgttgcccacgctagagtgcagtggtgcaatcgcggctcactgcaacctccacctctcaggttcaagcaattctcctgcttcagcctcctgagtagctgagattacaggcacccgccaccacacctggctaatttttgtattttttagtagagaagaggtttcactatcttggccaggctggtctccaatgcctgacctcatgatccacctgcctcggcctctcaaagtgttgggattacaggtgtgagccactgcacctggcctgctgcaggactattaatcaaattccacatcttgtttgaattttgccaggtttttttttaatgaatataggattttttctgtttcaggatcttgtccagcccacatttcatttagttgctatttcttcttaatctcaaaaatgttacaatttgtcagactttcctatcttcatgactttgacacttttgaagagtatggccagttattttgtagaatggcccttagtttgagtttctgacatttcctcatgattaagttattattatttttttttggcaaggataccatagaaatgatgttgctttttctctgtgcatcacgtgaaaggattccttatattgatatatcttattactgatgatattatccttgattgcttggttaaggtggagcctgccaggattcttcactgtgaagttcttatttttcattttgtaattaaagaaattagtagtaaaggattttggctgggcgcagtggctcatgcctgtaatccccccaccttgggaggctgaggcaggtggaccacgaggtcaagagatcgacaccatcctggcaaacatggtgaaaccctgtctctactaaaaatacaaaaattagctgggtatggtggtgcgtgcctgtaatctcagctacttgggaggctgaggcaggagaattgcttgaacttgggagatggaggttgtagtgagccaagacccagactggtgacagagtgagacaccatctcaaaaaaaaaaaaaagtttttttccagccctcaactgagaaactgcttttgaatcactgaagtgagaaggtgtgttcctgtgggtctgtttatggaagaaggagaaagaatggagagcaacacctcagtaatacctggtcttctttttgctctctcttctgccctctgcctcctgggttcaagcaactctcctgcctcagcctcccaagtagctgggattacaggtgtgtgccaacactcctggctaattttttgtatttttagtagagacagggtttcaccatgttggccaggctggtattgaagtcatgacctgagatgatctgcctgcctcagactcccaaagtgctgggattacaggcatgtcaccacacctgactcctgaaatagcttttgtagactcttggtgtaataaaaagaggggaactcttttcttaagaatgcatttccaaggtagacagggatatattttatgtgatttgtaaaattccttatgtggaaaacaattattctatcacaaatccatcactaatctgttcctgtgagaacttttccagtctcaggatagcgagaactcactactatgtgaaaggcacccattcatttatgagagatacacccatatgatccaaacacttcccactaggccccaccccccaacaccaccacactggagatcaaatttcaacatgagttttggtggggacaaaccatatccaatcatagcaatcacctttttagggaacttgacttttgaagctttcttagtgtttgagagtcattgtttggcaaactctctcagagaaagtttgcgtcactgtttcaaactccactgaacatgtgagtaagtttctgatatcttcttgcattcttatgtccaagatcagagaagaataccttctaatatctaggaaatttcatctccagttcaacctgcacatcttaacaatcgtactcatcttgtaagaccttgctgctcatggtgtggcctgcaaaccagcagcaagaccatcacctggggcttactagaaatgccatatctcagaccccagcagaccttctgaatcagagcctgcattttgacaagttgactcatgtgcaccttcacgttcgaggaacacttttaaagtgtttacaatggctctgccttcttgatacctgaatgaattgagcttatcaaaaatttgataaaggcagcttcatgatgatggtggccaggaagctctttcagctcttagtggacattgtggagatgaagaacataacaggaattatggtagcacaggataagttgattaattttgaagcccactagttgttttggaaggtgggggggaccctggatatattagctttctagggttttattgacagtgagagaaagccctatgacacagagccatctcatctacttttttgaactgctgcagattgggcttaggtgtttcaagtttgcccaaaataaatgattctaaaatcaatttacctaacggccagtttacttaatggtaatttcccctaatagtactattaacataaaaattcatgtttgtgaaatttataagaattcacatgtgataggaaggtaaattggtttttgtcaaatttggtttcagatagagctgctttaggcaaatgttcacttacatatattagctctaggcaaatagattttatagatgaattcacctgatccaggtgtcctctcctgaggagggaacagggaattcagcgtagggggtgggaatgtttagtcattatttccactagcagtgatactgggtgtggaggaggctcctgtaatagcaagtgggctgggtgggagcttgctacactggtcttactaatggccccctgagatatttactacatagccctcacctgtttcagtgtctcactatgaatgaccgttaccacttaggcccatctgggctgcatcttctaagctcattcctaagcactgttcttcttagtgaccgtacacttttatgagactcttcacaatgctcatgtttagcctgggcttttcatgctgggttgctttatcccagtgtgacttaaactgaaccaggctttgtcacagaaccatgttctgttctctcgcggtacttatccgttttcaattttacatttattagtgtgattattttgttaacatctgtctcccactggattgtaagctctgtgaacacatggatcatatctgtttttgttcatcattgtgtctttagaacctagcaaagcacctagcaaattgtagagacttaatatttttgaaataaatgaatgaataccttaatgaacctctggcttttattagcagtaataaattacatatggcacatctcacagatgatggtgatacatcaaactgccttgacatagaagctgagaatcactgtagaaaataaaagtttcttatcaaggaggcaattcaggaaaattaacatttaaataatgatgacaataataatagctgacatttattgagttcttatagcatgctagttatgataagtactttaccataaaatttatcttactatatttattgagagctcaagtcttcctaacagaagcagccactagaacacgtttcctacaacccccactctcatcctccagtactgtggagccgtcagcaccaggaacaaaggagggttccatgttggttctgttaagggtagttcatttccagctcatggtggctggcctcatatcccactgaacgctctgctaatgatgtcagccttcccagtgactcttatgggtagtggaaatttcagttatgggacagagtggtctgtgttgattcttatagttctttcttccaagagggcctggcttaggcatcattgtcctagttttgtgtctttggtcatcatttaacttctctctgacttgctttcttcactaattaaatgaagatgataatagtacctccttctagagggttgttccaagaatttacttcaatattgtatataaagtaataactaaagtggtatgtggtaagacttgataaatgttagccattattattattattattatttaaatggtgcttttactgaattatctccttgatgagtaacttgttttctataagagtgactgtgaactgcaatgtcacaaccctttgttgtatcacaatcagcactaaggcatgccacctgtaatttgttactgttactacaaaccagatattactatatttattcatttattccaaaaatatttattaagtcactacaagtatgctaagtgttatgctaggctctgaagataacatggtgagaaaaacagatatagtccatgtgttcctaaagcttatccagtgggagacagatgttaacaaaataatgagaaaaatatttaagtacagagatagctgtgaaggaaaggagcatattcttatttaaaaaaaccctatgtggtggtggggagtgcaagtcaatggacttcctggggaggtgacatttaaagtgagagctgaatgagtagaagttagctagggaaataatgggataagagccttccaggtagttggagcaagtgcattgtagtgggagggatcgtggtatgtttgaagacttgaaagaacgttggtgtgtagagggcaagatagagagtgagaaagctgacactggaaagataggcaggggctaaagcatgtagtttcctgaagcgcatgcctaagacttctaggcttgagctcaatagtaataagaagacactgatggattttaagcttggaagtgggggtgcttggaagaagtcgataatatgattggattcttgttttaaaaaggtaactttgtctgtagaatagattggaatgggccggcgtggattcggtgagacctgataggaatctatatagttgctagtagtagatgttggtggataagataaggatgatagctgtgaaggagatttggaatggataaatgtggtagatactttggaacagaagcgatagaacttgctgatggtgtgcacatcaggtgctggggagagaaaggtgtcaaagacaatgcttaggtttttagcttctgttctgatataggatataatggatgaggcccaggttttggggaaagaattaggagttatgtgttgcgagtattgagtttggggtattccgggagagatgttgagtaggtagttggttatgcaagtaagcagttcagaagacaggtctagactggagatataaatttgtgatttatttatgtaaaaaagcaccctcctggctaacatggtgaaaccccatctctactaaacatacaaaaaaattagctgggtgtggtggcgggcacctgtagtcccagctactagggaggctgaggcaggagaatggtgtgaacccaggaggcagagtttgcagtgagctgagatcacgccactgaactccagcctgggcaacagagagactccgtctcaaaaaaaaaaacaaaaaacaaacaaaaaaaacccaccctaacttattagagtggagtcagggtccatagagccactgatatgatgcactttctgagaagtggagaaaggactggagttagaggtaagaaaacaaattttgcataactggtgacacccgtgggagtgtttgaacattacctgcctatcagtcctaacataaaatggtttgagaactgctaggctgtaggaaaagggccatatgtcagtggttggttctatgaatctagccccaacttacctttctgttgcttcacaactcctctgatctgtttgtgtacatcgtcagtgctgttcatacctcttctttctttgttgcctgagcatgccagacacatttcttcctccatgtttttacattttccccactcctgaagcacttctcttacccatctcactccagtttaggtcattcttctacatctagcttctttttgaaacgttctcacatcaccgttcaagattggatctcctctcctcgttttaaaggtcaaggatgtattgttgtctatctttccgtaagtttttattttatcgagtgacatgtaaattctttgacaagaggcatactttgtattaagtaagtgcttgttgcttacttatctttacacttagtgccttctttgcatatatgattttcaatcttgctttcacagtatgtaagcctggcttagccttgagaaaatgggcctttacctagttgtaatttgaatttgtgttgtagataagtgagtgattttaattttgagtgggagaatatgtatcaaattgaaaacagtaaaaataaagaaaatgctctgtgtataagaaagttttcttattacattaattgaaaaaagtatggaacagtgagaatactctgctaccatttgtgttaaagaggtgggacaaaatagtatgtttatacttgctttcatagcataagaaacctttggaaaaaacgttcttttcttcctaaaaaatgatgcttgcacaatgggacattcgtattcaaaagaattaactggacaaagaccctatgccttttacataaattaactcaaaatagattatgtactttactgtaaaatgcaaaactgtaaaaatcctaaaagaaaacataggagaaaatctacataactttcggttcagtgatgagcttttaggtacaacatgaatagtatgatccatggaagaaaaagttgttaagttagatttttattaaaccttaagccttctgctctaccagaaagattattaagagattaaaaaaacaagttatagattgggagaaatatttgaaaaacacacatttgaggaaggatttatatccaacatatataagaacaattgaaactcaacaataagtaaactcaacaataagtaaacaaaccaatttttaaaaataggcaaaatatctgaatagacatcttactaaagaagatatgtgaataggaaataagcatattacaatgctcaatatcatttatcattagggaaatgctaattaaaacaatgatataccattacacaccaattagaatgggtaaaatccaaaaaaaaaaaaaaaccccaacaataccaattgctggtgggaatgaatagcaacaggaatccttgtttattgctggtctgagtgtaatgtagtgcggcccctttggaagacagtttggcagtttcttacaaagctaaacatagtcttatcacaaaatcaaggaattgcacttctaggtatttactcagttgatttgaaaatgtattttcacaaaaaatcctgcaaacaggaagcaaccaagtccttcaataagtaaatggataaactgtggtacatgtatatgatgaagtattactcagctataaaaaaaaacaacgcatgattaagccatgcaaagacacaggtgaaacttttttttttatggctgatcctatttggatgaatctttaatgcatgttactaagtgaaagaacccaatctgaaaaggctgaatactgtatcattccatttatatgacactctggaaaaagccaaaaaaaagattaaaaaaagataacaaacagattaatgatttccagggctttgggagttaggggagagctaaataggtgaaaaacagaggaattttttaggcagtggaactattgggtgtaattctgtaatggtggacacatgacactatgcatatgtcaaaagccacagaaccttacagcacagagagtaaacctcaatgtgtacatatttaaaaaaatcatttaggaagttaagagatcccaggatggaattcagaatgtaacagaatatctaactgtattataaatgtgtgaaataacctcaacaacggggattggggaaataggagctgacttccggaactttggaaattaatggcgtatgtaggactaaaggcggaaggaactgtatatagacacttcacttgagttgataaagttgtttacctgagggtattggttaatgatattaaaaccactatacgtgtatacagaaagtgaataattaattaagtaaattgatggtagatcatgggagattacagataagcatgagacagagactagaattatctatgtgataacagattagagtttaagacatcagtatgaattcatgtttagcttactttagatacaaatagatacatatagaaatatttatagaaatatttatagatatgtgtatatatactgattgttatacacacacatatatttctttgttctgttggctgagagagctcagaagcagcaataccttgtagccatgagcacacatagtggccaaatcttgatttcgcataccattctccagtagaaggaacaagccttccttggagagatggttgattttaggattgggtcaggaaatatataagatgagccttgagcatcttgtagtactagaaagtaaggaaatgctcaaaacaaaataaaacaaaacaagaaacatgatgggagtaaatcaaagaaactagctgaaaaacgtccaacagctaaagctggaacaatttgagcaaaaaaataaacagtgttggattgtaacccaaagtaaaaaatgataacccatgagtctacactgatataataagtgtttgaataaataaataaatgagaatagataaatctcccatgcagtaaaattctaagtaatttatgtaaaatgaatcttttcatttcaatattccatcctcaaggaggtggaatataactccccactccttaagtgtgagctccacagggtgtcttccttccaaagaggacagtataaaactggtagggggaagagtatttttataacagagaaaactgaccaacacttagccagggagatgaaccctgatagtaacatcaatagtgatgtcatgtagtagaatgcattcttagatacgatactgtgagaattgcacattacttctatggcattcctccccaaaagtgacaaccctagtataattatgagaaaaattagacaaatcccaattgtcagatattttaccaaatatctggccagtactcctcaaaaccgtcaaggtcataaaaaaacaaggcaagtctgaactggcacagctataaggagcctgaggaggcatgacaaacaaatgtatcgtagcatcctagataagagtgtggaacctaaaaagggtattaggtgaaaactaagaaaatctaaataaaatatagacttggttaataatctattaatattggttcttaatagggcagactgggtgtgggctatgtggaaactctatttttgtaattttctgcaaatataaaactattgtaaaagagtttatcataaaaaactttgtacaaatacatgggacgccaacactagttgcctatgagggttgttggatactgagaagactgggtacaggatgggagggaaatttttcactgagtacctttatagatatatcagtttatttctcaacaatagaaataaaaaaatttagaaaactgaagattatatttcttgtttgggaacaataatatttcttctttaagcattttagataaaatttagaaacaagtatagaaagtgctacatatgttttggtcattagtacaattaccattaccactacaactacaaccaccactatatatttagtgcctatttcctaaatcttgctattcataaacatcttaattttgagttcctggagatccaaagttataccttagtcttaagatgcagttgtgcaattccaagcttagtgccttcggcttggttgcttaataaatgtttttatttgactttatttgcaggccttgacaatcaaaaccaaatgattcctctccccttgtcctgctaaattagcttattttttttttaaagtgtattctgccactaattttatttttctatcttaacttgcctgaagtttcatgtatttttcctggttctctagggaatttagaagccagcctttactttgttaaatacagcatggctaataccatgtggatttttaaagagtgtaatagaacagttttgaatgggcataaagagcctgaattttacatttcatttaacagtgagtgttttattttcaataacaaaggcagtttgtaattgctgtcacgattaatctcttgctatatgtttgctaagaggattgagtacagaactaatatgtaactttacaactacaagtaaaaatcaccaggtctagtctaaacaagagaaagggagagacagaaaagcacttctttctaagaaaaggcagaatgcgtatgctttcagcagcatcacacctttgtaaggcagttaattttcatgtatatagaaagatgaagggaaatcataatcagtgttggatactaggcagtttgtaaggcaatttacaaacgtatgtcattttattctcaaaagaaatctgtgaagtagatgtttattttcaactagatgaagaaaagaaggcttagggaaatgctgtgtcctgcccacattcacacatggattgaatggcagaggggagggattgatcacaagatatctgggttctgaagcctctttacatctggcatatttttttctggtatatattctgtttccatattgctctgaataaaggaaacagaagttgagagtaccagaagtttgtctgggaaaatcaggactttagtttagtcaaatagctctgtagccttaaagggcacatggacctggaacccaaagatatctgatttgtgaaagaaccaccaacggggccacttccatttgtgtaaacaagaggcttgaggccaaaatgtttgggtttgatacaagaaaaataatagattaatgagaaaggtatcaaagtagtcctaaggtatttatttctttaagtagcttctgaaaaccatgtattttaaaacatataatggtttatttatattaaattacatttttggtagaattccatttttataagttaaaagaaaatgtatagttatatatctgtggtgctatttataagcagaaaatcaacattttgagatttggttatctggccaatgacccaggcatttagtagaaacatacttaagttatagtttttatttttaaaggtataataaaaatctgtatacctgaagttagagtgttccagtttctattgatgtataaaaaaaactaccccaaaacttttgctcacagtttctgtggatcaggaatttggacagagcccagaaaagatggcttatctctattctaccacttttgtggcttcagtgagaagagtggacagctgggcaggccagctggaggtgttttcactcataaagctggtgtttataatggctgttggctgggatcccagttggggttgtcaactaaagcacctacatgccacctccccagtacggtctggacttcctcacagcaaggtggcctcagggtagttggacttcttacaaggtgacttagggattaaagcacaagtgttctggtaaacaagacagaaactgcatttttacatttatggaattcaccaagcattacttttgcccttaaagtacttacaagttcatccaggttcaaggggaggagacacagttcccacctttcaaggtaaggaatgtgaaattcgcattgtagaagagtatgccagatgggagatattgtgtctcaaaatacagttttcccaacagaatattaagccatgtaattcaggttatctgtgatacacaggacaggagatgacagtgttcatgcctgctgccatttctttttacttatagactagcaataacttgtgcccattgttacttttcagcacttcttctttttgcctttcttcggtttcatgtttctgtacctctctttactgactcaaggtagactagtaatctctaaatttcactggttattatcagtaaaagtttatttttgtttacttcccagttcaatgttaatctgcgtgaggaaaggtatctctgctccatgaagtcatttatagacccagactttttccaccatatggtgccaccacccaataaggcctcagaattctccactggacgtctgctacttgtgtggataaggcacatcctctcttaactgttttggcctggacataatacacagcacctctgctcatgttttttttttttttttttggtgacagctactcatgtggtccctcctagattcaagggaactggggaatatattttagtatgtgcccagtgcccagggagaaggcggggtatagatattggctacatctgctacacttacctctccttcctctctcctccaggctgataaggagtcaggagcctgaatgctgacataatatcaggaatagaatgaaacgaattgaccaatcagatgcaaattagcataagaattctaggaatttagacctgagctggactttaaaaattatttagttcaatagtttaaaactatttttggaggtggatctcttttagccagaggaaatcttacaggaaactccaatttatgtaatagatggcagtgaagttgctctggttaaaaaaggttataggcctcatcttttccctctgccatacactctaagagccttttgaggaatcctagggctttgcggatcagatataattagtttatttaagacacattaaaaaactgagacacagaggggcagggacatgatgtgccaaaaattacatggtttgtctggcaggtttaagattgcaactcaagcttcagtagtcccactactatttacttaaaagctgtggtactgcctctttttcaggacacatagccattgagacccctggtctaaggtggggcacggtatacctgccttgtgttgttggcttaatctctttattagccaaacagtggacttaggaccaggaaagagacaggagcttcagcatgggctgggtgcggtggctcatgcctctaatcccagcagtttgggaggccgaggtgggcggatcacttgaggtcaggagttcgagaccagcctggccaaaatggtgaaaccctgtctctactaaaaatacaaaaattaaccaggcatggtggtggggtgcctgtaatcccagctactcaggaggctgagccagaagaatggcttgaacatgggaggtggaggttgcagtgagccaagatggtgccactacagcctgggcaacagagtgagactccgtttaaaaaaaaaaaaaaagagcttcagcatgaacaactgtagcatttctttccagagtgatgagattagcataaagaatgagggctggcacctgggtctgcagtagtctgacttggcagcatacctagactgagggcatcatgagaaccatgaatggaggctgcctgagttcacttgaactgttttgtcctctgactctgatgtgatcatgccactgtacctagtgagcctggaactagactgcttttgtttaaatcctgaatctgttcttatctacccatacaaagttgggcaagttatttaatctttctgtactttggtttcatcttttataaaatagggatgataatagttggtaatttttaaggttgttacgaggattacatgagtaaatatttgcagactagtgcctggcccatagtcactactatagaaatatttgttaaaacaagtaaaatatcttacaggtttgtggtaggaattattttgatatgaaatatacagacctaaaggcagttctcctagtaatgattagtactcactaagtattagctattattacataaataatgttagctatattgtttttgttatcatagttattattattgcccataaaaatagagttaccctttattgaggtcttacaaaattgtaggcactatgctgggaaacttatttttttcatcatctttaggattttccaggatttgtggaaatgatctacccaggtactctctctctatatgtggtggcttattccttttatagaaagtagctggacacctgcctgggtttctctctatctggagagtcctgctaggggtacacgctgggaaagggtatcttcttgtttcccaaatccattttgctttgacctccccacccagactcctaggaagcaatggtttgttcagggccacagaaaaatcattgttggaatgtaagcaggtactgcactaactctggagctctttgggtgtgatatatttctctgaatagctagtatatatccttgtagaataactggaaaagagaccttttctaagaaatgttttacctttacttgtgatttagtgctggatgctatctaaaattaacttttactgttttcactcttgtacacagaagccacctaattcatccagcaataatcactttaacattttgaatatatctagcccttctgttctatatataaaatataatatattttatatattatataaatataaaattttatataaatatatgaatataaaattttattataaatatataaatataaaattatattatatattttaatattatgtatgtaatctcaaaataggatactttggtatcaattttggggaaaatgataaaaattttaataaaaataacttgattgatctttatctacctatatttttagaattattgttcctgaatttatttccagatctactaaggaattcagatagtctcatgaaaatcgacttcagttcatgataatactgattgtacctgatacccaagggtggacctttgaggaattatgcatgttgattctgggtagggtctaccttgcacttaagcaaaggcctgggcttacagaattcagctaagtaaatacaggttggaaaagatttgccttcataacattttgtgttcaaggtcttggggtgttagttgatgggaaagtcagtgtaggcgtagttgtgcacagctcagagcaaagcaggtgatagtgtcactgtactttgcattagaccacatctgtacaagtgcctttattcctggatgctgtatttaagtggaaaattgattcatttgaccatgcctagcgcatggtgaccaacatggggaaggctgcaaagaggaagaaggcagaatccttgtccaggaggggctcatagtttagatggagatgggagtataaaggaaggagccagggaagcttggcttgaaacagaagagggaatatcactgctgttttccgatatttgcaggatgagcagacttttctgggagcgaaggcagtttgttggaacaacacacttggctgaggtccaaggctaagggcttgcaaaatcttttgcttacaaaatctggcttataattttatcatttatacagctgccctccccagagactcttgaaaagaccccaatacacctgagtcctgaagaatgaggactggtgaggggtagattgctcactagatcagcctactgtcacttccagtgtcctccttctacctggcagcgccacgtggctcctattcacttgctcgtagcgtcagacttctgctcccttcatcaagaccagctggccaggaagtaaggcaacacctggcatactactatagtgcttcttaaacacagatgtaaacatagaacatgaatcatctgggagttttgttggaatacagattctgctgcagtagaccttggggttatcccaataatctgaatttccacaggtgatgctgctattggtgttctacagaccaccctgagtcacaaggttctactagaaaacatgagtcttccctccaggctacagccaaatcccatcaggccaaatgactttctgctcagagttgcctcacatctttatttgtagagcattactgcctggaaatattgccttattttcctcctagccctcatgaaagaattttatccagatgtcacttagccatccagtgtttttattattgctaaggctgcttcagcagttatctgacatgtgttttcaaaaatatatcatcttgattttcatccaagttgcatgagatgcagcactttttgaatatgtgcaggatgtggccagaaactttagtctaagataaaagtatcatttgcctgacattaggacagacttcttttctcctagctatatatttgtgattaccccaatgtaatcactgactccagtgctttataaagtgatctttaagagatctgtttataatacattgaacacttgctcaatgaggccacaaccccaagaataatgatgaaatctggttaaatgtatttgcctccctctttaatgattccagcaggtgacttctgtgagtatttctaattgtcattgattgaagccctttcaaggtcatgtcccttccccaagtaattgcttattggtcaaagtaaagtaattgagagatttctcatgatgtgtgaatcctggtaggatctcaaatataagctcgtggtgcatttctatacaggtgctaaatggtcttgggcaagatacttaatatctttgatcatctataaaatagggataatgaaatctaccttaaagaaattaaaaagatgatgtctatgaaagcacttgccatattcctggcacatgacaatcattcattaaatgacttttcttgcctcctcatttgttccttttaggccatttttcaccctttttttgggggggccgtggggagggacatattttacttccttcttcactagttcacaaagcaccttcagacatgggatatatattttaaacccctttttagtttttcattatgtgttcagtaaagacatattgaatgaattaatgaatggccaatagtctgtaacatcttcttgacctctaagttctccgattgtttgattcttcagtgttctaacaacttagaagaaactggagaattcccttaaaataaatgtcttctttgttaaagcatttccttttgtgcagtcttataaagtatgtattacataaattattactaataagtatgaacctgggcctagaagctggctgctatggtataaataacctcttttagtttatgaccttgggcatgattctttgtactggtgcaaatgaggtgggtcagaggctggtcttgactctctgcttgcccttcactgtttactttggaaagatctgtgaaagatgagcaagaaatatgtatttgttctttggcatgacttttgggattcaggcacaatagacgctgagtttcctgatatattcatttcattcctcatagaagatgcattttgtcttttagattaaataccctttggcttgtggggttagccagctcagtggattagaatagaagcagcaggcccttccaaatctaggggttaagcctagttacctgtctaggctaatcgctctggagttgaccatatgaatgagttgttggagttagtgcctggtgaggctatcctcaccactttgtcatcatgcctctgggatgggcaacaaactggcagaaagtgcatacactgtcaaatttagatctaagtttaagtctggtttgggtatgtttaatccttaatctcagtttttaagttttttaaaaaagataataccagtctcaggttttttgagtgataaattagtatatgtgaaatacctagtgcaagccctggcagtgagatcaggcccaacgttgatgacaatgacacatttcagaagagaggcataggaaacaaaatagttttggcacctgtgaaagtactagccctgttgtgtgcctgaggagtgtcccaaagttgcttgtagcattttatgactgaagtgcagaccacagtggtaaggctaagaatttcttatgggtttgaaaaacaggatcataatcctggaaaagaaaaaacttaattgcatatttcattctctgataatttgaaatactaattcctatgtgactagcttcaaccttttctcccctactcattatctaggaattgttattcaattatatctttttgtctacagagaagaaaaaagactaatcttttcattctgacaatgtatttcaatccctgatgtccaacatgacttccatttccctttaattcttgaaaaggtaaagataatagttctgaaaataaccatcaatagatccattccacatgaatggcctgttttagacattcatggaatgagggttctgatttgtactttgaagtatttaagaaacactgcactgagttttgctaattagctgtggcttgttacctcatggtggaccaattgatctctgtttcagaggctcaagatgttgccacgagggttctcagacaatagattcattgggtgtcctacagtgaattgacttgaggtcttggctctttgtgccatgtttagctaattttagattgtgagagacctggtagtaaggggttgagggattgatgatggctgtgatatccagaactaaaataaaacaaatgtttgttcctttacatacagctattttgaactggagagcagtggcctgagggatgagattcggtatcactacatacacaatgggaagccaaggacagaggcacttccttaccgcatggcagatggacaatggcacaaggttgcactgtcagttagcgcctctcatctcctgctccatgtcgactgtaacaggtatttctttgtctttgagtgttgctgattctgcccttgaaatcaagcaatggaaaaggggaaaaaatatcaaattccttcaagacttgccaggaaacaaacaccaagggaccctaattgtaatttaacctaccaaatgggaccttaggcatgctgaaatgaccaactgtaatatgataagaaaacagttcattaagatgaaactgtatcccgtgattaggagcaaatgtacaaaaggttgattgcagattgggaaatagtaagtgcacctcagtgtgctccaggcactggctggaattccatggagctgtgatcacagttaacggtgatgtattgttgttgagttcgttccactgggaagcgaataagcttgtctaccctggaatgaatctgagaagcctgtgccactgaagcagctaattctatttcacttcatcaagctcacctttgcttaaatatcttttccaaatggaggcttcttaaagaggctgttctctgagccttttggaattgatgccaggtattttctccagaggaatgagccttccagcttgtcaggggatggtgggaccagggggtttcacaggaggttttgggttggggtgggatggaaatgttgtctcccttgtctgtcactggagccaggtttaatgaaaattgaagaatgagggagtccattggtttctattggatcatttatggctggacagctggataatggtgttcaaggggaaagtttttatctctccataacccactgaagatccttatggatagtgacccgagtccaattacagagtttttttttgcattctgagcagtgcccatgcattgttgattctcattaatgatgccatcaaagttaaaatgacttttcagccacacaaggcttgctcccttgaacccaggataaagaacaggcatattggggatagcctcccttccaaaaaccatcaagaggagagatattccaaggtcagtcagcttcagaccgcatttctcatgaggagatgcttgaatatgcctgccactctagctctgcagtctcttttagaagagttggaagggcagggaactgttgtcaggctcaagggaaggtttgccatcttgaggtgagtcttggtccattttgatatgacctatttaaggtgctttttagacttctgaagaattgtggtttccaccagatataataaatatgtctggacagagtttccatagaaaccactagctcctttgtacactgcagactggggctgggcagcctggataaagccaatgcttagctgctatatccattttcactttcaagagctcattgcccccttcaattctctagaattaaagtggcctgtccggcaacactcctatgacccactgtgacctaccacccacatgctgtctaaatgggattgcagaggaagagccctgcttgtccttctaagccacaggacagaaagaggccacaaaaccctagtttcgtaatttccaacttaagagtcctggagatactgctgttttcttgctatgcagttttttgtttcttccttctaagagttttactctgtttcctgacattcttctctctggagcagttcttaggtggtgcttggccttcagtgctcagtctacatttgtggtggttgttgttatttactctgcatatcaatggcagctctttgaccctgccttcaaactttcatactctgtatgtccttcatggaaaccatgacctctctaccaggagagtgagaagaggataggagatctgtagttcacagtattctttagagtcattgccatttataaagaattgactgagggtattccaaatattccttctgttttcttaatatttttcatactttggcttgtggcataacatgtcctttatgtaagatcttggagggaaaacttatgaagttgctgctagttaatgattcgtagactctaaacacaaatacatttttcaggtaggtcaggagaaaaaatggacccaaagactggtcataagaaaagtaaattttgattttcatgtaggaaaaggctagaaacatggttccaaaatctgactatacctaagaattacctggggaacatattaaaaaaatggataaccaggctttgcctctgacctactggattagattccccgagggcggaacctgagaagcaatatttttaacaagccctccatataggttccatgcgggcagtctacccttggtgaatggactggcatttccaaaccactggtttagaaagaggggaaggaatttggtggagaggctgggctacaacaaataaatgaagtcgtggaagaccagttacctgaaggagggtaagaaggagaaaaggattaaggagagggtagtgtctaatgcacgaaacaaactttaccttcttcacaagtttcttcccagccagaacttgccaactttacagtagcagaagctctgtcccatatatcaagatgctggttctatcacttttagtctcagccaccctcacagagagtgaatttcagctatccattactactttgtgattcttattttttgatccctgttactcttagagtttttctcaacctctcacccagtagtgttctgctgattagagtatgaaaggagatgatgttagataacatttgatgttgattgtgctaggcacagtgctgagtactttacatagattaacttattccatactcattctattagtttttcctctttttaagatgaggaaactgaggttatatatttgtctgtaaccctgctactaataaatggcagcaccaggatttggacccaagtttgacctatgagtgtctgcatctagctactactaagctatttagcccaatagtggggaccattgacactttatttggtacatgagggaaggccaagattcaatgtgagcagtttgttcctttctaatatttccctgccacatgtcttatattgctaatcctgggagctgcttggaaagatgtgaaatctaattgatggaaccctttactttggtgctggagaagggatatacatttattgagcctctactataggccaggtaatgttctagtaatagtattccttaggataaccatatggggacagttttactagatgcattttgcatatttggaaatagaaaagctcaagataaataactaggtgtcaatcacataatataataagcatataacccaaactttgagtctgaaactatctccaaaaccttagtctaacccaccctccaggtcacctccatagtgtgctaatgacatgtactgccaaagacaaggtcacaaccacaccagggagtcttcccaagggagagatactacagaaggttcagggaccatgagaactctaaaatcgagaagaaatttcccagataattccattgctctgaggaatattaatgtggcaggatttcgcacattatttttttaggtcagaattgaggaacagctttttcagacctaattgtacaaattgtcacaagaaaagcaaacgctattttagttggtagttcaacactttctgcttgctacggagacacttttctccttgtttcagctgtttagctgggcttagttagaagttcctgatgtgtggatagcagattacctcaagctagaaacatagaaggaaccattcagttgggtggggagactgattatctccattgccttgggtttttctccggctaccttttatattaagagttggcaacaaagcctggaatggaacctgaagaaaccttccttagattcaccctctcccttctcagctcactttacagcctgtctctattactcaaaggacagaatccaccaacatctgggattcagtgcataagcaacctttccctttcacaacaaaatgaattttatttccttctctttatttgtaacttttaattttcattcagcccatcaaatttatttattgggtacactatctctgccaggctgtgtaggatacaaggaaataagagtccttgccaccaggaagttcttggcttattcatttagtcattttaacttcgttctgaaaccaccagagcccctcacagtgattgggcctagtccctgggtatcagaggaagcctggatgcagacaggagccctgtaagcaggctgatttgataactcgcaatggcagctgaacagtggaaagaactggaaacagtgaactcccagcatcttggtcctgaagtgacagtggagctgagctcctcagcagctaagagatggatggcttttaattcacccagcctttggccagcactttttgtaatatgccggcatccctaccctgtgttaacctccttatgcctcattgctggaaaaattcagctcttaagtgcagtctatcacatttcaacttagctcttattttttcagacttgttcaaatgtgtatggcacatacacacacatctgcagcccgattgtcaccttgacagagagttaacaagtgattagtctagactagactaaacatacttatcttttacttttaacacatgctatttattatccatagagcacatccaatttttgcatacaactgatcttgaaaagcatgcagaatccaaaactaaacttgctacaaatcaatgaatgagtcagtaatttaaggtttctatctaaaatttcagagtaatttcaggatgtgagcatctgtttatatgtgtagacttttcataatgaaatctgttgatatggcatcttccttctagagagcgccacaactacttaccaacatattatttaaccttgtattttttgaggtggttaaatcacaagtataatgcatgacattggttttatacaagcatatctgctgtagtatgcggagggaaattaagagatgactatcaaaggtctcagctttcaagagagccaggctgagactctcaatctcctggttctccaactgatatgttctttgcttcataaacagaaatacaagagcacaactcattatcaaaattaattaaaataaaattggaagctagcatatgcctcatgtcaaactaacaaagcagcttcaggttgtctaggaagagatgggaagcaagctaggaagataggacatattcatgtgtaaatttaagtaacagcacaaggtaagagatgtggtaaggcagtcagtatatgatgtattgctagattcctggtagaggcaatcaggtctgggagatcacagtaggggaagctcctgggggacttggagtaacctctcaatttcttaccagcctaggtgaaaatgcatgacaatctctacagctttatagtttcaccattatgtgatctgaatctgattctgtaccagtcacatgagtcaggcttagaacaaggtttatctcacaggcataacagtgccaattctagtgtggtgagagaaaaccatgtatgggtaagtagtatcgagttggtagtgagggaaggtctgtagggagagacagagaaggaagtgtgggaaaggagaggaaaaggaaagatttgtcttccatgtttcatatttgaagcatttgcgctccgtggtttaatctagatggaaacatattttggaccctagtcttggttttgccatttataaaatgtgatttttatgtaacgatgcaggagtgtgaaagcaagaaatctatgtctaattttctcattcattcattcattcactcattcatatgccagaaactgcgcttgcatctgtaaaatggcagtaatatgaattcttctaccatagggttgtggtaggaatttagctagagggtataggccaaatcctctgaaaatgttaagcttctgtatgaacatataacatcattaagcacaacagatgtataccatcatatagagaaggttttaatatattgtactgaaaatgggtaacatttagtcaaatttttacctctgtaaaaatagtggcttatatcccatggattcaggacataatgtgtaatgtagattcactgaacaatgtgagatttctgaggttattctactttccagatcctaagcaaggtttgccagtagtttgtctttgagttctctggtctgtagtgcagcacagtattgcatgctttttacaccaatagaatcactttaaaaatttgtaactgaggcagagtggggaaggaaacacctcctcctgtgtaagattttttgttgatcctggcagggctttgagaaagtgacatgcccactttccctttttattcctgtgaggagtggttcagaaacttactccccaccactcatgaggcaaaattatcatggcttttatgaaaggatgtaaagttttgactttacaaatgagggaactcatttgctctaattttctggatgtcctaaagcccacatggatgagcaaaatatgtactatttgcctctctactttgaaagtctggctttttagctcaaaaattctcttgactgaaaacttgaactgaaagaaattggtattaccctgggcaagtccaagtcctttactgtctctgggctttagcttcctaagtataaaatgtggggctaggactagatgacttttaagtcttcttccacctctacccttctgggtgtacctcctgattctatctcatcacaagtcttatttcagggcttgcattcccctccccctttagcaccatggagagcaacttagcttgtccttttcaaagtgccacttctgtagtggacctacaggggtttgcagtcatctgaatttatatgtgagttggcagtgcaacatgctgctgatgagcaaagaccaaagcccacttctcctggatgctcactctctctttttcttttttaaatcacttgctggagtagatactgaatatgtacttttggatgctaatggatgctggccttttcttctctccaccttgtgctctttcttcctgagttctctgcctcagacatgtgacagtggacagcctgtgtgggatgcaggcttttctggccatggaggccttggtagctcggtgacctacaagacagagggcagtgcacagtagcaagcagatgatggatagttgtgctgtgaaagacatacatcctctgaatgctgaagtaaaagaagccttggatgctgctaagtcacagagatttaaataacaggaaatagagttaatgttaaagatatagatggccaatataatactttcaaaatgagattttcaggcaaaatagagagtgtctgcttaattgctaaggcagcctgaccattacagtgttggatatctcattctgacttagcccccacatttctactcatgctatgtaccctgtggcgtattcatatcaacctcgctaggtggattccaagttaaccttgtcctatgttctattaacatcagtagcagacctatttctaatttttaagaaccttcaactttttcttttttttttttttctggtgggtttaaatatgcctttcgttaacgattgcctcaatggcaaagagagatagaaggtgaaaggattaattgaaatggaagatgagagagtgatctgcatttttctccatccacttgcactcctgggctttcaagtttgcaaatagaaagaactgggaaaaaatacaatagactctttcctttatctgatggtttgttggctacctgaggcgaggagtggattaaaaagaaagcattttgttgcatacatgaggcctgagatgtgttagaatagagaggaaaataagacttcatttccaactcatagtgatttcatctacctgccttcagtcacatctcatgttgtcattgtattacatggacatgggtctatatagatgaatggagggggaaaataggctgcaagagaaaaatatattttctgataggaaaaatattgatgcttgcatcttaattgttgtaattttactctatttttgatggatatgcatggttattttttaaagagaaaagcaaggaaagaaagtaaaccagaacaatacacctggtgaaactctgtttgaaaaaaacatatacacattcatatattagttttctctgttccttttatgcttcacttgttggaaaagatcattggggataaaaaatgcatgagccatgaggactttttaattgaaaaaacaaaaacaaaaacaaaacaaagaattccaaacagtgcattagttttccagatagatcagggatgctgatgtcgttgaaaagaacggattttctatactactgtaacaagattcatctatctccttggaaactttaattaaactaatgttataaataatagcagccagagctgttggacacaagaaaacagatttatagctgcatctgctcagctattcctcttttaggtggtatattggggttaggatgtgaggatgaagaggcttgcacggaaaatgtttctgtgcactctttttcctgcacaaaccccaaatctaggtgacttttctctccagattatcctttttagtttgttgtgagtgtttctgccagcaagggttgtagagttgcagagccagccagctaatgtgcctggacccacacctgagggttttcattggcaattagagtggaaataatttctcttctctttaaagggcttgtgtaatggtgtctctaactctccctcaggaatgccatgtcgcatccctactcattagagtctattagtctgagggtgtcacttttctgacagcaaatttcacacatttgaactaacaagcttcaagttgtggccatcagctggcttctttgggacacctagaatgcctgtattacccagaatggaattttattatcattggaggtaaacagccctaggctgtgattagtcctggtatatcctcagcaaagcagttgactgactaatccttccatgtacttttgctaatatctgctttccaggtctgatgctgtttttggctgaagtacaagcaagaaagaggctggggaaatgctgattcaaatttcttgtattctttgacattttagcctcagaagcataacaccacgctaaggaaaatgtagaatttttgcttaatcattagtgagttgaggttagtgtcttatgtttctctagagatgattgatacattcacttgatctttatagctctgtgagatggatgtgattgcatcttatagatgggaggttttgagatgctaagtgtaaggtacatggatgtgctttggtcaagaataggctgaggcagacatctgggccagagtgactcagtgagtttggagtacaggtgcataactccacttgttatataatcacagccataacatgggaaggctcatcgctattattgtttgtaaaaggtataactgccctgctgatgctgtgcatacagcatgcatccagagggagagagggaagctgttggccgtataagggagagccagccttgcaggccagggaatgcagctgtaagcatgggagcggcaggagctgcagaaccagagcaggcagccgagataaaggcaaacagtgtgagagagctgctgatgagagagtcgctgaataaaaccgtatttcacctgcctatagccccccgagtgttctttcagccattcaccacccatccactcactcccctcgaacctcagcatgggctgcaacctaatatctggcatgacatttggcatagctggcaggagaaggtgagtggttcttcagccccgaggctcccagctcggctatgtgacctcagcatgggctgtggtacccagtggcagtggtgctgctttgatgatccccagtggaaatgtgagaggcagtgggcaggtctcctgtgagtgtggagaaagcactgaagcagctggaaggacacagcaccaagaaggaacgcatcttcaccggcagagttggatgggtgtttctgactgcactgtgggaagtacatgctcagtctctgcaggacgctgcccaggtttagaagtgacagtgctccttatgcctgggattgagatgatgcaggtgagagagtctttctggcagccagcaggcaattcagcagacacaagccctacgggtagttagccaggggtgtccatttaaacgtgatgtgcatgtgaccacagatagtttcagttagggcctatagcggtgcatggagcactgaatacaccagtaggctttgggtcgcaactatggaagggagccaagctccagtattccttgataaagatgcagttagtaactgcatatgctgcccttcaggctcgtaagaacgtaacaggacgggctacagttgtcatgtgcacagcttacccaatagcaggatgggtgcattcatgggtaacaaccccacaggctgggacagcacagacatccactttagcaaagtgggacacctacttagagcagtgaagtactctacaagtcccttagcagcagagttacaagagatattgaagcctgtagtcctaatgcaagataaggccatggagcctgaggtacccctagaccctgagccatcaccgtttaaggaagtgcacccccctatttctgatgaggcatagtatacagataggtctagccagagcactgctgctacctggactgctgttgcagtccagcctagtactgacactataaagtttgataccaagtgttggcaaagtagctaatgagctgaactcagggcaatatggatgatgatcaccaaggaagtaatacctatggtaatctgcaccgatagctgagcaatttatcaaggtttaaccttttggtaaatcacctaagagttacagaattagctagttagtcaccaacccatgtaggaccaggccatatggctggatctgtgacaggaaggatgaccttctccaaccaggtatgaggacaatgatgatctgttgttgcctgctccaacacccctgaaggcagagggaacagaaaacctaatcttatccataaactctccaagccgctgtttgcagatggttggctatcatagccccctgggggtggggagggactgcagtataacttacatggtactccttgggtatttaatgtgtggcctccacaattaaccgtttgtaggggaatggccaaggaagggatcctcctccagggcacatgtgtactgtctgtgtggcctattagaagctcccctgtgactttggcacaggtacaggatccaaaagaaccatggggaactgataaggtgtaccattgcccagggcagaaggccttggcggctgcattattacccagagatgaaaaattagcctgcattttgcctgaggaacgtgatttacccctgttagtacctgtgcctgcttcgtcatttcggctgtaggttgacatgctccaaagcattgtggactaggcccacacctacactgaagtgaccaaagtctcaaactgttggatctgcaccacccttccaacagcagctgcagacagcttgccctggcatgcacctccagcttccgtgaagaactggacatagctagagacttggggttccacggacattggttaggccaaaatccaccttgttataaattccaagtatagctgatcagttggtctttagatgctagaaggcttatgtgtgttgtttttagattcaaagactccctctttcctggaatttgaagtattgataggttcatgacttcaacactacagagatacggcccattgtccttgtaagatttgtatgccttgtgtgggtctcgatgctgatgtgtaatggccagggacataatcttacatcacgactgactgcaaatgagccattcagccatttcttcaaatgtggagtagacgttacactagtctccagtgttacgtatgtggttttacactgctccaatataaattttgatattcgctacctcaaggtgacaaattctctgtattctttaaggggactttgcaattgaaggtctcattataaactactggtggtgaaatcaagggttgggcagtaggagacccccatttaggagggcatttgtcgttattgcttcttttattggcacctaattagatatgtactagagcctgcaggaactaataagagagcacaggaggtaggcgaacatattgaattctgagtaattttcatggatggcaatttttcatggacattaggttgatacataatgacttaacactgcaaacctggtcatcctattccctacccactccaacacacaattacgcttgtttaatagcctctgataagctttaggataaaggtcacaatccttaatatagcttacaaaaattgtgtatagtctagtccacgtttccttctgtagtttctccttgcattggtttctgcctttttctgattttgagttctttagaggtatcatattcacttaagccacagaacctctcttcacaatgctgtttctaggatgtcaagttcactcttatacatccttaattttcaggctaaaagaaaggggcctcttgtgttttacacttttaccataaaatagtgtttgcttttcaacacagtaatttttgatcatttgattgatgtctgcctttcctatgggctgtaagcaccctatgagctcaccattgtttcacaaatgccaatcatagagctgccacctaataggtaatcagcaaatatttgcaaatacctgaatgaatgaataaatggcaaagcttctctaggggtctggattcctagcttgtggccactgatcctcacattctcgatggcttcattagtgaattgttatttctttgcctcagtctcctcatctgtgtaggcatcatttctactcagtccacctgtacagggggtatcatgaggttcaaatgagggcctgcatgtggatgtgtgctgtaactttcagtgtgctttatgaatatcaggcacaaggaaaggtgaagacgaagtaatcctagcagtttttgctttgaacttttgagtattgttctctttctcagggaggcagttaatttatataaggcttttggtgatttcctggtctgattaacagcacaaggtgaaccgtgccttgctctcaagttgaatttacatgtggcctgtgtcagcgggagctctggcaggcatgaaggagtggaggagaaggtgatttacagatagagtacaaacataaactgatcacaggtggggtgaagggatgtgtgcccctgctggagaacaaacagagttgggtacttgtgttttgcctgcacaggacatatctccatctttaaattctgtggatctgtttcataaaatttgaagctcacagtaagggcctcattcaagcccattagactaacctctttgggcagggtttcatgactcccaggctatattggtgtagccttagtgtgaagatcaatggatgtgtttttctttaatttttaaaaattatgtaaggtgcaaagtatttaaagatatacaatacccattgccctgcccttaatcgtattgcacagaagtggtcattattagcagttttatttctgttcttcagatattttctttgcatacacaaacacattttttttctccataatgatatagcattgtacatattattcttcaacttgcgttttcatttaacggaatatcagcctgattcactattgatctgcagcgggaacatattcaggaggaatgaggctgctttgtttcttgcagggtagcctgggactgctttgtcccttggtagtgtgtggagcagtactcacctgcaagcctctagcctcctgctttgggctacaatacatctctctttcctgtcacacagcagtgactatagaaacagggcagggagccaagagcccctgcccttgaatcagcatgtcctgtctcagctgcatagctaggtgagaccacggcaattatcctgcactgagatgggagtaacaagattgaactgggtttgtgatgagggtcaggtgctctgagcagggtcataatgctaaatcttattttgtgtggctgaaatggagctagtgctggccagggttagacatcaggtgagcacaatgagagacagtgtagtttagtggttccgagcatgagcttttggagttgggcagaactgaatttcaagtctggctctgccactagatgtgctacccttgccaagttacttagcttttctaagtctcaatcataagatggggacagagtacctccctcaagtgattgtgagaattaaatgtgacagtgcatttagatcaaataggacactcctggttgctaataacagtggctgaaactataaggatatataatgtttactttagaagtttagataaagccgtgcctgggatgagtcagtagctcagaagtgacatgcaggagggacaccctatgtgtcctttgattctgccttccttggcattgtttctagatgcttttctctggaaaattagcactgtgtctggtaagtaagtgtttaatatgtgccatcatgatgattcggatgctaaatctgactatgattctttctcatctgagaaaagcagaagtgaactgaaggacaaaatacagaagctaataccagtatctggttattcaagagtcatttttttttaagcaattttagttctgttttggcatagcaaaattgaacaggaagtacggagagtttccatataccccgtcactacacacgcacaagcttccctttctgtcaacatcaaagcacaagagtggtactttgttacaactgatgaatctactatgacacattattaccacccaaagtccataatttacattagggttcattcttggtattgtacatttgtgggttttaacaaaggtatcgtgtcatctatacagcatcatagtaacgtacagaatagtttcactgccctaaaaatcttttgagctgctgctttttttttttttttttttttttattgatcattcttgggtgtttctcgcagaggatttggcagggtcataggacaatagtggagggaaggtcagcagataaacaagtgaacaaaggtctctggctttcctaggcagaggaccctggccttccgcagtgtttgtgtccctgcgtacttgagattagggagtggcgatgactctcaacgagcatgctgccttcaagcatctgttcaacaaagcacatcttgcaccgcccttaatccatttaaccctgggtggacacagcacatgtttcagagagcacagggttgggggtaaggtcatagatcaacagcatcccaaggcagaagaatttttcttagtacagaacaaaatgaagtctcccatgtctacttctttctacacagacacagcaacaatctgatttctcttttgcccacctttcccccttttctatttcacaaaaaccgccatcgtcatcatggcccgttctcagtgagctgttgggtacacctcctagatggggtggtggccgggcagaggggctcctcacttcccagaaggggtggccgggcagaggcgcccctcacctcccggacggggccgcagccgggcagaggcgccccccacctccctcccggatggggcggctggctgggcgggggctgaccccccacctccctcccggacggggcagctggccaggcaggggctgttctccacctccctcccggacggggcggctggccgggcgggggctgccccccacctccctcctggacggggtggctgccaggcggagacgctcctcacttcccagaaggggtggctgctgggcggaggggctcctcacttctcagacggggcggccgggcagagacgctcctcacctcccagacggggtcgcggccgggcagaggtgctcctcacatcccagacgatgggcagccgggcagagacgctcctcacttctcagacgggatggcggccgggaagaggcggtcctcacctcccagactgggcagccgggcagaggtgctcctcacttcccagacgatgggcagccaggcagagacgctcctcacttcccagacggggtggtgaccgggcagaggctgtaatctccgcactctgggaggccaaggcaggcggctgggaggtggaggccatagctagccgagatcacgccactgcactccagcctgggcaacattgagcactgagtgaacgagactccgtctgcaatcccggcacctcaggaggcggaagctggcggatcactcgcggttaggagctggagaccagcccggccaacacagtgaaaccccgtctccaccaaaaaaatacgaaaaccagtcaggcgtggcggcgcgcgcctgcaatcgcaggcactcggcaggctgaggcaggagaatcaggcagggaggctgcagtgagccgagatggcagcagcacagcccagcctcggctgggcatcagagggagaccgtggaaagagagggagagggagactgtggggagagggagagggagagaatttttttatttcgagagtcattttttaacaattaaaaaaattttttaaatagaaaattgtatgtatttattgtgtagagcaggctgtttgaaatatatatacattgtggaatggttagaactagctaattaacagatgcattctctcacatagtaataaattttgtggtaagaacacaacatctcttctctttgcatttttcgaagactgcaagatacttcattaattctagtcaccatgccatactatagatcttgtgaacttactcctacagtctaactgtaattatatatcctttgaccgacatctccttatcattttgatacatggctgttcctgccatcagggcatcttcaaaagacccagggccttgatcaaagaggggaaagagtatgagtgggtctgagaggccagagtgcctcctgcctccataggccatcgtcccaattggcaggggtcaatcttgttggccttcactttcggaaacctggcctctacctgtctgcctgttgctgctgccttctcaaaggccctttcaacacaggtcttccttatacataaagggccatggcaggcccagctaagccagagcctgattgcagcttttacccaagcctgacttcacacttacttttatctcctgatcctgtcagctcttgcctttttagttcaccaatccctagattttgatactgactcagtttggcaacttgcttggattccttccctgtttactgacttcagagcttcctggctgctcctgccagtcctcctgtacaacatcctcattggcaggacagcccttcctgacctcaggggagattctgacctttgctttactagtctccttgaccttgactttttgatacacactgatatttttattttcctgccctcctttaactgcaagttggatccatgacagttttggggggttgctctggacctctctggagttagagctatgcagcagtggaaatctctatctgcagttgagcttaaggcttcacttgtaggagctctgaaatctagatttcagtttctagagatgaagacgaatacaacttttgcaggatccacgaagctgttaaatgcacaaattatatgactgaggcttgctgtaaagctcattcctgctaaacaccacatgaaaaaggtgacccagtatttgtaagatgaaaaatcactaggattaaccaaaatgtcacctccttcaaaagagggtgtgctcaggtatcacctgcaataatccctcaagtgggaggccgggtgggatgctggaaaagccttggagtctgagctgagtatcttctattggcttctcgggaaacattctctcccctcccttcactctactgtgtctgagcaggctgacctgcatgggctgcatctgtgggcttctttgccatctggattttttttgaattttattaggaagaacaggcaggggaagggaggaggagaaggtatctattcccctgtcttcttcactgtggggtcaccttgggctggctgtgacctttgactgaaagccacaggccctattaggtggttctttttggcttccttgctctttaatgccagaaagggaagagcttttcccatcttctttttacacactgtgaggtgccaccatccctcacagtttatgtactccttgcctgtacttctgtaaacaatgccgtttaatctattattctctttgcaaatgaccaaagtacagtatactgagtttcccacaggaccctgactgttacacatcctaagtcagaaaccctggctcactctctggcttcaccacttcctagctgtgtgctcttgggtgtatttctcaactcccttgaatcttgggtttcttttcagtaaaatggggatggcagtcattcttgcttctgtctataccaccctcctgccccctgccttcaaggaagaagacaaagagtgtacaaatgttatgtaaactgtaatgtactgtgcacaaaggaggagttaccatctctgtgatgcgcaaggagcttgaagtgggaattggggaaagcagaaggctttgaggctagagcattcaggtccccagatgggactctgcatcctcacctgctcctcagcacagccaatgagaagcacatctggcaggagaacaggacctaacaaaataccctccaaagctgaggccacaggaccgcctgttctattcaccttagcccacaggtccaactcatctggaaaacagatgagagctcctctaattacagacaaattatgtagggatgacattagactctggtaagatggactctctggtaaggcctttggaaaataaagttatgtggtccaaaaggaggaagctgtcaaaatggtgctgagaaacagatgaaaaggccaatttctggccttttgtttttcaacattcacagaatacagtattggcaagagtaaatcctgttatttgtgtctggataatctgacacttgttgctaaaaggaaatggccatggcatttatattggaaatttccttggaaggccttgtgcatgagcttctggagggaggtggcaccccctctagcagatgactctttatcacgtcaatcacctcatcttcttttattgtctttgaaggactattcattgtgtaaaattatcttgatcagttacctgtttacaattttatgatgtctctcattctttcctacctgtaacccttgcctccaataaggaaatcagctcctcgaacttattttaatgctgagttccaagcacttggctaaatgcctggcacagagtggacattcaacaatatttgttgaatgaataaatgagagaaggattactatgcatagctggctatgttgggcacaagacagaattctgggtctttaaggagctcacatctaacgtctaatatctttccacaactttggggcaatggacataaacccacaactccaagacattaaatactcagggccccaaaagaagcaaaggcacagatcaactgttataggattagaaaatgggagacttgacttccagtggaaatgaggggaaagtagaatgaacagaggtttaagagaaaggctgtgtttatattcagatccctaatttctcaatggtttccttttgcttcagttatttgggccacagttttctcattaaaaaaaagatgatgattgactctacgtcatgggtttaactgaagtaatgcatggaaagcagctgggcacatagtaagcagtcagcaaatgttaattattattattgttagcagcagtagtaggataaggaggaggagaaagaggaggaaacgtttatgaacgaaaattcagtgaatcctggccagtggatgagaagacttgcgttccagcttttgtcttgctattcaactctgtggtgatgtttgaaagaacttccgttttctgggcatcatttgcaaaatgaggagtttgaacttgctgatctctgggtatcctcaaattattattagtttgcatagagttgggcttgaaggatgcatagtatttgtgtttaagagcatacggtgtgcatatggaggaataactttccttcttatttttatttgtttctgcctatgccaaaaggttatttaattaagagaaaataatcacatgtctcttgagatccttctactccagtacctgcacactttggatacagaggagcaaccaatcaaatattcgttggttgcttggctgacttatttggttggatattagaaagagtctcaaaattccatttttaaaatttctaaattgtgaatgagacatttatttattttaccctcactcatatatacttaggtaaacacagagaaatagagggagggtggaagagaagaaagaggatgtcgaaaaggaccgaataatatttatcagttgtttacagtgtgtcaggggtttacatatagcatctcatttgaccttcagaacaatcctgtgtgatgtgagagcagatgtttttaaggcatcttcatttccattttgactttgagacagtaggatcagggaggtttaacctgtttaaggtcctagaagcaggaggcatgttagaggtgggattgaaacccagacctccatgactcccaagccatcatattctcacgtgctaagtgaaataagccagtcacaaaaggacaaatattataagatttcatctatatgaaatatctagaataggagcattcatagagacagaaagtaaattagaggttttcaagtgctggggggagggtgaatggaaagttattgcttaatggttatagggtttctgtttgggatgataaaaagttaaggaaatagatagtggtgataattgcataacattgtgaatgtaattaatgttactgaattgtacaattaaaaatggtgaaatggtaattttttgttataaacatcacaatttaaaaaattaatgttatatatcaaaaacattgaaatatatagcttaaatgggtgaattgtacatgaattatatgaatgagtaaatgaaataattatatttcaataaagctattaaaaatcgcaatgcaaggaaataaaagaaaacccaaatatacatattgagtaggtccattataaatctgggaaaatcaatctgtaaaataaactctgagatatatcctcataaaagtattaaattttatataaaagagaagaaatttcatgatcttaaggcaaaaagacctcacaaaggaaaaaaattcaggttgccatcagacattttgacagcaatgtacaaaacaaggcaaaagtagcattttcaagaaaactcgaggaaagattgagtgggaagcagttccctgtttgacagctgagttaagtgttggtgtattatatagccagtgaagtgctaggaaggtgtctggaaccaagggtccagcggttggaagcaaaagagtatatgaaacttttgggaattgcaaataattagcaattcagtttctgtaaagtgaagtggagaggctcataaggccttagatttcatcaagtagttcatttattcatttgtttacttaactgatgtttcttgagtgtgttagtattaagtgcctagtaatgcccagtcagttatatgttactgagagagagagagcattgtttatgatatctatataaagggaggaggagaggttaaagagactaggggaatgtgcatagaaattttcatttatgcatggaaatgtatggcatttacttgagtaattcttcagctattccaaacatcctctttcaaatgaaaatttgcatttcaaccttttcatcaacctagtattcaaagtgctgatggacaattaatctatgtaagaggcagagacaactgagccagttcatccatttgatcaacattgtacagttgtagggagatggctgtgtacaggaactgatcagatggatacaatttgagtgcataagtgcaaaaataggtgaaatgagaactattcttgagcatatattttgtgacatgagctgctttaggtactggggataccaaggcaaataagagctggtttctgcttttcagttgccctaaatctataaaatgctgattacatcacagggtgtaagtaaggtaagtaccaggtatggtgagaagaacagaattgttatctttatgtgtactgctgagtggtcatgccaagacttatcatagtgcttcatctgagtttagaattgcttgccttatagcgtatcttcctgcatacttttgtgttagttaggatgctctagttgtaagtaacagaaatcaacttgaataccttgagcaaagaaggtgaggttactaaaaggttaccagattatctcatggaatggacataaggaaaaggatgtagctggatcaatggaaagatgtggaaaatcagtaaacattcaggtgactcagtatcacttcacttatgcctgtttatgtttgtattggtgacattttcaaagcagttactgttcatggcctcattgagcctcaacataaataggtaagtagggcaggcatcattttctttatgtaagaggtaaggaaataatccaggaaaaggaaatgatttgtctaaggctacatcccaagttcagtggttaagtccagaatttagaatagcagtctctaactcttgggtttattctttacccattagttttcttcaaaactttgtctcactactatgcagtttttttccttcttcgaattctctcacctttttaatttttattttatcattcatttggtcttggaaattaaaggagtcgcctgtgtgtccttaataataggcttatttgagacatctctggcaactaatttatattctgtaacctgaacatgaaggggccaccaagaaaggagataattaaagagaggatgggagatctcagtcatctcagtgattttcttattatcatccatgaagtaccttaccagacatgggccattatagtttaaatgatgagttggagtttgaaaaggatttggaacttcatcagacactttccgagcttgtagcccattgttttccaaacttcaatttttcttccacaatgaacaataactttttgattaaacagctggcagttactattgaatgcctcacatttaataacaaaagtcttccttcagaacaggaaattttatctaaattgctttgctcttcttccatgattgtgaacttctaaagtctgacaggactgatagctggaaaaaataaaaatttctttcaagaagatgatgattgctttttaaaagaaagagccccaaactaaatgaataattcggtgtgcttgctacaaagcagaagtcaaggcacacaagttatcctctctgtaaacattattaaaaaacaatcaagtttgtattggcacatttatattgggaagattgtagacagcagctgagagaaagagtaaaaaaagcaccgcttggtagttagggaccttcttcactttttgtttttgttcttaatagaagtagctaccattattcagctaatactgtgctatgcccttaatatattaattaattagtactccaacctgaatcccttcctgccctcctgctagtacttccctttgactgaaaccaagtggaaccaaaaggagaggaacttttgatacaggtcagtctcctgtggcccaaagccaggcaaagaggggtggagagtgtatctggctgggacacatggagaatattcagctcgccttaattttataataaataaagtcatttgttttgctgttcatctgccctataatgcagtctctaagaggacagggatataatattattttcaaaataaatttactggtgtctgcctatatattatctatctatgtatctatctatctaatctatctaatctgtctattcatccatcatccaaacaactattattaatggtcatagtcaggagaactctttcatttctttataatgctttgcaaaatggtgggacactgcaggaatttttcttttatttgtactactttctcattttttttttattcatgtagaaaaacctctagaaactgtcctgcagaggaaaatcccctccctatgcctcttactttgcctcggagatgctttaagaagaggccctgctgggcgtggtggctcacacctgtaatcccagcactttgggaggccgaggcgggcagatcacgaggtcaggagatcaaaaccatcctggctaacatggtgaaaccccgtctctactaaaaatacaaaaagttatccgggcgtggtggcaggtgcctgtagtcccagctactcaggaggctgaggtgggagaatggcatgaacctgggaggcggagcttgcagtgagccaagatcgtgccactgcattccagcctgggcgacagagaaagactccgtctcaaaaaaaaaaaaaaaaaaaaaaaagaagaggcccaactacttccatcataggcttgcttggagctatatcctgtggctggggcaggagctcccagccaagcctgactctgctgctcaagggcagataataccaaatgagtcctctatcagagatttttttttttttttttttggagacatggtctcactctgttgcctaggctggagtgcagtggcacaatctgggctcactgtagcctcagcctccctgggctcaggtgattctcccgctcccacctcagcctcctgggttactgggaccacaggtacctgccaccgtgcctagctaatttttatatttcttgtagagatgatgttttgccatgttgctcaggctggtctagaattcctgggctcaagtgatctgcccaccttggcttcccaaagtgctgggcttacaggtatgagccacatggggccaggctggcacctataagtctgatttcgtgaggggcttatgaatttgtatttttgaaaagcttatgaggctatcctactgcctagtaaagtttgggaattgccaagagacctttggtggtttccaaagtcctgaaagagtcagaaagtcaaagaatactaatccctgcttgaatgtggagatgccagtgtttgaggtgtgtgtgtgtgtgtgtgtgtgtgtgtgtgtgtgtgtgtgtagtctatgctgtacaaagacttcatggagagggagcaaaataattcctgtgttccttaccataactgctagtccctgatatattttgtatgggttgtttgggaatggtcaatcatcaggcctttagagagacattcatttgctctgggaagctttaaactagtacatgaggatgtcacacatgctcactgaatgacagatggcttttggattcttacatattaatataacaagtagcagatagtggttggatcagaagaccttcaatgtcctttccaaccctgagagtcctggttaccaatgtctgttttatgtgagcagcaggcttttgatttattatcactggaaactaacacctaaatcttcatctaggtgaataataatatgggtttgcactaaattatcacccatttgtgagcatcagcaagtgttttggaggcagccagcctggggtataattgaacactaggagcagcacattttgctctgaacctctggaaaagatgggaccgacgactgtggccttgatgtaacctcaatggcgccatctagggagtgatttcacaggttaatgctcccctctcttcctataagattgtggcttttaagcacctcttttatagaaattgtgaagctaacactagatactatgttctaaccagttgagccaagtggcttcaatgaggtttttggtattttgtctgaaaatatttcaaactaaaatgtcttttagattattctgtgaagataaaggcattgatctcacctaaaaacattaataatgttctgtttgtgaaaagcattttagactttacaaagtacttttacagagcagatgatctgttttgtgcttacacggaaaatcctgtgtggtagatgttgttattaaaggtttacggatgaagaaacaaaggactcagagaggtttagtaacttgtcccaagtcacaaaacataaaagtaaaggtaagacacaaatgggaattttctggctctagtctgatgatctttccctggctgatgctgtttgtgtaacccactggttgaatatttgactttttttttttttttttgagacagggtctcactctgttgcccaggcagtccatcggtgcagtcacagctcaccgcagcctcgaccccccaggctcaagggatcttcctgtttcagcctccccagtagcttgggctacaggcacacaccaccatgcccagctaacttttttattttttgtagagatgtgggtcttcctatgttacccaggctggtcttgaactcctgggttcgagcaatcctccctccttggcctcccaaagtgctgggattgcaggcatgagccattgaacccggtctgagtttagactttttttttgagacagagtttccctcttgttgcccaggctggagtgcaatggcacgatcacggctcactgcaacctccgcctcctgggtttaagcgattctcctgcctcagactcccgagtagctgggattataggcacatgccaacacacccggctaatttttgtatttttagtagagtcgaggtttcatcatattgatcaggctggtcttgaactcctgacctcaggtgatccacccacctcagcctcccaaagtggtgggattacaggtatgagccacctcgcccggcctagactttttaatagcagaattaattgagggtttttagccagtgtggcatggcagaagtttacacctggatttgaatttagaattcaccatttactgaatagtatttagtcgagtcacttcatctctgtgaacatctgtcaattgagtatagcaatgcttgtcttttagggttattgaaaggattataaagtctgtaaacttttggcctataggaggtgctaactcaaaggcagctcttataaattttgagacagtgcctctccatctctctgagtttgaggctaattgtccttcatcatctgctgaaacacccttcagagactggaagttcactgccttccaggagtgccccttccctctgtatactatagttctgactgctagaaaattttctctatcttgagctcaaagtgcctccttatagcttccacctgttggtatcaattttccctcttggtgctgcacagagcaagttcaattcctcttctacacgatggtcttccaaatacttgaagaccttattatggcctccctaatctttacttcttcagacagaacatctctgttccttcaactgttcatcacttgatttgtctcacaatgccctcacaatcttttctgattccttctgaagtatgtctgtttattatctgagaagttcctagaactaaatgcgattatctctggacagattgactcagaataaaatgagataattactttcgtctcatggtacactttaagatcacaacatcctttttgacagctgatcttagctcgctgttgaccaaaaaggtgtttattttattttattttaatttttttaatatgtatttctgtttacccttagatctcacattctgtttttaagcagcatatttaccctaactttggacccttttcatttttccgtgtgaaatttcatctgatttggccctaattcctgcctattaatatctcttttaatcctgatagtgttgtgctaaatctgtcatgattgaaaccatcacaccagcttcaaattttccagcatgtttaagaagcctatattctagccaggtatagtagcatgcacctatagtcccagctacttgggaggctgaggtgggagaattgcttgaacccaagagtttgagaccctgtctctttgcatgcctatatcaaaacatctcatgtatcccgtggatatatacacctactaagtactcacaaaaattttaaaaaattaaaaataaacaatgaagcatactttctattattttgtcaaatcacagatacaaatactagtgaggacagtcttatatgatctggttatttgaccctggtacataatcacaatcatctcagaatgatatctggatcgtgaattttaagcagagagaagggttggtaagaagtagtgaaagagtgatattaaggacataaaatatggttaagaagaaaaagcacccttattatcattagagatccagatgaggagagaaaaagaaaacagtgaaattcagttgctgggcaagaaaaagcatgaacgtgacaagggtttcctaaggggatgaagcaggtcacacgcaggcttgatctctgagaagacctctctcctctctgtgaagggtgttgacaccctgctctcaaaccccctcccacagtgtttgctgatctcatttgaacacttctgacttctcatttatcacagcaaaggcatctccttgcagacttcaactgtgtgccttctcttttttgtttgcgtttgtatttacagacagttgttaaggaacctgctgagccttgttatagcccttcttcccatgctctatgtggatttagcttggaattcaatccttacctgttgggggcatactgtattcatccccatagtctctcttcccattacagtctgtgttttctgatataatgcctgaggtgcatttttcaattttgtcattttctgagtgtcatctggatttgttaaacagattggcaggaggagactacagagttcctctttgggccattcctttcatgtcctggtttcagccctgtgtgctgtgtgttccatgtgagcagttaattaacaacatccaggcagcctgatatggaattcaacagatagttcatcgccgggcacggtggctcatgcctgtaatcccagcactttgggaggccgaggcggtggatctcgaggtcaggagattgagaccatcctggctaacacggtgaaacccggtctctactaaaaatacaaaaaaattagctgggcgcagtggcgggtgcctgtagtcccagctacttgggaggctgaggcaggagaatggcgtgaacctggaaggcagagcttgcagagctgagatcgcgccactgcactacagcctgggggacagagggagactccatctcaaaaacaaaacaaaacaaaacaaacaaacaaaaaacccagatagctcatcagtgtacacaattggcaaaaccccctgtcacagtcagtaaactttgaggacctgctctgaagagtataacaacctatggactgaatgctgaatatttgttggtgtcagaaataatgctgatgacatcatgacttttgcttttctagtggggctcaagaaagttacaattctcacatttttcttatgaggctaagaggggaaagggtctgttatgtccccttagcataaggccaaaagaggggcttagcttcatgtgcaaggtcacccattaccatattgggcagggaaaaatggatgggaatgaacttatgttctgtataggaaaatttctccaaggagcaccttgatattcactaatgccagctaaaaggcagtaaagatgaggctctgtataactaaggaaggtcattccaacttttctcttcagcaagagcatgagagcttctcttcaattcttggcaaagcccaagataaatctcttcatttactgtctcatttgggcttcatattgtcttattgaacagtggcataatacatgtcaattcacatgatttacactggaaattcattcttttatataattaggaaaggtactgtggagtctcttcaaaaaccttcctttatccaggtaaataaaaatccagtatttcttcataagtagtgttgttgaaccaccacactgctttgtgtttagctctgagggttttatctattaatgagaaaatcaagttcttcacagaatatagactagtcttttaagcagacaatacacttgttagggagagtgttttaaaccaaagtcacaaattaagagaggttacaccttgggaagaaaattcctaatgtgagcccttgattcaatgattgactttgacaaggagtgtggcagttactctttgccttgtcctctcaagcaggttttacatttgactagatgtttaattttacatggtattatattagaaatgagacacttacactttaaaatattgatcgatactagtggcatgcaaaattcctataattctccccgtacagcttaataggtagcaccttgtaaaggctcaagtgaatacaaagcctgagactcatgtctaatgggaagtgggtgttcttcagcccaaagaaagggtaaatttttgatggttggagagtaaatgcgttgtttgcatctgatagcctataggaatgtgatacatttagactgattacaacataatcagattaagcagtaaatcatgtgcttttcaaaaaacatgccatttgggccgggcgcggtggctcacacctgtaatcccagcactttgggaggctgaggcgggtggatcatgaggtcaggagatcgagaccatcctggctaacacggtgaaaacccatctctactaaaaatacaaaaaattagctgggcatggtggcgggtgcctgtggtcccagctactcgggaggctgaggcaggaaatggtgtgaacccgtgaggtggagcttgcagtgagccgagatcgcggcactgcacttcagcctgggggacagagagagaccccgtctcaaaaaaaaaaaaaaaaaaaagatgccatttgatctaattaattttcaagttgtcgactgcttttcctgctctttctgaaatacatctctctgatttctctgttagtgagttgtctgcctgatagattcaaattttctatctctatctcttttccgggtgagagacagtgagaggagtttatcttgttctttctttggtgcttcttgtataaatctcaaaaggtattgatggtggaggagaacacttgaaaagggttattacatttcactcatctttattgacttcatggatctcatgattatcagcataatgtaaagtgtcacatttgactatttttctcagtcaggattattaatttttgcaaattgctcatcataaagctttgccatagtaggacttttatagctatctgactgtagttctcctgttctgaatacagtcagggaactttcattcatttattcattcagtatctgaatttggctaggttctcttccagatagtagaaatgctgacttgaaaaagacagacgaggctccttatcttaaggtgcttacagtgtgctgggtaaaacaagctaagtgatggagactgaccaggtggttaggagttactttatatagggtgcttagggagggtgtctagtgcaggagatatctaagcaggtacaggaatgctgtggtcagtgttccatttcctccagacccggaagataattggtggtagcagcagtcaggaagtacacacacaacttcaggatggatatgatgggcccaagggtactaggaaagctatttcctccttccttagccaggtgatctaggaaggcaggcccagccactaccagagtcttgaagacccctgtgggtcatggaagctaccgtgtcacatgctgaagagctgaggaatgcgtctgaatggatcgtccaaatggggaggttctgagagaccaggaaataaccaacatatagggtggttagaatgtataaaaataatatataaagaaagaatgtataatgtaagggtagtcctggatgagaacttaaaaatagggcctctgcttactgctgttttcattttcccagaaacattcttcataaattggctaaatccaattaaatgtcccaaattgactagggaaaatgcttactaccggactgggtgaaagtgttaagagtagtgtgctgccgtattttactcagaaaagctaactgatggccaggtgtgtgtgtgggtgtcaggtggggcgggggtttggtgatagtgtgtttaagcacacaatcttataaaatgtttcttccatctcttcctgttgcctgagcctatttccaatcttatgtgagtttatgattaactttccacaaaaataaaacttttataaatgtcaaagaattacatttttggaagaatgtaaaagaaataagatatttacttagaattttgagtaatttacatagaaaagtttacgatttatggccaaaaagagttaaagaaagctgaaaaaaatgatactttaaaacaacaataataaaaatactgaagttttaggattcatagaaagtatactttatcgaaaaattctgttttaatgcaaagtttagtatctaaatagatcatcagttttctccataatatcagattaaacagcaacagaaatgaatttttttttctgttacatattagcttgttctagctttaaagtttataaagggaaaaaagaaacctaagacttaaattttgataattgtcgaaatgtatggcaaaaatagacaatgagttcttgcattgtaacattgaaatatcaaacccttaaattccctgtcacagtgatgtcatttcttttaactgtaaattcaaagcataagtaagcatctaagatattgagacttcccatctcagtgggtccatttggtgagagctacagcaagtaggctggactgggtcacatgacctgtgcagctccacattcttaggtacccatgagacttacacaatgtcagcacagactaagtgccaagggcatgtaatgtattttgtttaatcctcatgacaatccatacagttaacagtaatatccttatgttttaaatgaggaaattgaaatacagagaaattaaattacttgattaaagtcatgcatttagtagactgcggaactgcgatacgaacccaaacatgtttaatcccaaatttatgttgtttttgctacaccacactatctaagatacttcttggctttgtgggcgtgaaaaaggcaacagtaacctttctgtttttcagtgcggtatattttttagggtaaattatactagtcacaacttcagaatatcctctccatctcagtggcttaaaatagctgaattttatttctcatttaaatagagtccagttgggtgtgtctagctgacaagtggcctttgatgtcatcctttagggattcaagattctcggtcttgtagctctgtccaccccttagccctcagagttttctccaggcagctgaaagggagaaagagaaaagagataaagggaaagagacagcatggaagatacctgagggagtttttaaattatttttcggtggggtggaggggcaggcttagaagtggggcacaacctttccacttccattccatagccacactcaacttcaagggaggctgggaagtgtagtaaagctgtgaatctgggaggaaaacaaagtgggttccaggagagctgaccagtcttgccttcaagctttgatacatgaacttgtttccccttttccttctgataagtaagcctagttaggaattttactttatttgaatgagttaggttttcacgttgctctattaggaaataaagaacctgtctgtgacagcaggacatcccaggatatattaatcatgtcctcttttgttcagtgttgatttaaaagttctaccaaattatttactgtttttgttttcctgtattttaactctttgataaatagtagcttggatggggcttttgtggctgaaactgcccttcattgcttgtctagagaggcagtagggcaaggtggtcaatagtacagactataggatctgatttcaaatcccagcggtgtcactcacaagctgcttaaccaaggacgagttatttgaccttgctaagccaagaacacccacctgagggtgttgttatgaggatttagtaaattaacatatagaagccctcaatacacaatgtcggcacacattaagtgttgtataagtgctggctgttatgtctgctctttcagctccactttattcttcattcaaaactcagtgtagtgtctcctttggaaagttttctctgactatggcaggcagaattctgttttgttttttttttccctttctgcttccaggaaacattgaatttaatgcattgaattataaggtgtgtccatgcatgtgtctgtctcaggcattagatctaaagacaagaaattggccattctaaatttgcctgtatgtatccccatagccagcacagcacagcacagtgtcatacacattgcaggcaatcagctatttgctgatgtgaaggaaacctcgttaaccagagtaccctatatatcagaaagctcagtttccttaccacactggagagcaaggagttcactatattagctgtgactttcattttagttgacttgggtgacgccagatttaagtgacagatcactgtgccctacctgcctttttacatgatccagtccacccaaactgtccctcagggaccagcagcctttgtgctaagattctgattttactttggctggcatgtatagctccccttctataggggtacgtgtaggaatgtgataattcaatttcttagtttgtgttatcagcattagtctgtgccgtgcacatttcttgtttcattcattcacttttttcttgcctcaccattcccaccaggcctgtgataggaaaattctgtgcgtatccttagctaatcgataacattgttttgcatgtgtgaatttttagtttacatacattatggaccttgttggttttttctctattttttaaactgttaatgttaatataactttaagctcacagaaaacttataggagtgatacaaggaacaatcatatttgcccagattctgcattatttggaaggaagagaaagcgtgtattcatagatgtgtatacttatatatacaaacagtattgttattttgaaccctttgagagttaagttgtaaacatcatgaccctctacccctaaatacttcagtgcctatttcctaagaacaagactttcacttaagtatatactgcccagttagcaaaatcaggaaattgagtatcaataaaatactattacataatttacagatcttattcaaattttcccaattttcccaataatgtcctttatgggattatttccccctgccctagcatctaatccaggatcccatcttgcgtatagcttttatgtctttttaaagtctctcttttaatctccaactgttgttcagcctttctttatttttcatgacattgacattttaaagaccacaagcagttattttgtggactgtctttcaattgaggtttatctgatgtttcttcatgattagatttcctcctccctcctcagcaagttttctttttaaaaaaaatactgtttttaaactctcttcatgttgatacatctgtatccagtttgttgattccacctgctgcacagaattccctaatgcagactgcctcttggaacagatttggcagggctgccaggaaggcagcatccggcagagcttccttggcatcaggatggtgtctttgtgggggctgtatgacatgggaaatgagaacaccactttgacacatgtgccctgggtcaccctgctttagctggtgatagtgggcctcagatgtttgcttcttcaactatttctaaggcacacggagctattatgctttgcaagataaggtaggataggaagttaatctctttgattgttttttccttcattaattcatgcatttaataaatattgattaagggcctactctgctcattggagcttatcttctagcctattgaatacataaaataaacttttgaatcgaaagctcgtctaactgtgacagaggcaaagttgttaaaattgagcttaaggtaaatggttcaacattttcaatttattagtaaaatagccttatagaaatcatgcttctgcctcgtcacccaaatacagtgatttccatttctccctggcctcttttggtatttaccaacattgaacatcatttgtgcctcattatctctatagggcataaataattttgcattcccttttttccagtgaaaaatattttgtatatactttcccttgtttcataacttgcatattcatcacacttaatgactgtagtaaattctttcaagctgatctataacttatgcatatctcttaagttgtaaatttgccttgtgtctagtttttccactaatgttaggagaaaaaattttaaaggaagtgtgtatcatgctcctgtgttaaggcagttttgacaaatagtttcgtctaaaatcgttcattctaagatacaaaaaaggttagattcctgtaaagaaaacacattctgtcttctttttaggaaaacttattttttcctgattatgttttgagtgtccacttataatggaaggataattagtagagaaagacctgatgtgcttggagctttgccagctgaaaaccttgcatgtattaggaaacagcaggtttccagtggggaatagtagagtaatggactgtgcagctaagatataagactgcagcgcgacagctcccaactgcagcaggctcaccatcactcactttccttgacacaagtggacagtctttcagttcttctgcactttccttgtgagaaccaccggaggaatacatcgccctctggcaggaggcagtcagctccatcacagcagggaggagtgatgagctgtccgtacctctggacacacctaggaatgattccgcagccgttgctcagtcctcagcgaggactcaggaaagcaagaaatggacatagttctcgtttacagatcactgtgtttcatcccacccagaatcttctgagcatccaatgctgagaggtacttgcccggggtgaggttggaagctcgtgatcagtgggtggttgcagggactatttctaaagagggcacgaataaaaagatttgggaccaactaaccggaccttggtaggatggaataactgagacattaattgttcggtaggctctgctagaaacttcaaagatcctaggtagggctctgacatcttctgtattagttatgtgcctgtatggatcagatgaggattttcttcatatatagaatttttatcttacttttcctccatgagagtgggaccttgtgtgtctggtttcttgctctattttctgttgcttagtgtggagcttagagcataaaaagtgttcaataaatatttgttggttggacgatgacttaagctgtgtagttctgtagactaaaaacatgatcatctaggcagctgcaatctacttgtttaaagggttctctcaggttactgcagaaatgagtaggacctaaagaaaccgaagtcggagaatagcagggtgcaaaggaaagtacagtggctttagagccaggcagataagagttcttatcccaactctactactcactgctgtcttcacttggttaactcatttatgattcctaaatctgagctttcgcacctataacatgcgtatcaaaccactttccccacagagtttgtgggcagttcattgctcagagtggacactcaaaaatgtcaccttcttcctccctcccctgccaaaagggagacaaaagcaggaggggcccagatgatgtgtccaagtgttagatctctacattcatgttatctgtcatgtaaagtgtgccacatattggcttctcttcatacagcagctaatggcatgcatacttcaaacagcatatgcaccttttggttctgctttgagcctctctattagtaactgtgttctttgcctttacaggatttatgagcgtgtgatagaccctccagataccaaccttcccccaggaatcaatttatggcttggccagcgcaaccaaaagcatggcttattcaaagtaagcactaacgttctttttattgaagtatatatataggcgatgctcagttttctgtgttatttattggagccgtgtttataattacattagtgggaagggcatggcataatagctactaatgtttattgaacacttactttgtgacacatgcttttttatgtgcttgacatgaataaactggtttacttgtcacagtaatttgtgaagtaggtgctttgaaaccaggcagagagttaagtgacttgcccaaggttatccagttcactctgctgccagggatggatgatccagaaggcaaatgatcctcaaaatgttgacctcccaattctgaaggatttacgataatcttcaaactggtttcccttctcagattatatgttaattcagtttagagtagatgtctagatatgaaaaatacatctctgcttccttgagctttggtttaattgcattactgggaacagaaaaccaaatactgcatattctcacttataagtgggagctaaacactgaatacacatggacacaaagatgggagcagtagacactgtggactactagaggtgggagggagagagggagccatgggctgaaaaactatttggtaccatgctcactacctgagtgactggaccatccatagcctaaacctcaacatcatgcagtatacccatgtaacaaacctgcgtgtgtaccccctacatccaaaattttttttaaaaaaactgcattattatacttcacagaaacataaggatacagtgataaaataaatttaaaaacttaaaaataccatgaaattttaagacagtcttgttctttgaaagaatgacacacttttgcttctggcaatatggcagactagatattctaaaaatccttctgcttcaaaatgactataatgctcgataaaataccacaaaaatattttaaaattcagcattgtacttatacgaaaggaattccttggggaccaaatatatggaggggagagaaagccagaggggtatcagtaccagaacttagagccttaggttccttcttttttatttttaaaaaattaaggtgtaattccgcatgttctcactcacaggtgggagttgaacaatgagaacacatggacacagggtggggaacatcatacactggggctgggagagagatagcattaggagaaataactaatgtaaatgacgggttgatgggtgcagcaaaccaacatggcacatgtataccaaggtaacaaacctgcacgttgtgcacatgtaccctagaacttaaagtataataaaataataccaaaaaaaagtaagatgtaatttacatacaggaaaattcattccatttaatgtacagtgtcacaagttttggaaaatctacactgtattataatcatcattgtaattgagataaagaaccatttctttatctccaaaaatttccatccccctttgtattaaacccttctcctcacccgaagcctttagcaaccactggtctgttttctgaccctgtagttttgtctttaccagaatgttatataaatggaatcatttatgtgtgtgtgtgtatttacataagtttctatgttgagattcaccaagttgttgtgtgtatcagtggttcattgttttctattgctgagtagtattccagttctgttgtatgaatgtatcatattttgtttgtccattcttcagttgatggacatctgggttatttccagtttggaacaattatgaatagaaccactataaacatttgcatacaggtttttgtgtgaacagcggttttgatttcacttaggtaagtgtgtaggtgtgggcttactgggttgtatattaagtgtatgtttaaattcacaggcaactgctaaaccatttttcaaagcagctgtgccagtttttgcattcccaccagcaatctatgaaaatttcagttagagctttaaatttcaaccgtctgtgtgggatgggagaaattacttagatcccatgcgtgactgagtgttggaatggaaatttttaaggtaaagccagtccactatctagcagaaggaggcaatccagaaactatcctgtctgcatctcatctccagatgagaaaaaataatacttcccagagaactagtaaaccacagcacttgaagggttgcagacttgacacccagatttactttacccatgaagctcaataaagtatattaaagtggccctggattaggtaccttgggagtcctgatgaagaaaatacaaattatctttggagaaagtcacttttgatgtagacctcaaaggatgcccacagattaagtccataaaataggagctctaaagccatcacgaatgacagtggaaagaaacaaaaaaatgctcagttagtcctcacagggctacagaaaatgaaattagcaggtaaagaatttttttttaattttttaaaaaacttctgtttaaaatgtttgaagaatcaaaataataaagaatgtatgatgactagagataataaataggcccagagatagttgaactaaaaagcacttccaaaaatgaaagatacagttgttgaagttaaaaaagaaacaaaaaccaaaaacctcagtgaacctgctaaacagattagacacaggtaggaagagcatttgtgaaatggaaaatattgttaaaataattaaactaatagtagtgcttcagagataaagagaagaaaataggaaggaggttaaaatatagaacagatacatgtatataaaaaaagtttacgtatctgtttaatatgtgtgaatatgtatgcatatctatataaaatggctgttctgatgcctctatgttttctaagtggcttcttagatagctgagatagatagcttcttagatatgtatattattataatatacatatatttaaaaattaaggaagataataaagaatatattatgtctatatatgcatatatatttgaaaattccagatagtaaacagagataaaggttatgggcactattataagtataacgggtaagaattttctaaacttaataaaagacattaattctcattactgaaagaacaatgaaataaaagtatatgttgttgatttcacatagaaatcatagaaaacatagaggcatcagaacagccattttatttagctcaaaaaccaatttttttctgctttgacctggctaagctgatacttgttaggctgtctcccatgtctgtggttaattggcatgctagcaggtggcaggatgatctgagagcctcttcacctctctgggggttggctggctgttgactcttgttcctcagttgtcctcacatggtctctcatctccaatggcctagctcagcttatttacatgtcatccctgggattccaagtatcggaagagtgcaatccctaaagtactaatattttcaaggctttgtttgcttgatcacatttgctaatgttttattgcccaaagcaagtcatatggccaactccagagtcaaaatgtaaataaatagacttcatctcttgaagggctgctccatgatatcacattgcaaggatatggatgcaaggagggaagaattttttttggccacatcagcaacctattatacaaatcaagataaatagacagccacacttagatatactggcagaatagcagaactccaaagacacagagaagatcttaaaaatagccagtgacaaaacacaaatttttcacaaaaggataacaaactgaacagctggtttttaaacagtaaaagcagaagtcaaaagacagtagaaaaagtgttttccaagttttgagagaaaataactttcaaatgtagtagtatataccaagcttaattgtcatttgagaatgagtgtgacataaagacattagtagagaaatgaaactctcagtttataaccaatagatcttcatttaaaaaacttcctggaaggaagacatacagtgcaagaagaattggagagcaaatgcatgttgacagtatgcacaaatctcagtgattattattctgaatgattgccattatccttgtttgattaaaatataataatgcttaattttagaaaaataatattaaaaatattgacaatggaatccttcaccatcaaccaaaatatccgggttctgtcatcaaaattgactagaaggctggcgtgactcatggagagaaggaggaacagtgcggtgcgacggcccatctgagagccacacgggaaaggggagccccctccctgcagccaagggaggcagatttccagtaactccagccggagactcagggacagaattcggatttccctgggcctgagcccctagcgggagaggtggccacagtctgtgtggaccagcagacttagcctcttgtcttggtaattctgaagaatccgggcagtctagacgagtaggtttccccccagcaaagcacacccgctccaccaatggccaaaatgcctcattaaacaggtcctgctccctgtgccacccaactgagtgagaccctccaacaggggttgtcaagcaccctatacaggagcaatcctactggcatcagtttggtgtcgttcgaggtcagaggtcccagaaggagcaggaatccaactctgctgttctccagcctccttaagtgacatctccaggcatgggagtgaagcaggtgaacagggcctgaagtgaatccccagcaaactgcagcagccctacagaagagagacctgactattgaaataaagacaagcagaaagtaacagcaacagcatcatcaatgacaacaaaaggcccccacaaaaaccccatccaaaggtcagcagcctcaaagactgaaactagacaaactcacgaagatgagaaagaatcaatgaaaaaattctgaaaacccaaaaggccagagtgcctcttctccaaatgatttcaatgtctctccatcaagggcacagaactggatggaggatcagatggacaaattgacagaagcaggcttcagaaggtgggtaataacaaactcctctgagttaaaggagcatgttctaacccaatgcaaggaagctaagaaccttgataagaggttaaaggaattgctaaccagaataaccagcttagagaggaatatgaacaacgtgatggaactgaaaaacatggcagaagaactttgtgaagcatacacaagtatcaatagctgaattgaccaagcagaaaaaaggacattagagtttgaagaccaccttactgaaaaaagatgcagaaaagaataaagaaaagagaatgaaaaggaatgaacaaagcctccaagaaatatgggacttcataaaaagaccgaacctaccattgactggagtaccagaaggagacagggagaatggaaacgagctggaaaacacacttcaggatattatccaggagaacctccccatcctagcaagacaggccaacatgcaaattcaggaaatacaaagaacaccattaagatactctacgagaagatcaaccccaagacacatgatcatcagcttcacgaaggttgaaatgaaggaaaaaaactgttaagggcagccagagagaaagaccaagtcacctacaaagggaagcccatcagactaacagtggacctcttagcagaaactctgtaagccagaagagattgggggccaatattcaacattcttaaagaaaagaattttcaacccagaatttcatatccagccaaagtaaacttcataagagaatgagaaataaaattctttccagacaagcaaatgctgagggattttgttaccaccaggcctgccctgcaagagctgctgaaagaaacaataaatatggaaaggaaaaactggtaccagccactgcaaaaacacaccaaaatataaagaccaatgacactacaaagaaactgcatcaactagtgtgcaaaataaccaaataacatcatgatgacaggatcaaattcacacataacaatactaaccttaaatgtaaatgggctaagtgccccaattaaaagacacagactggcaaattggataaggagtcaagaccaatcggtatgctgtattcaggagatccatcttacatgcaaagacacacacaggctcaaaataaagggatggaggaaaatttaccaagcaaatggaaggcaaaaaaaggcaggggttggaatcctagtctctgacaaaacagactttaaaccgacaaagataaaaaaagacaaagaagggcattacataatggtaaagggatcaattcaacaagaagagataactatcctaaatacatatatgcacccaatacaggagcacccagattcataaagcaagttcttagagacctacaaagagacttagactcccacataataatagtgagagactttaacaccccactgtcaatattagacagatcaacgagacagaaaattaacaaggatattcaggacttgaactccgctttgcatcaagtggacctagtagatgtctacagaactctccaccccaaatcaacagaatatacattcttctcagtgccacatgactcttattctaaaatcaaccacataattggacataaaacactcctcagcaaatgcaaaagaactgaaatcataacaaaccgtctctcagatcacggtgcgatcaaattagaactcaggattaagaaactcgctcaaaaccgcacaatttcatgaaatctgaacaatgtgctcctgaattactcctgagtaaataatgaaattaaggcagaaatcaagaagttctttgaaaccaatgagaacaaagagacaatgtaccagaactgattatcagagaaatgcaaaccaaaaccacaatgagataccatctcataccagtcggaatggtgattattaaaaaggcaagaaacaatagatcctatgtgaggctgtggagaaataggaatccttttacactgttggtgggaatgcaaattagttcaaccattgtggacgatagtatggtgattccttaaggatctatgaccggaaacaccatttgacccagcagttccattactgagtgtatacacaaaggaatataaatcattctactgtgaagacacatgcggccgggcgcagtggctcaggccagacacggtggctcacacctgtaatcccagcactttgggaggccgaggtgggtggatcatgaggtcaggagttcaagaccagcctgaccaacatggtgaaaccctgtctctactaaaaatacaaaacttagccgggtgtggcggcacgcgccagtaatctcagctacttgggaggctgagacaggagaatcgcttgaacccatgaggtggaggttgcagtgagctgagattgtgccattgtactccagcctgggtgacagagagagactgtgtctcaaaaaaaaaaaaaaaaaaacagacacatgtacatgtatgtttattgcagcactattcacaatagcaaagacgtggaactaacccaaatgctcatcaatgttagactaaagaaaatgtggtacataaacaccatggcatactacacagccatgaaaaggaatgagatcatgtcctttgcagagacatgggtgaagctggaagccatcatcctcagcaaaccaacacaggaacagaaaaccaaacactgcatgttcttactcataagtgggagtttaacattaagaacacatggatacagagaggggaacaacataccccagggcctgttggggggtgaggggtgaggggagggaatttagaggatggatcaatgggtgcagcgaaccaccatgacacatgtcctatgtcacaaacctgcacactctgcacatgtatcccgtgtttttttttttaataaataaaaaaataattaaaattaaaattaaaaaaatattgacagcaataaaatgttagtaaaggtgatctgatttaaagtgttctaaggcctgatttcaagtgttctaagtggtcagaaaaagaatggagaaactgattaactttagactttaagtctacatgttagaattaaaacaatatcaaaataatagaaatcatgtttaactcccaaactctgacatttaagtataagagaaaaggggattttttttaagcctcatcaacccaaaataaggtaagaagagaaatatttaatataagataccatatataattccatttcacaattgttattatcaatttaagtgatttacacttagaatgaaaaataagagtattatattgaattcataaaacccaaagcctgttgtatattgcttacagtgaaacaataaaaaataaggactcataaatgttgatagtgaggtagttaaaaaaaaaaaaaaaagaaaaataggccaaactaaacatgagaaggctggagaaactgctgatttcaaactgcaaggccaaaaaggtcaccacataataataagctattttaaagatgtatgtactgaataacataatctcaaactgtatgttgtagcctggcagaatagcaggcatggatggcctactcactacagtgtgctgggtcaactgaatatccccatggggaaagcactaatcctgaccctgtttcacacaactgataatgcaaaatcaattccaagtgggctatagatcaaaaagttaaactgacaaagcttataaaagataatgtaggagaatactttatgacctcgatgtaggaaaaatactttttaaataagatgtaagaaataataactataaaggaaaagactgatccattggaatatattaaaatttggaacttttctcatcaaaatagatgactaagagagtaaaaaggcatgtcaaggaataggaggagctattcaaagtagttgtgtcccacaaaggccttttatccaagctgtataaaggacccctttacatcaataatgaaaagtctatccaataaaaacatttgagaaaaatgctaccaggcacttcacaaaagggaatgtccaaaaggccagtaaacaaaggggatggtatcaatatgattagtcatcagggaaagtaaagccatactgagatgctactgaatatccatcagaatgggtcaaattaaaaacacagaccataccatgtatttgcaaggatgtggaacaactggagccttcattcactgctggtgggaatgaaattgatttaagtactaaggaaagctgtttgttagtatggttaataaaatggacatatatatgtcctatgaccaagaaagaatactctaggtacctaatgtctaatagagatatgcatttgtatacactaaaaggcatgcacagaatttttaagatttgcataaatttgtggggtacatgtaaatgttgttatatgtatataacgtatagtgatcaagtcaacgtatttagggtgtccattgcctgagtataatacatttttgttaagtatagtcaacctactctgctatcaaacattgaaattattccctctggccgggcgcggtggctcacgcctgtaatcccagcactttgggaggccgaggcgggcggatcacgaggtcaggagatcgagaccatcccggctaaaacggtgaaaccccgtctctactaaaaatacaaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaaaaaaaaaaaaaaaaaaaagaaattattccttctgtcctactgtgtatatgtaccctttaaccagcttctcttcatccttgctccatgtaccccattcacccttcccagtctctgttatctgtctttccgctctctatctttccactctctagctgtgtattcaaattttttagctcccacatataagtgagaacatgtgatatttgcctttttttttttttttttttgagacggagtctcgctctgttgcccaggctggagtgcagtggcgcgatcttggctcactgcaacctccgcccctccaggtttaagcatttctctgcctcagcctctggaggagctgggattacaggtgtgtgccaccatgcccggctaatttttttgtatttttagtagagacggggtttcactgtcttggccaggctggtcttgaactcctgacctcgtgatccacccacctcggcctcccaaagtgctgggattacaggcctgagccactgcgcctggccagatacttgccttttttatgcctggcttatttcacttaagataatgacctccagttccatccgtgttgctgcaaatgacatgagttcattttctttttttggctgaatagtatttcattgtgtatataggccacattttcttttttttaaattctatgatttggtgtttattttttatatttttaaaaaaatttcactagtttttggggcacaggtggttttttgttacatagataaattctttagtggtgatttgtgagatttttggtgcactcatcacccgagtggtgtacacagtacccaacatgtagtcttttatccctcaccctctctcaccctttcacctaagtccccaggatcccttctgtcattcttatacctttgtgccctcatagcttagctcccacttataagtgagaacatacaatatttggttttccattcctgagttgcttcacttagaataatggtctccagtttcattcaggttgctgtgaatgccattatttcatttccttttatggctgagtagtatttatatatacatgccacaatttctttatccattcattggttgatggacatttaggctggttccgtgtctttgcaattgagaattgtgctgctataaccgtgtgtatgtctttttcatataatgacttcttttcttcttggtagatacccagtagtgggattgctggatcaaatggtatttccacttttggttctttaaagaatctccatactgttttccataggggttaatagtttacattcacaccagcagtgtaaaagtgttccctttttagtcaaattgtccctgtttgcagacgacatgattgtatatctagaaaaccccatcatctcagcccagaatctccttaagctgataaacaacttcagcaaagtctcaggatacaaaatcagtgtgcagaaatcacaagcattcttatacaccaataacagacaaacagagagccaaatcatgagtgaactcccattcacaattgcttcaaagagaataaaatacctaggaatccaacttacaagggatgtgaaggacctcttcaaggagaactacaaaccactgctcaatgaaataaaagaggatacaaacaaatggaagaacattccatgctcatgggtaggaagaatcaatatcatgaaaatggccatattgcccaaggtaatttatagattcagtgccatccccatcaagctaccaatgcctttcttcacagaattggaaaaaactactttaaagttcctatggaactaaaaaagagcccgcattgccaagtcaatcctaagccaaaagaccaaagctggaggcatcatgctacctgacttcaaactatactacaaagctacagtaaccaaaacagcatggtactgttaccaaaacagagatatagactaatggaacagaacagagccctcagaaataatgccacatatctacaactatctgatttttgacaaacctgacaaaaataagaaatggggaaaggattccctatttaataaatggtgctgggaaaactggctagccatatgtagaaagctgaaactggatcccttccttacaccttatacaaaaattaattcaagatggattaaatatttaaatgttagacctaaaaccataaaaaccctagaagaaaacctaggcaataccattcaggaaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggaaacctacagaatgggagaaaatttttgcaatctactcatctgacaaagggctaatatccagaatctacaatgaactcaaacaaatttacaagaaaaaaacaaacaaccccatcaacaagtgggcaaagtatatggatagacacttcttaaaagaagacatttatgcagccaaaagacacatgaaaaaatgctcatcatccctggccatcagagaaatgcaaatcaaaaccacaatgagataccatctcacaccagttagtatggcgatcattaaaaagtcaggaaacaacacaggtgctggagaggatgtgtagaaatgggaacacttttacactgttggtgggaccgtaaactagttcagccattgtgaaagtcagtgtggtgattcctcagggatctagaactagaaataccatttgacccagccatcccattactgggtatatacccaaaggattataaatcatgctattataaaggcacatgcacacatatgtttatcgcagcactattcacaatagcaaagacttggaaccaccccaaatgtccaacaatgatagactggattaagaaaacgtggcacatatacaccgtggaataccatgcagccataaaaaaggatgagttcatgtcctttgtagggacatggatgaagctggaaaccatcattctcagtaaactattgcgaggacaaaaaaccaaacactgcatgttctcactcataagggggaattgaacaatgacaacacatggacacaggaaggggaatatcacacaccagggcctgtcatggggtggggggaagggggagggatagcattaggagatatacctaatgttaaatgatgagttactgggtacagcacaccaacatggcacatatatatatatgtaacaaacctgcacattgtgcacatgtaccctaaaacttaaagtataataaaaaaaaaagtgttctcttttcaccacatccacgtcaacatctattttttttttttttaaattatgaccattcttgcaggactaagatgctatttcactgtggttttaatttgcatttccctgataattagtgatgtgagtattttttcatatgtttgtttaccatttgtatatatcacattttctttattcattcattcattgatgaacacttagggtgattccatatttttgctttcacaagtaaataatatttgctttcacaaatctataaataaaactagggaagtctcctagttttatttacagatctaggtggcacttgcacagtgtttatgtcaagttaattcatcaatatgtacttttatgatttgtgtaactatctgtatatatgttattctttaataaaaatgtttactaaacatatatgcatagtaggtaattagagggaaaatggatacatttgccatcatactgagtgatatttaacatacttctcgcaataacttatagatcaagctagcagaaaagttagtaagcgtatggatttaaacatacttaacaagtttaatggctatatatatatacacacacacatacacactctaccaacaatgaacacatctagcacatggaatctttgtgaaaattaactacataaaagtccataaaaaggaaatctccacaaattacaaaaaatgatacatagaccatattctctgatgacagtgcagttacgttagaaataaatagtgaaaagataactaacctcccacctttgtatgtttggcaatataaacagtatcatttaaagtaactaatcagtctgggggaaaataatagtataagttaataactaactcagaaagataataaatatcacaatttgtgagatgcagctaaagcaattcttagcagtatttatctttaaatgcttgtattggaaaaggtagatatttaatgagttaaacatccaaatagggaagttagaaaaagaacaacagaatgtatacaaagaaagtaaaaggaatgaaatagtaagcatgaaatcgtaagaacagaaattcataaaataatgagtagggtataataggcaagatcaagaaagccaaaatttgatcatttgaaaatacactgggaagtttgagcaagaagaaaatgagagaaggcataaatatattagaaataaaaaaagcatataacaataaatgctgcaaaaattaaaacagtagtaaccatttgttaacaactttatgccaataaaatggaaaattagagaaaaatggacagttttctaaagctacatgaatcgccaaaatggacttcaaataactatggtagtcttagcttcattaaagtgatgagtttatgattgaaagtctattgtaccagttagcttttgatatacagcaaatcaaaacaaagcttaatggcttaaaacaacagcctttatttacctcacaattttgtgcattagcaatttgagctgggcttactttgctggattttattctccatgggttcatttgtgcatctttgatcagctgctggggtttctggggcctagttgtactaggccttgaatggccttagctggtatggctcatctctgcttcatgtggcctctcgatttccagaagtctagcccaaactagtttacatgatcatggaataaagtttcaagagtcagagcagaaatgtgcatggccttttgaggcctaggcttgaaacttgcactagattactttgcttcattatattggccaaagcaagttacaagcccagcttagattcaagtgtactggaaatagatttgaccttttgatgggatatgctacaaattcacattgcacaaggtatggacacagtgaggagcaaaggactgggatcattctggcagtctaccatgtccctccaccaaataaccacgaggctcacacagttttacaggggagttgtagcacacatccaaggaaataattccaatcttaaataaactcttccagagaggagaataaatgagaataccactcatctaattttatgagcataggtcaccttgatttgcagagtagacaaggaccgtatgagaagggaattgcttaagccaatttacttttgaacagattagattaaaaaatttaaacaaaatattattagcaacctgtttattagcagagtgtatgtatgcgtgtgtgtctgggtgtgtgagagagaacaagttgattatttcaatagtgaaaatttgtttttatcttcagaaaatttcttaatgaaattgactacattaaaggagaaaaaaatccaatggtcttctcaagaggcagaaaaggcactagaagaaattcaatactgactcattaaaaattcttagcaaactagaaatagaaggaaacttcattaaattgataaaagtacatgaagtaaacatacatcaaatatcatacttacggtttaaatattaagagaattcctgttaaaatcaggaaccacacaagaatgactattatcagtgtttctattcaacattgtactggaggttcttaccagcaaaataagtaaaaatcttaaggattataatttaaaaagtagttattaacttatatattgcctatatataaaaaatgatcaccaaattattagaattagcaagagagttcagaaagagtactagatgtaaagccaaagataagatcaattgcattgctgagcaaaagcagcacagtggcagctgcaacagcaataacaaaaactgcaattaaatattttatttataatatcaaaaggtgaatcaaataggaacaaatcaaataaaatatatacatgacacctataaagaaaattatgaaattttatgaaaaaccactgaagacctaactggggagaagtacgctatgttcttggagaagaaggcttaaaataataaaaacgtctgcttcttccacattgctctctagggtcaatgaacttgtaatcagttcccaagaggatttttttttttttcctgatggactctgacaagctgatgctaaaatttttagggaagaccagaggccaagaataactaagacattttctgagggagaaaaaggaagggacttagccatccagatgtgaaggcttattgtaaagttatagcaatcagcagagtgtgatatcactgcattaatcagcacatgaaccaagagatcagaatggagaggccagaaatgaccctttcgtcatgtgtggaaacttggaaacttgacacataactgatgtggcattcctgaccaatgaggaaaggatggattcatcaatacatggttaggaaaatcagttatttaaaaacattatatatatattatagacacagacattgagtgatgtaattgatttttgtgtacagtataaggaaaagcttcaaatatatacctggaccccatacataaaaatcacttacaagtacaattgaattaaatacctaactgaaagctcaatgttgaaaggtttagaagacaacataagaacatatcttcacgatctcagtcaggatagagaagttcttagacaagataaaaaaatgcacaagtccttaaagaaaatactgatgggtttactgcataaaattctaaaaagtgtgacaatacatcaaggaagatcttgacaacaattagcaaaaaaaaagtattcattgaagaaatgctgcaaatcaataagaaaccttttttttttaactcaataggaagtcagacaaaagatatagaaggatggttttccaaagtagaaaacataaataaccagtgaacatattgaaagtaattcaagttcactagttatcttggaaatgcaaattaaaaccattatgaaaaaccatttcttcacccattagcctggcaaaagtgaaaaaccatctgacaatgctatgtgtaggggaagtcattgagcaatggattcttacccattgtgttggaaacttgaattggtggaaccaatagagagggaaatttggggatccttgtaatgtgcatacatttggacataggagcccaactctttggtataaacgttgaagaaactcttggtcatatacccaggtatatatgtataagcatcatcacaggacttttttttttgttttggtaatttcaaaaacttggaaaaaacctaattgtccatcaataggagaatgtttaaatacgttgtagtagagacatagaaacataaaaatcagtgaaattgaacaaaaattgatgaattgctaaagtaattttaaatgaaaaagctagcagaaggataaaattacagtattaaatcatgtatatatttcaaaatgcaagataattccatatacagcttattgatacatccatatatatacaaagaaaaatgcatagaagtgataaacactaaatttagaatagtttacttctgagaggaggaaatgggagttttattagggttgtgaacccagaagacttcaactatattgaggatattttatttctcaagtgtttgctatatgttgttttgtacatcataaatattcaaaatgtttaaaatggcatactttttcagggtgataatccacatatatatgtgaatatatgtatatatgtgtgtgtgtatatatgtatatgtatataattttgccatgtttccaagaatgaacagaaattcatccaagtgtctcagtttaaaactgaactcacattcaatgcaatggtgtgtcttgttctgtagctagttacttcctggtgaagctctccttttcttgtgggtcctggatctgtaatgaagggcaatgactggttctcagtcctgaaaagacattaaaatcatattagaagactttaaaaatcaaattattgtgtacacttagacctcctcattgagaatctgaacagtagggtctaagaactgacacatttttttcacaaccttcttattggttttgatttattcagtttgaaggctcaaatttgagtgcactgacatacaggaaatatgtgttgatggcctagattatggttttgccttatctctataaggagcccacaaatctaacatatggtcagtaattagcttctaattagtgactttttagattagttgttctctaactttagattgcatacaaatatcctggaaggcttgttaaaacacaagtagctggatgtcaacaaaatgttagagtagaaaacctgaagctgctgtttctcgacagaaacactgaaaaacaagcagaaattgtcagaaccaactttgttggaacttaggaaaatagtcagaggtttatagcaaccgagtgaatgctgaatcaagaaaaaggcaaccttaaaacagtaggaaagctgtgaggcatgtttacttgccttttgtaccataccatttataacccagtggcagtcctgaaagatttcagcccatgttcctagtgtaggacaacagtctctggttgtggagtgagcagagcagaccttattcacaaattattttgcatatctattctaactatctgggactatgtgaagaactgataaaaggtacttgtaactcagaacgagttagtgggtgcagcgcaccagcatggcacatgcatacatatgtaactaacctgcacaatgtgcacatgtaccctaaaacttaaagtataataaataaataaaaaaaaaaagaaaaaagtggcaggcattgatttattgcatatttcaaaatagctacaagagaagatttggaatgttcccaacacgaataaataactaatgtttgaagtgacagttatcccaattatcctgatatgatcattatatattgtatgcacgtaccaaatatcaaatgtacccaatacataggtacaattattatgtgttaatttaagaaaacatttcaaatctaacaaacaccatgtgtctgcctggggccaaagagtatggttgagacatatagtagatcatgtaaagcaaagagaaaatgctggaaaaagggtttctttggacaattagaacattcaaaatcacctgtgtgttcaaggaatttagaaagccatatgcatgcctagggcaagaggtaaggtcagaaaagacttgagaacacccaaagctttcatctttggctgatccctaggatcagtgtaagcctggctaagtgttgaaggagggtcccagcacggagaaaatctgcaaaggttggaggagtctctctctctttcttgtttttggttgctgacattcaaggaaatccctgtcaaaatttttttttaagtttttttttctttctttcttttttcttcttttgagacagggtctcattctgttgcccaagctggaggacaatgatatgatcatggctcactgcagccttgacctcctgggctcgtgtaatcatcccattttagcttcctaagaagctaggactacaggcacatgtgaccatgcctggctaatttttaatttttttttttttttttcacagagacaaagtctcactgtgttgcccaggcaggtctcaaactcctggcctccagcaatcctctttccacagcctatcagagtgttgggattacaggtgtgagccaccttgcctggcccaaaatactttataacataagattaggaacagagatttcagttactacacatgactagaaatacagtctctgcaaaaatagtttggtaagccactaaagaaatggactactgtagtattcaacaataaaaaacaaagaaaaacaaaactcagcaaaccccagtaaaggggcagatctgttctccagtgttaatacattataacatccaaatgttcagtgttcaaataaagtcacaggcaaacaaagaaagaggaaagtattgtcattcaaaggaacaaaataaatgaatagaaactattcctgaggaagcacagatgttgaacttactgtacagactttaaaataactgtctctaatgtgcttaaagagctagatgaaaacatggataaagaaataagtcacgaaaatgatgtataaaaaaatgagaatatcaatgaagagatataaattataaaaaggaaccaaacagatactctgcagctgagaagtacaactggaataaaacacttactagagggatgcaagagaagatttgagcaggctgaagaatgagtaatggaacttaaagataagatcattgaaattaacaaggctgtggagcaaaaagaaaaatgaataaagaaaaatgaacaaggcctgagggatctatctgtaggacattatcaaatagactaatgtatgcaccgggggtgtctcagatggagaagatagaaagtactggaaagaaaatttggaacaataatggttaaaacttttaacatttgatgaaatatatgaatctatgtatccaagaagtttagcaaactgtaagtaagataaactcaaaggtatccacactgagacacgttatgataaaaccatcaaaagataaacgcaaagagaatcttgagagcagaaagcaagacatgactgtcaaatacaaggacttcttcatgagattagcagtaaatttatcatcagaaaccatggagaccagaaggcaatgggttgtcatatttaaagtagggtcattactactgaccttacagaaattaaaaggattaaaatagaagactatgaataattatatgaaaacaaattagataacctagatgaaatggacaaattcctagaaacacataaccaaccaggactggatcatgaagaagaccggatcatgaagaattagaaaatctgaagagacttataataagtaaagtgtttgaactggtaacaaaaatctctcaatcaagtaaagtctgggaccagatggcttcactggtgaattgcaacaaacattcaaacaagaatgaacatcaatccttcttaaactcttccaaaaaattgaagtggagaaacatttcctaactcattctatgaggtcagaattactataataccaaagcagataaggacatcataagcaaagaaaattacagaccagtatctcttatgaatgtagaggcaacatttctcaacaaaatacaaatgaactgaatccaacagtgtattaaaaggattatgcactatgcccaagtgggatttatcccaggagaatggtttaacataagaaaagtcaagcaatattatatgccacattaatagaataaaggaaaaaaagccctacaggatcatctcaattgacacagaaaacgcatctgacaaaatccaatatcttgtcatgataaaaacactaagaaaatgagcaacatgtggaaactttcttaacgtaataaagggcattaatgaaaaactcagagctagcattatactcaatagtgaaagactcaaagttttcctcttaaaatcaggaacaaggcaaagatatcaccactgctatttaacactgtactggaatttctagccagtgcaaatgggcaagaaaaataagtaaatgcattcaaattggaaaagaagtaaaactatctctactcacagatgccatgattctatgtatagaagttagaccccctacttcacaccacatataaaaatgatctcaaaatcaactaacattctaaatataatagctacaaccactaaatcttagaataaaaagtagaggtaaatatctatgggcttgcattttacaatggattctgtgactccatctcaaaaaaaaaaaaaaaaaatttcttcatcaaaagagattattaaggatgtgaaaacaaaaccaaaaaaaggaagaaagtatttttaaattatgtatcttataaaaatttaatgtccagagtatacaaagtactcctataactgaacaaaatgacaacccaactgaaaaatgggcaaatgatctgaatacacatttctccaaagaagatatacaaatggccaataagcacatgaaaagatactcaacatctttagtcattaggaaaattcaaattaaacctccaataatatatcacttcataccccaccagttataatttttaaataaaattcccatcctattagaaaataaggggaaaataagtgttggtgaggttgtggaaaatttggaactcttgtatattgctggtggaaatataaaatcatgtagcttgatgaaaataccaaaagcaattggaacagaatccaaaattgacaaatgggatgtaattaaactaaagagcttctgcacagcaaaagaaactatcatcagagtgaacaggcatccaacagagtgggagaaaatttttgcagtctacttactgacaaaagtctaatatccagaatttacaaggaacttaaacatatttatgagaaaaacttcatcacaaagtgggcaaaagagatgaacagacacttctcaaaggaagacatttacacggccaaaaaacgtatgaaaaagagttaaacatcactgatcatcagagaaatgcaaatcaaaatgataatgagataccatcttacgccagtcagaatggcgattattaaaaaggcaagaaacaatagatcctggtgaggctgtggagaaatacgaacatttttatgctattggtgggaatgtaaattagttcaaccattgtggaagacagtatggcaattcttcaaagatataaaaccagaaataccatttgacccaggaatcccattgctgggtatatagccaaaggaatataagtcaatctgctgaaaagacacatgcacacgtatgtttattacagcactattcacaatagcaaagacatggaactaacccaaattctcaacaatgatagactatttgataaagaaaatgtggtacatatacaccagggagtactacacagccataaaaagggacatgatcatgttctttgcagggacatggatgaagctggaagccatcatcttcagcaaactaacacagaaggagaaaaccaaacaccacatgttctcactcataagtgggagttgaacaatgagaacacatgggcacagagaggggaacatcacacactggggcctgttgcgggatgggggaaaggggagggaatttagaggacaggtcaataatacatcaagcccccatggcacacgtatacctatgtaacaaacctgcacattctgcacatgtatcctggaacttaaagtaaaatttaaaaataaaatttaaagtaaaaataaaattttgattaaaaaagttaaaaaataaaatcacgcagctgctgtggaaaacagtttgttggttcctcaaaaatttaaacacagaattacatgtaatccagcaattcctctcctaggtttataggtaaaagaattgaaaacagggactcaaacagacacttgtatgtcagtgttcactgcagccttattcaaaatacacaaaagatggaatgaagccaaatgtctacccatgtatgaatggataaagaaaacttggtatatgtatccagtgggatattattcatccataagaaaggaatgaagttctgatacgtactacagtgtggataagccctaaaaactatgctatgtgaaggaaccatgcacaaaaggacaactattctttaattccacttatatgaaatatcaaaaataggcaaatttattgagacagaaagtaaattaatggttaacaggggatggtggcgggagtcatgggagttattgcttaatggttacagagtttttgttgaggcaatagaaaagtttgattaatagtggtgatggttgcataacactgtgaatgtatttaatgccactgaattgtgcacttaaaatgtttataatggaaaattttaaaaaaacaaaacaaaacaggtagcttggtcctatttccaaagtctgattcagtggacctaggttgggacccaaatcttttcatttctaacaagctgccaggtgatggtgatgctgctggttctgagacatgctttagacagaaacataacaagaactccagggccgggaagaagaatcttggtttcaagggatggagatctgagtttgaatcctgaacatacctctttattatagctgttgaacttgtgttgctttgctttttgaagccaatgaagttactctcttgcttaaattcttttagtgactctctattgcatgtcaaaccagcgtaagatctggtccttgctgtcctctgcaaccttctctcatgccattttctcttctgcccaccatgcctcagccacactactctttttacagttccttgaacataacagggccttttcacctgcttgtgcccaggacagttttcattcggttgtttgaaatgttgtcttctttatttttctaaattaattataatttgtattttaagtgctagggtacatgtgcaggatattttcctggagcaccctctctttgcaggtccgtcaccattactgcatatatcggttagctattgctgcacaacaaacccccaaaactcaggggcttatgtcagtaagctcacaggtctgctcaaaaattgtgttgataaggatcggtcttggttgatcccctctagatttactcatatgcctgtagctggctggtggagttggccaaaggctgacttaactgggatagtctcagtgccatggtgattaactcctggctggggcaatgttgacgactggaccatgtgtctttcattatctaacaggccagcctgggcttgttcccgtggtgctcggcaatgtttcaaggtagagtagatgttcacaagacccttgaggcctaggctgggaactggcacaccatcacttccacagtgctttactgatcaaagcaagtcacaagactagccccagacttaagggatggggaaacagactccccctcttgaagtgagggtgtacaaagtcactgttcaaaatgtgtgagtacaaatggggaatcaatttgcaatcattctatcacatactttccaactgaaacatctccatttccggccccgcactcaccacagtttgagagtgtaggcagggctggcttcatgggccatcaacctgagcagtcccaggggggccgtgcttagaaaggtcctgtgattagattactgccctgctgttgccctcttcaattgtttagtaaattttgaacaagggactctgcaaattatgtagcaggttctaagtatagtttatgtgggtgtttatttgttcatcattggtctttctagattgtaggcttcaccagggtcagaactagctctcattcagcaagtgcttagaagtaccaggtacataactggcagacaatatactgttaatgaatgaatgtaccagttatgaatttatcttcttatttgtaaagttccagagatgtctttcctgaaggaaatgcagattatataagaatatgtattaaaagcaacttgcacatagtacatttgtaacacatgtctccatccctttttagtatttaagcacataaaaatgcatttcttggcatttaatgctccctgtatgtttaactgtatactgtagaaatgaaggcactcttcctgtcttttaggaatttctgttttagttatgaggatatgattaagagagagagaacagttcttcctattatctattccagcttgatgagtgtatgattctctgtagatataaagaactttgtgcttgagctcaaatacctggtacagacagataacacaaagaacattcagagacttggacaatcattttgctgcagaggtgggttatgggaatgtagaggacagaaccaacagttattgaatacttcctatgttacagactttggccctgcatatagtatctcagttaattacatttcaccttcagagaaatcctactaagttagtgatttttatccccattgtgtaggtcaggcaattggactcagattaagtaagttgccaaccttatatagcccagaagtgatggaaatgggatttagacccaggtctttatgatttcaaagtctttgctccttcattcaacaaatatttattaagggcttaccctgtgtttccacagttaccactgtgttgattaaggagacatgatatttacatgtggtacaccaagtaccatcaggagacagaatttgtctttttctgggtttccagcttcaaagaataggtgatcccagtggaaacatcaaaaggtgatggcaatttcacccagtccatcttcctagagagcaaggcggttcttcttgcttcctaataggagtggcctcatggaatggctcattacaaagatactttccatggggcagctttcaaaactcatcttctccttagaatcctggatgccaggcagtgcttctggccatccttttatgagaagaaatggctggggtaggggaaatatgtcagtgtctcattacagaaattacctcttgatcaattcaacactacaaaaatctccctgaaaaagaggcagccacttctcaggtgagagtcagcatagctccaggcttttaatatttatcttgtacatgctgcctcatggattcaacaaccacatctgctgaattgctccagaactaaaaatgcttgtgatgtgctttcaggttaaaataacattattctctattttaaatattattatgttgcctttataggcaaagtaaaagcaaaagctcctcacttgtcaaacctaatttctggaccctggtggatccttgtggatagtgcaaaaaaaagtgctgctgattaaatagcagaggatggaatcacttgcttggtgcctggtacataagcctctagcattaggtaattcctgtctgagacacagaacacaagctgggaattttttcacttcaaaacagcatccatttgagaaaagctggccagtagtgataggcttatctgaatcttctgattgtcatagattttcattatcaggatggttgattacccactcaatttccctttgatgcattctgagctgattatgctgttacaatttcagagggtgaaaaataaaaaaatgagccgaggtgaaccaaaataagttataaggatgcttcaggggttgagtgttctgacagtttctaaatagttgaggcctcagggagacttcattccaaagcctttcacagaggccaaggctctcctgtctttgtttctctgtctctgtgtctgtctggtgaacttgggtctgaaacctttcccttacctggacatcactgtctcctctaacagctgaggtgtcactgggaagtgaaattgattacaactttttaaaaattccacagctgtcgtttttacctcagctgcttcccataattccacagatggtaaacatatgtttataggcacattgaaaaagaagctatattggatgcctcccatctttaattcttatttttcctttcatgcagaaagtcaaagtcacagaactggggaatcttacacatttgaagattaatatttctgtgcattaagactttggaaacagcaggacagctaatgatatgctaatgagctgacagtttttattgatcataatgaaagtcgacaagtgtctttcttggcggttttgcatgctggaatattttattaacgtcttcagggcagaagtacatgattggttgcattttgaaaaccctccctgtgagtttacaggtcctactttttgttagcctgtttccaaagcttgagtccctgccagtttataaacagaacacatcttcatccatatatttacatgcccagcaggaaactctcccacccctttttcctctctctttcaaagcaatttgtttcagtattttagcatacaaaaaaatagaaccattttcttcaatgtaaacagagatctgcagggaaataagagcgttaaaaaagaattagcatttgtttggtggtgaagctgcttttgtttgtatcagaaagctctgcatgtttagaagagcttgcttaatcttagttattccatacacaagagggacctaattggataattttctaattttttaattgcatctttctatatttcttaatgcaaaatgagaaacgttctaggaataatagaaataatgggcattagttccctaaacattaaaaatccataatatacaatgtacctggtgcaaatttatttttcagtgcatggtgagctgacagcaggaggtacagggtggcaacaggtggattaaacaaaaggaaaaaaaatccatttttctgccgtccatccgtactaaatagtaagcttattaattttgggctctgcaccttagggatttatttaaggcctcagatcagctgaggttcatcattacactaacaataagaaaatggattgtttagcaaattaatagtgtaaataagattacggggggcggggggatggggggaagaatattaggctacctaaaaagacttctgttttctagcactgaaaaactgtcttagcaaattattattatctaatacaaatagttttgcatgtttgattggtatctatctattaaggcaatcaagataaaatctcattttgataacaagacctctttgtagcaacatgttgttggttcatgttaaggggatcccttaaattatatatttttacctacagcatattgtagtgacccagcactggttttggagtgttaatcgaaaagtgtctggatctgtctctagctaatgataaacaagtctcaatcaatttagaaaagtttattttgccaaggttaaggatgcacccatgacacaacttcaggaggtcctgaggacatgtgcccaaggtggtcctcatgtataccttgctttatacatcttagggagacataatacctccatcagtacatgtaagatttacattggtttgatctggaagggtaggacaaccagaagggtggcagcttccaggtcataggtagatttaaaatttttctgatcggctattggttgaaagcgttatcagtagtaaagaatgtctgggttctgataaggggttgtggagaagaagcttttatcatgcagatgaagcctctaaatagcaggcttcagggagaatatattgtaaatgtgtatcattagacttaaggtctgtgttgatgtaaatgctggagaggtttaatgaagcatgttcaactccttttccatcatggtctgaactagatttccgggttaactctggaatgcccttggcggagagaagggggttcattcagatggttgggggcttagaactttatttttggttttcaagagttagtagccctgtagtatatagcctaggattaaggtatcctttagaaaagctacttagagtatcaaagccttaaatttctcataggtcatatgaccaggtaatctggtcctagataagtagttcttatggaaagtatcaaaatgacctcagacagttttcaaaatagtcatgactgttctttcaacctcttccaaaattctgatatataccctaaattaaaaactattgccccacatgatcttcacagatcctaactgtgctcaaaattatgtggttcagtattgtataattcatagttttcaataatttgatgctttagaatatttattgtgtttactatgtgaaatctactacaataggaacttcaggggatactaagatgaaaatctattatctttggtgtttataatacagtctagtaattctgttgggttttattcagttccaaatcagtaagattttactctatttatatatgagttggatgcaataattttaaccattgtgaacttttaatgagtaaatgctcttgctccaaaagaagcaaatggttgacaataaagcagaatttttcaaagtgaggtccttttaccattcatcagaatcatctggaagaggttttgtttaaaaaatgaatattcctgggcccactccaatcctactgaaacaggatcctttgggttgacacaagaatctgaatgttaagcagatactcaaggtgattctcaggaacttgaagtttgagaaacactgccaaaatgaataatatgaaataaagcatatgtctgaaaaaaggagatcaaatgaggtcagctaatacaggcccagatagagttgcatttttcagttaaatgtagatacatttagagttaaatgaggagaaataataaaaattttgtctttttatcccttatctcctttgggagaagttgtagtgctgaaaggcacattttcatctgtggaaatcctcatagatgatatatatatatatatattttttttttttttttttgagaggaataaggctgattgagctcctttgtagttttatgcattataaaatcccttttgtagttttatgaaggaaactacatgcttagcaaatgcttcttttatcagcaaatgtcctggcagtaaattgtccatatagcaatttaatgccagaccttctgattcttattctggggaaggtgctgggatatacataaatgtgtgtagtcacatgcatacacacacatgcactcagacatctttagattataagtggtatctgtagggtatcaccacttttcttttaatccagcattgacttacaaccattcaaataaattaacattcccatcttgattcatttggtaagaacacattttcatgccagtatgtgggctcacctctatgacctttccttataaaaaataccaagtgctttgggtttttgtgttaatgagcattgggaagctgtcagcttttatttctgttttttgttcaagtcaacatcattgaccttcacctaatgatctatgtaacatacacacgcaggtaccacagattaaaagtggaaagacagggaagtaaggagagatgcccatagaggaaaggtgtgagagcaggtgatttgtaaatcataatgtcactaaaatgagtaagatcacttgaaaaggaaaaggaaaactgctgtgtgctgtattttcttgctttaggattagcgggatggggtattattttaaaatgagttttcagtttggttttggaaaggtatttaacaccatgacacatgtgctccaggattctgggtacccttttccatggatgataaaaataaaaataatctagggtcttctgatgaacaggtatggatcctatccttttctgtacatatacttccaccaattctgcatcgcctggggtaaccagctgtcctggtttgcctaggagcctctgttttagcgctgaatttttccatgttccaggaaatccataagatggaaatctatagttttgtctgtttacattcttttattattattattattatttgaaaagtaatgaaagcatagatgtctaaaatgtgacaatttcagtttggaggcctgtttcattgacctagaacatgagtgctgggtggatctttaggtttttcatctagcacttcttttccagatgaagcaactggggctcatagaaggtggctaacttattgcctaagtctgtgcagttagctggagacagatccagaacttgaaaccaggttccctgacttctaatccatgcttgtctcaaattgccacatgtgcttgaaggtgtgatagcctctcaaagagttaatttgctttgaaagactgagtaatctcatcccagagagaagttaattcatttagattgtgctccattaattgctccctggtattcctctgcaagagattatgaattaatattgaggagcagtggcagaaacttcttccccatggggaggctgtcttctctcataatcgcaaacactgcatcatccttgaagaggaagaggttaataaacatataattctgtggaagaggtgctgtgatcctgttatttctattaatatttccaattaatatttttttcttgaaataataagccaaaaactgcatttgctgattgccttctgctgtttagaagataagcacatatatgttaaatgttactccctctgaaagacttgcagcactctcttaagtctatattttatttatagaataagctcagtattctgaaccagcttctacatcttccatctgttctgtaatatctctgccatcaaatcagaaaaaaccctaacaacagaatcttgaaattcaacttgaaaaattcaaaagtcaagtcaatattttcattgagagatgacagccctgatgactttcttaaatttgagctattcttccagactgaattacagaattaaaagaccaccttttactcttaagactcatcaacaaagactcatgttactcaattagttgaagagcaaggattgttatggaattttcccaatgtctaattttatttccttcgctaaatgaatcagtagaaaaattttagcgtaatatgtttctattatatttcttcccactttaaaaaaatcctgtaaatcagcaatatttaatattccaggatgattagggcattaaggagaatttttattgaatcagtgctttttactgatgtgtctttggtgttataatctataattggcattaactagtggtaactaattggagctttctccacataaatgtacaatttgagattcctaaagtaggatgctttagagtagttcagtatatactaaggccagctcaccctttgaatgaatcaattttgttgaaaaataatctgacctgccaagagtatgtgattgcataggggacatttgagctggtgactgtaatcttgattgccacctgtctcttctattatcaaggggatcatccaagatgggaagatcatctttatgccgaatggatatataacacagtgtccaaatctaaatcacagtaagtagcaacttaaagcattgtgatatattatataacttgttgattgtatcagagaaacacatctggaaagatagacccaaattgtttacagtgttgacttctgaggtgctggagatagtgaaagagaacttattatctacattatataattctgtgtctttaaaaaaatatgtatcatttattgtattaatccgttttctcactgctgataaagacataccctagactgggtaatttataaaggaaagaggtttaattgactcacagttccacatggatggggaggcctcgcaatcatagtggaaggcaaaacaggagcaaagtcacatcttacatggtggcagccaaagagaatgagagccaagtgaaaggtgaaaccccttataaaaccatcagatcttgtgagacttattcactaccataagaatagtatgggagtaactgccttcatgattcaattatttccaactgggtccctcccacatgtgggaattatgggagctacaattcaagatgagatttgagtggggatgcagccaacccatatcatttattgaactaaaatttgaaaagaagagggttacattagcagattctataggtggatatagaaagatatgtttaatatatatttttaaaaactattccttaagattcttgacctggatgagagtttactttttcttcttctatgatacttcacattttttaagttacctccctataaaaatgagagtttaattttaactttaaaatgtcatgttgcctttctttttagttaacaatgcctttttcctgttcctttctttttgcttattaaagtaggaaaagatccagacctgaaatcctctgtgatttcactcaaatttcaaagcaatgtcaaccaaaaaaaccccaaaaactcttctacatagtcacgtatctactgttttaaaattttatttcttatattagcacaatataaatatatatgttttatattttctttattgagcttgcccaacctgcagtgatttcttaagcctggtgcaaggaataatggatttacaagagcttttggccaagatgactgcaaaagtaggtatctaaatttcatttgtgatgtttcatttctttttctgtcctatctggaatttggagtgatatgttataatggaaacatttttagcctcggcatctgctatatgttactacaaaaatgttttattcttactcaaaataggactaccaatagtaaacataaccattcctgtctttgatgctattaagctgtatcataatgtttacttgaaaaatgcttggaagcaagaggcaatatgtatcactgtagattccatgggagtggaaaaggaattttcctattggctattaaagtagtaacactgtaagatgatctatggtcagagccactgctcttataagctaatgcattttggatgtaagaataattgccagtaatcggaaggggcaaaatagctattgttaggaacagattactgtcaaaagaaggcattatattacatttttaatgtataatttatttcaaggctggtcctgagttaaatagcaaaggaggcaaagtttgcctttcaacaccttcggttttataattccgcaccttttcctcctctccattccatcatccacttaacaagcatcttttgaggacctgccgtttgctgggcactgtgttaggcacaaagaggcaatagtgaaaaagacacgctttctaccctagatatgttcatactgagtggcggagccaaatgtgtaaacaactaagggctttaatatatattcataaagtgtatattcataatgaaaagccctgagccttgttgaaaaagacactgaaaatatagaaaatatggctaatgctgttgttatgataccaatcagttgtggacatgagttccagcctagggcgaagaaagaattaggttgggcctaagagacattatactctgcaaaagaagaattttaataacaatgaaaatgatacattaatcctattgtacctgcagctaagactgctccctaccatcagccatggcatgtgcaaaaaaattggtgggtagataagtgtttgcaagataaggctatagtttggacccatggattgtgctgctgaagacaatgtttctatttcaaactgggtttttggctaaggcaaacccctttttgtctggaaaggagagatggaaaacttttgtaagaaaacaattgagactgaggcccagatctgaagcattagcttttcgcttcagagtatagtgggaatgtgaaacgcaggtgattatttaccttcccagcttgtgttatagagaggcttttatttcatattgtctggagcagcttgatctcaatactgttaattatattttagcatgctaccaaagttttggaacaagaaacatgccactctgtctcaggtgattgtggttcttcattctccagcttcgagggcgtcgtttgctttctcattctttcccattgcagagaatgtcatttttctctttttagccacacatcatctaggagccacagagagctctattctcaaaacgttattgtgtaaaatgggcctttgtgaggtaggtatttaattgtgggcagttgcaaacagcaaattttttaatccatcttctaaacctccctttggcactttggcagatttttaggtctgttccttccaaacagtatatagaattacaatttgaaaactgagtacttccatctttgctgtgtaatttgaaatctatgatcatctagaataagcattggcaaactttttctgtaaaggaccagctagtaaattttgggccttgcaagccaagaggcaaaatcaaggatattatgtgtagacttagttcatttaagtataataatttaaattataactattgaaaactataagaaccattcttagcttataggacatacaaaagtaagtagagggccagatttggtccactggccttagtttgtcaaccattgatctaaaagaaatggaaaagtcagtaatacaagcatttactatgtattagttaaaatgcttaagcttttatatcccctgtcactttaatctttaccacaatcctttgagcttgctttaattcattagtctgctttacagatgagatgactgaggtccaggaaggtctgataacttttcctaagagagtagatggcagagctgggacctaaactcaggtagttagatcctgaaagttgaatcatggctgagaaagttcatggtttgacaagaaagggttaagaagagagataaaagctataaatagggagtaatattactctttctaaccctcaccatccactggcaggaggatggagatattaccaagaaagagcaaataaaaaagaaaggaaaagagaaatgaatgtttgatcattttattgagctgaactaaagttttcagatcatacctgtttggaatgaaatgtgtgaacatagaacttgtagtaacttttcaaagaagaaggttatggcaagagcaaggtctcttttttattgtgtgtgttttttttttttttttaagaacagtgtctcttaatgcacgcttttggctatgagctgcttgttttccttggaaatagtgaaaattatttgacattatttacttaagtattttcaaaccagattgctcagaatcagactgctacacctaggaaaggccaggtgaagtctcaggaaaggattctttaaggattttcaaggaagatttttttttccttctagctggtgccaaggtctgaacatgaaagttttctttctgtgccttgagcaagcctccttctttttgttcactctaacactgagggtatctcatgttaggccaaatctttatataggggtttgctttaaggtacccatcttgggaagatacttttccccaactctgtccccctataccctgtgcaaccatcagggtggaagctcaggggctctacattgcatcaaaaatcttcaggatgttgttgtctttggtgctcacttatttcctgggatccctgcagtcactttgttttggcctctgtgactttgtttcttccttttgtattagctctgtgacaattttcaaaagtttttatttatatattgaatacagcagtttagttggttcagttggtgaagtccttcagggtatgtagtctgccgtcttggtggaggcgaaaatgtaactcacttttttggcaggtggaaggagatggagtctggaaatgtcaggcaaacttgaagttgaatatggttcgcagatgcaaaaagaattctatggcactaaatttatctgggcccagtctttatttttaattaaataggccgattgtggcagaattcagttaatagggctggaggtaatttttggagttttgatttgagttgtccagcagttccgattaagatgggtagacagtcatataggtcatagtggagatagagaatgggctttaaagtcaggctgatatgattctgagtcactattttataatttccttggatatttatagctttgagtaagttattcgacttgtttcagcatctgtttccccatatgtaaaatggtgacaattattcctgctcttgtaaagattccgtgagcccaggcaaatgaggtttgttgcacggcacacaaatgtcattcaataggtggtggctgctgctgtttatactcttaaacctagaaaatatagacaaccatggtgggatgatggttccttagagaaaatggtccttaagaaaatgcacatcttccccagtgacttgaaatcacaaagtctggtagagcctgtgcattgctgtcaagaccctagtctaggagtcctggaaaacagcaggaagtccttcctcttgggtcgaggtggaaaccctggagcccttccagagaagaagctccgtgtataagctagagaggaattggtagtcaaagtcagaaccaaacagatgtagataccagatcagcccaggggtctgtgtaggagagctcattgatccttttctccttttagggttaggcatgctggcaagtgactgtgcccttgcttgatcatgggagcagcctgcactcacattcaggtgacagaggtcagggtagataagagctctcttgaggaattctggcattttggcaaaactatactttttttaaggcagagaagagatggggctgctacctcaagtaataaaccttttttgtcctcctacatttcccttagtgatctacaagcatcagccactcccctggcttactctcaaggttctctcaggtggttttgacattgtgggaactacctacctgctgggaacattgtgatagggtcagactctgtcctgctatcagatcccaactgcactgtaatcccattctgacttcaatctcagaaagaagagatactgaagactgggactttcttgattacttctgtttaaatatttgacaaatctatgtatgcaaatcaagcgacacttggagtggcatttaagcttgtgacatctttaattttgagactttcattgttttgaggaattcaataatgattttttgattaagcttaaatgtttaacaatagaagcttcttttttcctttcatatagcaaatgccaagtaaatggtatttcaaagaaaagaagcaatccaccacacaactaatgtacttagatctgttcattgacctctgatgataaaaaaggcctctgctgtctatctttcattatgtagagttcagaataaatgatttggtccatggttgcttagataaatgcataaacaagaggtagacagaatagagatgtagatgtgataccgtatctatttcgaatctgcagacaatcttagagaaagtgtcaggtagtatagaaatagcttttgaaaatgaatgtgtataaattcagcatgctaataccagtgacagaaaatgcaattcattttttgattcacagttgtttgtctcctttattgccgttttaggatttagcaggagtaaaagggaaggcaagaggttacatgaagttctttgaaaaattagctttttgccttaacatccctttgcctttgtgtctatttggtgtgctcttattattacagacaataggacttctcaatgttgtcagaaaaggctacaaatattaaaaataaaaaccacattcagaagggaaacaaaatcagccttgagaatagcattcattatattaaaactgacattttctttggaattgagttttgtaggtgagcacagctcagctttgtgggacagtgctagaaattgccactatttcccttaggcaagctcctggattttaagaaagctcagatagatatagagttgccttttgggccatttagtccttaagaagttcccttcttggagtgatatagacaccagaattgttccagattttcagagtaaggcacgtatgggtcctctcacaaaggtacacaattctgagacccttttaggaggaatgcagatctggttcaactctgttgttcaatccaaggtcatatatctgttactgccttgtgtaggaactactggggctatggaaatgaagtaaagataagtgataagttgttactttctttctattgaggttccacatctgtggattcaaccaaccatggaccaacaatactcagaaaaaaattccaaaaagttacagagagtaaaacttgaattttccatgtaccgagtactgcattgaatccatgtgaatgaattgatgtttagacattgtattacttattataagttatctagagatgacttaaagtgtataggaggatgtgcatacgttatatgcaaactatactattttatataaaggacttgaagattttcagattttggtatctgcaagtggccaaaccatatgccatcatccctcagtgtccaagagtatcaccaaactcagcagtgtattttatccgtttcctaaagcattgccaaataacttaattatcatagattctataaactctatgattaggctggagttttgttgtattaatttatttatttattgagatggagtatcgctctgttgcccaggctggagtgcactggcatgatcttggcctgctgcaacctctgcctcccaggttcaagagattctcatgtctcagcctccagagtagctggtggtacccgctaccacacccggctttttttttttttttttttgtatttgtagtggagacagggtttcgccatgttggctgggttggtctcaaactcctgaccttgggtcatctgctcgtcttggcctcccaaagtgctgggattataggtgtgagtcactgcacttgacctaggctggagttttaaatgaaacatggatttttagaagatcatgcatattagaaggagtgataggaagctaatatttcaggcagcgtcaactcttagttctttaggggctgctcatggtgcatggtggttggtctaagatcctattttttgttttttctaccctttgctaccacccacaaaaggcagacaaggggtaaattttcttgagaaattccaaaagcttggaggaagaggatgaaataaatgacaaaaacaaaggttagaattacatgtggattccatttccagagagtagttctggtatgagtaagtcagaggaaggtgtatgaaatggaaccatagttaatgtagaaagatggtggaagtcattccctaggtttatctattatgtctaaaatagtggctcaaaataatcttagttagatcaaaggttgaattgatctcctgtatggggaaagtacttaagacatgaaaggataaacatgattgagaaggaaaagagaaactcagataattttctaggaaacgatacttgtttttcaatcatggtggtctctatgtaagggaaaggaaaggaagagtaatatcactactaggttgagttactctttcgtgtggatgtgacagtagacagatcatatcaaagtgctgtatttagggtttttttgcaccatatttttgaaggtaaactggagtaggctgtatgaaaagtgatcagaagagaggcttggaatcatatcatgaggagctgttaagggaacctggtggtgccaagtgtggtcaagacgacaggataacctcaaatgcttgaagattaggtttgctcaggatggattacaatgaaaacctaggtatggcaggaaaaaaagaaagatttcacagccaaaaccatgaaaaatgtttcaaacaagagagctaactgagaaaagtggctttccttggaagataatacatgttcctccactggagatgtacaaaggctagataatcacttgaggtttcttgtgaggatattcaagctttataatccctttccagcaggagagtctaagactctgtgattattggcaatgactgggtggcctagaaaaataaaaaaggttattttacaaaattctgatcttacctggggttttggttacttttcctgtccttcttctaagcacaaaagtgaattcctggggcattctgtttgggggatccgcttacgacttttctttttttctgaccccagctctccagaatttttcatcagacagaaggcagtgacttcctagtttgtaaaccacgacattctagttagtgtgtgaagaacatagagaggatagtgggagataaatgtaagtgcctcggagttcctgattagatcgcctgtaaacatcataatgagtccttgagaacacattcattatgagtgtttttgtgtgggcttgaatggaaagcacacacatttatgaacacccatgaggttcctgagttacagtttaatgtctcatttggtattcattagaccatgacagccaatatttcttcaatttagagtgattccaccttgtgtaaaaaaaataaaaaaaacaaaaaacagataatgctaagaatcagtgaactgctctgagcatttttttctcttctcagaaggattttttttcttgttgctattagctttgttaggatgatgcaattgaattacagaaattacattcagtaactcttgtttgcagctaaattatgcagagacaagacttagtcaattggaaaactgtcattgtgagaagacttgtcaagtgagtggactgctctatcgagatcaagactcttgggtagatggtgaccattgcaggaactgcacttgcaaagtaagcctctttgtaaataaatacagtaaaaacagttttaaggggagaggtttgataattagagtgtaacctggttctttaataaataatattaactctgagaattgttaggtttttacctagcacccactagccatacgagcaattgtgaagcaatgctggaagagtgtcatgtcttatatgaatacttggaaattaaaatctgctttcccttgccaacacaccctaatttgatttaataggcaatgtttggagtttgaaggttgggatatagtggaaagaagggactcctttgattttcaaacaacctaatggttatccttattcacaaccagaataactttaaaaggggagtttaattattttctacatgtttttattgtcttttgcaaagtgtatccatcacctgtttcaaataattgcaaggcatttcctccctgactcactgtcagtgtgaggatatccattatttgtatatcccttcatctgtttcagtgaattacaacatccccctccaaaaattagtatggaaaccctgtccagttgaaattacttgataaatatctgaagaatgccattgtttgtctaggaaaatacaaaacagattgttagagcctcagaaatgattgacagagtctgcaaatgtgttatttatgttcttataaaaatagactttttgttttctgcataatctagttagcacacatgggcaggtaggatgaaaccagtgatgtatttcagaaaagtaattgaggtggtacaggtcattcgggccggagaaaacacttcatctgtggtcctggagtggactgggaattcgaatactgcttctgtttccctgatgaggtttctgggatgagatttcaatgatctccacaacaggagctatcaaaggatacttctgagattatgttccatgtccttccttcctcagagtggtgccgtggaatgccgaaggatgtcctgtccccctctcaattgctccccagactccctcccagtgcacattgctggccagtgctgtaaggtctgccgacgtaagtactgactgagggtcagactggctgtctgtgttttgagatttatttatttattttccctgtttttctggactcaactgattgacattgatgaaatgaaacattggcagttgatgtaacattaaatatatggtaagaagagccacaatattttaatcacttgcaatgtggcagacacttaacatgggctatttttttttttaaatcctcacatcacctgtaattactattcttctttcattctatgtggaaggaacgtgtgttcacagggattaagtcacttgtccaacaagtgggtgaggctgatctgtgaatttacaactccaaagctccataggctttagtcccctcattctaaatgatcaagttaaaggccaaattctgtattttggctttctgaggttttggctagattctcctcttattaagaggcctttgttaggaacttccggatgaaattcagttaaaatactgaagctgtcgtttagaacatgtggtatgttccatatactgtgctggatgctttaaatctactagcttagtgaattctcacagcaactctttagggaggtattattattatccctattttacaggaagctgaggcttagggatattagcttacgaaaatcatgaggctggtgagtggcagaggtgagacagaaaactagttctgttgactacaaagcccatagcctttttatcagtccatatggtcctctacagaaaaggagagttctggtcagaaatgtgtgctatggataattttcaaggtcatttatttaccaaaagaaacacaccaatgtcagtagccttcaaagcacagtggtctatcattctgccaggaacagcatgtcacctattatgacactgaaagtgggaatagcagtgaaagtgggttgcagcagcccaaataattgttgaacttttcaaaaaggaactttgtaatcttccttttttttttttttatggttggcacactgcacccattgctctgggggatgtacttggagttgctctaaagagaagaactttcttatttctgtttcaagaacttttggaagtcatgtctggcaatataggcagctcaagtgtctggatattgaattatagtttgatcccatgatggagagagttgttagtaggtacagattatttgtttttattcttgacattcttcagcagaagaagttgaaaaactattaggggccaagcacagtggctcacgcttctaatcccagcactttgggaggccgaggccgtcggatcacctgaggtcaggagtttgagaccagcctggccaacatggcgaaatcccgtctctactaaaaatacaaaaattagctgggtgtggtggtgggcacctgtaattccagctattctggaggctgaggcaggagaattgcttgaacccgggaggcagaggttgcagtgagctgagatcgcgccactgcactccagcctgggcaacagagtgagtctgtctcaaaaaaaaaaaagaaaaaaaaaaaaaggctattagggatgtattaaaaaatgtgagatgttttagtctattatttagagttcctgcatagatctctgaatgccatctcttgaaagttgttgtttggacatggaagtaatgagtccttcggcaggtttgtgtcttaactttttgacgtttttttaaaattataaaagcactgtgcttttggcttaacattttgaaaacacagagaatcataaagatcaagatggaaagttcacccataatagctccacttagaaacactcttgaaattttagtggatgtgtcctttttttaagaaaaattacattttgtgtgcagttgaggttgtattgtgtgggcaattttttattctagtctgttaacttgccattgtcacttaaatatattattatgttttaaaaacttctgcataaatgtcattttcatgagcttcattgtttcccattgtttggctgttgcataacttttttttaaccagtcccaagtcattgatatctagattgtttcccacttttcactattataaagcacgcttaaataacatgttttgtatagaaaacacatttttgtatatttttgtattttatatttcctgaaaatagaattcttcaggccagaattactgggccaaagatgaacattttcaaggccctggatacatacagttaaattgccctctcactagacgtgtgtgggacggtcatttttctttgtgctaatttgtttgatagttttaggtttttaaaattatttcagaaaataactcaattttattaaaatgttgatacacacactaactaaaacatcagttttttttttttttttccctttgcatggaattcatagcaatttagttaggtagcactaattttctcacagctctgattggtagtttgatgtgttcagagtttaataaagtgggaatacaaataaattattaaaacactattctagacaaacttaaaaagaaatgatacaaggcacctctggtaattaaaaggttgagaacttctgggctggagggctttcatttctcactagtttttaatagaaatatgcattaggtgattactgagtactgatgcctggaataatgatgagggatccttccctgctttagaggagctcactttcaaggtagagacgtggtttacagtgtctggaactgtaagtgcactaacattaggcatgtgttggagtacagaagaatggcctgggagggagggggagaataccgggggaaggcctgggatgcttcccggaggacatggagccaagttaaatattttgaaccttctagaagttgacttttgtgggttaagcagtggggtggagaagaagagaatgaggattgctagagcagagttctaacactaatcagtggaatttctagatgtttccaatgtcttcacatcagaaacatggtagagtatatttactttggttgtcccttttaaatataagtatgtgaggtaatgcatatgttagttagttcttagccataccacagtgcctacgtatttcaaaatatcatgctgtagaccgtaaatatgcataccttttgtcagttaaaaaataataataaaatataaaaaaagacaaagaaaaaattgtatcttgtatgaataacttatagtcaaatcttgttttttaatccagtctgacagtctggattgtattgtttggattggatcatttaatccattcacatttaatgttgtgagggatataagtgaaactactgtttcctgaataccatgtttttccttggtttggttccttattttgattttttttcattttttttgtggagctgcctgaagtaaatttcttatatgtgaatttaaagaaaaattcccaagcttctctctgactttaggtggggtagtattctagggacaccaggtaaaggtagggctatgacaaaggcaaaatgagccaatatgtaaaagcagattgtgttgtctgctcactcactgagtgttcacggacttctcttggccttgggaactgcagcacttacagatgagggcgtctgtttggaaatagggaagaaatttatctaagcatccatggcggtaccgaaaatagtgagggagtttcattcctcaaacacttgttgggtgtctgcactattcaaggcatatttaatatacctatttgcacattaaaatcctttggtgaacttcttaaacttggaggtttccagggctccacctagacctacataatcacaatctccaggcatcaacatcctgaaatctgtattattttggtagacagatttgagatctaccagagataggaaggagggaggaagatggagaaaaaaatatttcttctatgcaaaacagtatgtgtgaaggaataagagtgaaagagggaaaggggaatagtgtgtttgatgataacacaggatttatgtaggtgagaggttgaaatagagctgcaaacgtgagttgcggatggatgatgaagattgtatcccaatgaagccattcagtaatccctaccgaggtccttctgccaaacactttgtcagttctgggggcaacagtggacacgtatggatcatttactctgacaggcactgtgtttaaccattttatatgtattcatttaattcttccaacaactttaagtggtagggtccgctattatccccattttacacatgaggaggtgaaacagagaggagaagtaacttgtccaaggtctcccagttttgggggagccaaaataaagccctggcagtctggcttcagaacccagtgggatgctcttgacctgttggctctaaccattgttctccagagagatctctgttacaataaagaatattatttcacatgaacactatggaagacacagaagtcacacagagaagggagtgattaactccatctgaaatgtacatatgtatgtgtgtgttaggaaaacgtcataggtaacagctgagcggggtattgacaaatgaagaggagttttccaagtgtacaaagtaggtaagaacataactgccagagggaattgcatacacaaaatcatggaaataaaccagtgttggttttggtactgcaatcaaggttttaatgcagagttgtggcataatcaaagatgtgcttttagaaaggctactgcatcaagagagctggaggtggtgggggatatgggacttgggcatattccaggtggaggtgttgaggctggcaggcaggcacagcctgggaagatgcaaaggaagggaaggatgtgggtgacagccaaaggagctggcacattagagatactccacaggtattgttttgcatgagacaaatggatcagggacagagcgtctgtaagggagaaattgccaggttttgaacaagagcctgtgggagactcacggtgtgattaacagaaataagacaggtggagaaagcagtatggggagcaatacattccgtttgacatgtttgagttagagatgcctgaggtacaactagtttgatgtgggtgtcttgctcatagaggtggtatctgaagccaaggctgtgaattagctcactgagggaggaaggatctttgggtgttcagtctctctgatctgccactctcctttaaagtgtaaaacagtgtgctgattttgacattctaggccgctgagtaccaagggatggctggagtgtgtgcagggtacaaatacctaaataaagatagggaaaccttgtatccacatctgacagggatgtcaagctgtacttgtcaattgtttattcagtgtgcacccaaatggcaaaattgtccaatcattgcaccagaaaaatcaaggtcaaaattgaagggccaggtgtctgtcggtgcaaaaagatacagctgcataactctttatatcctcagtacattttgtttctgacataatggagaagtgtgtgttggtgctaggtttcaattttgtgtttgggcactgtgaaatattctagtttgcatgtcaccagtgtgatatgaagagctttaggtatccatttacatttctaatcaccctgaaagatgttcgaatggagtcccaaatgccccagccaaacgcaccagagcctgactcaccttatgcttgaatttcctcagacataaaaaataagccttttggctatagatcaagaggttggataataagggctgatattaggcataggaatgcagtggcagggaaggagggctgttgtcagagaagtgaggatgagtatgagaaagcaggagaaattcttgtgacctccagtggtgatcctgaaagtcatcctaagataatttcatagatacatacattctgcactagtgccaaattgcagatggttgaggcgtgcagtaatatgttgatctcattcaccagcaccaaagcaccctgctatgtgagtacataaagttcagtggacatttaatttttataagagactggtggattcgaggggtggatgtgtctccatgtgtggtgtgaatgtaaacaatgaggcatttttatctccagattaggagttttgggatgagcctgtcaaaggggaagagaggatttggacaagtgccttaaggcaggtgatcaaatgtgttaataccattgtgggagtggcaaggggcaaaggaagaaaaaatgtctatttcttcgcttcacagcttgggccaagaagcagatggcagatttgacaacagtgcacttagcagaactgtcactttggaacaagctgccttgccaagttggcagcaggcacatttgggagtgtgggaatttattagacaggaattccagaccttggaggtgtggtctctccatgcaagtacactgggaaatctagctctcattaggaccaacgagtcatggtcaactgatttatctacaaaattgaggcataaaagatgatcagggatagatttttgtttactgaagggaggaaaggacctatccagacaattatattaattctccatttttttggtctctacttctaatgtttgaagttgtattgaatgccagaaataactcttatctgtggatcaagaaatttgactgttttttgccacctactagaggctcattaattggaaaattattattactctcaataaatcctaaggcatggggctttgggctggagataaaattatagacattttccctaccctcatgggggttgcaattagcagcagggacatggtggggtgtacaattaaatgggaaattaggatgtcatgtgatatatattctgttgggattaggttcaaagtacaatagaataaaaaagtgaggacgattaaccagtgttaaagggtaagaacaagttctgagggaagtcagccctaagcggaagctcatgggtgtatagggtgggaggctgccagtggaaggtggatggggtgctctgcacgtgtttctgagaaagagaacggtatatgtaaggcccggaagtgagagataaagcatggctagaacatatgtggaggtgtggatgttttgtagggtgaatgaaatcacgggaaatggtgggctgtgaaccttgggagataagaagcctcatgaatggccttgtttgctgaactaaggattttggactttattctgagagctttagggaccctgatttcaagcagggcctcatgtttgcacttaaaaaatatgtgtctgactgttttatggggaaggactggtgaagattgagactagaacatgagagagctaggaagttgtggtggtactgaagaagagggatgacgacagcctgaacaaagacagtgtctgggggcagagggtgaggaatggagaggaggaggttgacttgagaaacttaagaaggggacattgataggatttggacactgattggacatggagttgtgtaagagggagaggttagaaggttgccaggcactagggtgtgggagctgggatggatacccatgccattgccattcactgagaggagaatacaggagtggaacatatttgggtggggagtgaggttgctgcaggtcaggttctgaggggaaacagactttgacatagagatttacatgtactttattaggaagtgctctcaggatcaattctgggataggaatgaggtggtgaaggaagaagaattgggcagaaggagaagttaagctgcagtggttacagcaaatgccgaactcattcctacagggagctttggagctggaatggcccttcggagttgtcctcagttggagaaagggggccaggactgtgtaccatgttcacccatcaagagaacttcaccttgggcaaggtggctctctacagccctatacaagtcttagatctccattcaggggagagccgttagttgccaactgtcacagcagttgtaagaatgtatcctttgctcatggaagtggatctccatgtaccacagcatccactacagggtatgacgttaacttaggcatgtccctggactttcttcttcctgtggctaaaatggactagatgactactgtttgttttattggaagggaggaatgaaagccccatttctcacctggtcatcctctttgcctttcagatcttgcccctcaacatcgaagggggtctaggttctttatctgcaaacacagcacttgcctcacttagtaattatacattcactgatgttattatgtaattactgtctatttccctgattgtaagctccatgagaagaaagctttggttcttgcaacactatattaccagttagcatgttgcctgccctttagtaacactagaatattatttgaatgaagaataactgagcatcccgtgagaatcagagggttttataactagtaaaccaccagatttaatcagcccatttttagcagatacagatatagaggctctgaaaggtgaggtggttctataagaccaacaccgaattagtgggtgagatctcttagagtgcgtattattgcttctgttcctcctagagctggggctagaagggtcctcatcagggcaggagagggagtgaccagatacttgcttctttttttcctgttgaagtggatggagaatttggtggtgttatattaggatcatatcaaattgacatatgctgtacttgcttaaaagtgagtcagccagttaagtcaagaaatgagtttcagtgcaatctaaattgagtggtaggagctccgtttatgtttctctttgaaattttctacaagttcacccccgctgcccttcctggcagccttttgaactcacctttccaaaggcattctctctagtgcattgatctagcactttacaggctttccttgtatttctcacttgtctcacatgtgtatttctcacgcccactcccatgatcacaaggaagaagaaatggtgtccttctccattgtggctgaggttctgaggaatggaatatatgtgagtcccctttcacccagttcattttagctggagtgtctgaatcaaagctactgctaactgtactccacagcgattgccaccagttctttcttgttttagcttcttactacatcagttcattctctagttcctttggcaactgtaacattgaaataattgtatatcctggctgtaaaggccaggcaaacacaatcatgatgaggtctgcctgggagatttaagggttatcctccacacaattcctttcactttagacaaagagatttgtattgctcagaagcagagaatctaggtttctgtggaatctattggagttagaaggtacctctgaggtcattttgtggcacagcaggactgtctgacccatttttatgttttattacagcaaaatgtatctatggaggaaaagttcttgcagaaggccagcggattttaaccaagagctgtcgggaatgccgagtaagtgttaattttatggtccctatcacttctggaaaatgaatagatagatgtgtgggctttagatgaggttcttgagtggggcatattggcctggatagggccccgaggggtggaactctctgcggtgggttggattacatgatggcgaggatccagccaggccatttatgtggttagcttgtggtcagctgtggatcaggtagccttggaagaagctattaaggcaaggatgtgagaggagaaagaactaacagctgttattagttagggaggctggtgggtggccctgcgaaagggttttgagttggtattaggggaatcagtctgtaatgctagttatgataatactaactctactcccagagggctgatatactgttaaaaatgcctcttcctcctgcctgcccctcccatgcattacttgaaataagatgtataagatcatagatctcattcaataatcattcgacaaaaatgcattaagcaaatgctgtatgacagcattatagtaggttctggatatacaacagtgaacaaaacaaagtcactgtctttatagaacttgcagtctagtgagggagagagacagtaagaattaaacaaacgtataatataatgccaaattctataaaagtatgaagtaggctgaaggaatagagaggtctgagttggggatgggtggactgagaagatctctctgagatgtaattttgttccaaaattacattttgggtaaggtgtgggagccagccatgcaggtatttgggtgagtgattacttaaccaataattgcttcctaggtagatgagggagaaggcacgttccaaacagaaggaattgcacttataaatgcctaaagcaataaagggagcaggttttacttagggacctgcaaataatttgacttgggtgaagttctagagctcatgtgggagagtgatgagagatgaacctggacagttagacagaacaggtgacaatggacctagtttggacttgatcttaatggagatgagaattcattgaagctctctcttctctctctgtctctctctctctctctctctctctctctctctgtgtgtgtgtgtgtgtgtgtgtgcatgcacgtgtgtatgtcacgagcagctgtgcatttccaaaggtcactgtgattgcaatgggaggagtgattggaggagcaccagattaatttgaataattgtaagaaatgacctaaggttatgattgaaggcagtgatagtgaagatgtacaggaaaagagattcaagagctatttaaaaaatggaattgaaaggactcgagtgattgggtttggggaaggctaatatgatggagaggagaaacccagatgatgtccaggttcctggtagagttgcagggaataccagtttctgttttcccaagtagccaaaacctcccctggctaacgtaggtaaaaatgacaatgttattgaaatgatattgggggactcacagaatcctcagaaggccagaccaggcttgatactagatagagaccaaagagtcccagaagttaggaagcagaaaccatagcaatgacctagtagcggggatcccggcaagcacattgctgctgtgatgagtgactttcaatcatttctactgtcctggagtcacttatacaagatttaaagtttggagaaaggacatatgattagcaaagtttggatcatatgtccaagctctgattgttcaggatggggaagaattcgacccctttatcctctgtgtaaggagccagttacctggaattatcaccccattaagacagcatgcaatggagaaaaaattccccaagagaacactgtggtactcatgggaagggagactggatcagaagaagccaaaatgtgataaatgctctcttcattaggtgatgacgagatactggtgcaggaagaggaacattcaggaggaggaacatgttttgtgggtgaggagggagtgaagagcaaatggggccaggtttaggcatgttgagtttgattgtactttggctatctacacaaactctctaaaacttagtattttaggattatttctgtattttatgattatttctcatggttgcatgggttgaatgggctcagcttaatgattctcacttgggttcgcacatgcaattgcaatctggtggctgctgcagctagaatcctatgaaggcttgacatggctggctatcaaagatggcttctttacttttctgtctagcacctcaacaaagatgaatagaaagagacttctctctgtgtctctgtctggtgtgctcgctctctctctccctcccttcctccctccctccgtccctctctctctctctctgtatgtgtgtgagtgtgccttgttctctgcaacccctagacatggctaccttgggcttctttttttttttagaccgggtctcgctctgtctcccaggctggagtgcagtagcacaatctcggctcactgcaacctctgcctcccaggttcaagcaattcttctgccttagcctcctgagtagctggaattaagagctgcgccaccacacccagctaatttttgtatttttagtagagacgggttgttggccaggctggtcttgaactcctaatctcatgatccacctgcctcggcctcccaaagtggtgggattacaggtgtgagccactgcacctggccccttgggcttctttgtaccatggtggtctcagggatttctcacatgctggccagcttctcccagaataagctttccaaagaccaaggtgaaagcgccagtatttcttataaactggtctccgaaacgggaacatcattctgcattctaaaggctatagaggcccaggccagatttattgtagaggcagacaatacaagggcatgaataccaggaggcatgattcattaggtagacaggcatctttggagaccagctgtcataataagactttgtgatataattttctacttaaaaatacccacctccagccaggcgtggtggcttatgcctgtaatcccagcacttttgagaggctgaggtgggcagatcatctgaggtcaggagttcaagaccagtctggacaacatggtgaaactctgtctctcccaaaaatacaaaaattagctgggcatgatggtgcatgcctgtaatcccagctactcgggaggcagaggcaggagaattgcttgaacccgggaggcggaggttgcagtgagctgagattgtgccactgcactacagcctgggcgacagagtgagacgccatctcaaaaaaaagtaaaacaaaacaaaacaaaacccacctccaacatatcataatgggaagttactaaactaataggttagtggatttccatggctggaaaacattaggaatcagagaattcctttaattgggtgaaaatctacccccctgtaacttctgtccagtggctttacttcttccctctggaggataagagggtgagtctaattactcttacaatatagcattgtggttgaaaggtcaaaatctgcagtcaggtggatctgggtttaaatcctgaaattttacctagctgttagtgaagttcagagttccttgcgttcttttcccccattgggttccagtaagagctgggttggagaacataacttgagattattacttcctcctacatgatatttttttttctcctcaccattcccactgcaacataacggaagacaattataggcataatcaccagccctggaggaatgtggaacattttgcctagtgccttgtgccgaactgtcaaacctattccttttctgcctaacattagctgggacacactagtcagaatagcaacacttcttacctatctgatcctgatttctagaaaatagaacgcgaggcctaggtatttgtgttgatgctttatttatttattctttggtggtcatgggcgtggatagaggaaggggaagggtatagtcctaggaatgcaagagtgaggcacagacagaaggaagtatggaaggaaaggcaggagagcaagtacaagatggtgcatcacagaaaagtcagaaccccacaacaaagcacagctggctttgtgaggcatctcctgagaaggtgacagaaatcactgtgtctcagaaaagaccatcctcgcaagtgctcttacttacattgtttcattttcttttcaacacacctcttggaaaaaagacaggaatgtgttttaaagattgaaaagaatgaggcatttagagactttgcagaagcactcaaggagatactaatacaagaagagcttgaattttgttctttatggagagctgggaaggaaagacattccctatattctgtctctcattggccagactgtaccctaaaggttagcttccttgaacctccctattttgattcccattcttgccctcttggctgctgctgggaatgccagagattccatgagtccaggtggtctggtgggcatgcaggtgtggtggtctctctgcatcagtgggtactgggtgtaggggctctccactctgtggcaggggcaaggatggtgtgacaacaagggctttaatgatctcttgactgacaaggaggctcccagggttgggagtaggggagtaggggagtaggggagcaggtggggtggtcaataacctatagctggcacattatcacacaaggatgttgtgtagattaaatgagataaaacacatggagaacttagtagagtgcttaccacaaagaccatcctcaataaatgtgagctatttttgttattccatatgaccatacatgtccttcttgaatttaagacagataccattctctctgaacattgttttacttctaggaagggaaaacagttggattctaaaattgttgcttttgtctttgacttcagggaaagctgggatgattaaaggcaattttgctcactgtggtgatggtcccagaatcagccataacacttaaaattagcaaatccttttccattttgaatggaagctgtgggtgactctagcaagggtcactattatgattcaatgtctattatcaaagaggagccaggcagacaccatttgagacctttagaagatatgggcatggatttgaatgccagcttatttaaatatcacttactactattactggcacattgcagttgctctacacacttgggttcatcttttactgttttttttttttttaataatttagaaagaagttggggcagacagattattctcttgcacaggtagtgtgtgtgtgcatgtgtgagtgcatgtgaataattttattctgtgcaaaaaagttatttttccatttattgtctttctatagttatttactaattactttgtatacaagaaagagttattgacaataatttttaatatttcttgagcacttattatcttccaggcacaatttaaagcatctaaaacatatttatctcggccgggcatgcgggtcagcactttgggaggctgaggtgggtggatcacgaggtcaggagattgagaccatcttggccaacatggtaaaaccctgtctctactaaaatacaaaaaattagccgggcatggtggcacatgcctgtaatcccagctacttgggaggctgaggcaggggaatcgcttgaacccaggaggcggaggtggcagtgagctgagattgcgccactgcactccagcctagtgacagtacaagaccccatttcaaaaaaaaaacccaacaaaacaaaaaaccatatttatctcactgaaacctcataataattctgtgcagaaggtaatacccagatgtgaaaatcgaggcacagaagaacaaggccacataggtagtgagtgagccagctgggatcagaacctgtgtggtttggccccacagtctcctctcttagcctgtctactgccactcctgttattgttagactgacttggaaataattctcaattctgaattttagaggggtagattgagaaggattgtttgatcatttttcagtctatctgagaatatcagattggtcaggctatggcccattgattcccttgataaaggtagcatttataaaaggccatggaagagctttgggacatagttaatggatattgtcagcagagagtgagggtaatgggtataggatcaaagggcctcttatttctcccaggcagcttttctcaagatgtaagcactaatgccctatggaatctgttgtatgcaataaattaaacttcctcttaggcatctaaaatggtattatgaagtattatccttgggaggactaaggaaataattgctaaaataatttttgatattctgtcattcagttgacaaaaggatgcctggagatccacccattttcattttcctgggatcattttaaagcttcagcaacaccaattagtcaaaaaacaaactcttgtttcaaatattttcaccaagtgtttccaggaattaacataatttttaaaaaaaaatcaacatgaataaactctcctagcagtcttattaattttgcccaattattgcttttctgcagaatttctttatcctagcaacaattttttacttgaagttgtaagttttatatgttgttagaaattcaggttagtgcacaatggttagtacagaacttgaaagtgtatgtatttgaccaatgacatggagaaagccactctaaatgagaaagaaaaaaggaattgtatttttccaccagcgcagaactccaggggtcataaaataacatactataatcagaaagacttaaaatgttaattatcaggtacttcttactagagataggtttgaaaataaagctataaaaggtttgtgcctaattatgtagctggattaaatggatttggtggcacttatgcaatggtaatcacagttcatattatttttcaaattcatgcaaaaaggtttgtctccatttaaatatttgggattatgatcttactcattaaatatgttaaaggttgattagaactggtgactgatttaatcagcgaagcaaaccctttttataaaaatagaagatttgtgaatgattatttttaaaaaatcttctgtagcatttttaatattttgtttttacaaaaatatatacttatacaatttggaatatagaggggaaaatgtaaggaagaaaatgggaatcactcccgaatctcaccacctagagataatcttttaacagtttgatttttgacagcaagagtgaaatttattttaattgtcttagtttgggttctcccagaagcgaaccctgagctaaggatttcagtacaagtgatttattaaggtagtgcccccaggagaaaccagtgagggtgtgggggatgccagatggagaaggggaagaaactgagaagaggtacaattttagatgaaaggtcaaacataccgtaatcccaccatgggctctggagcatacattttaccctagagattgtctctcttcgaggtaaagaatatcccataccattcattcactggctttgggtcatacgcatgggagttgtagaacttgcatgtaacttccggctctctgcatgggcaaaatggctccattgcccaagggcagtgctctgagagtgacagaggtgagccagttgcagcaaagcattgataaacctagaggtgcgcacatagagctgacaaaaggattcaacagtgtcagccactcttatttatgccaggaggcagcagatcatgaataaatatattaatattgaaggatagacttagaggcaataatggtaagtaattcagcattgtgatttcctctacatttagctgctgatagtaaggttactaacttccattgattggtaataactggtttgattccctgttgtagaaagtaaggcacatcaggtagggacacttgccttaggactggagctaatttttgaggttagataccacccatcatggtctggattgaggattaaaaatgaagtgcagttgcaaagtggggcagagtgagtagcaggatcgattctcaggtcttagggacaattgtaagatagtcaggagaaagttaagagttaccttgggaaagattgggaataaagataaaaggagaagaaaagacaagactaagaatgccagaggctggcctgtctggactggaaattctgagaaaggagaggaagccatggtgcaaataatccaaaagatgagcagttggaaatttatatttgacatatacaattatgttactgttccaatttaagaatgggtattcctgatatagtgggagttcttgccaaaccagagaaatgtggaaccactgggatgacggtctcatgaagacggaaaactcagtctctcctgcacccttcttgactatacaccttcatcctattcttccacctgtgttgggaactaccttttggccttaaatgagatgcctcttcttgagcttgcttcctggttgacttaagcatccccttaaaaatgggagagaaaaagtaaatgttttagataaaataaggaactctcagcatttttaaaaaaatagtaattaatggaataatttttacaaattggcatcatactaaatacagatgctagtaatgtcaaccaaaaagaccttggatgaagtaaggtcataaagattcaccttctgaatattacacacgttattgtaagtgattttatatctagggaaaatctaatgctcagctaactgatcctctttcagttcattcctgcctacatgccttggctcttttcagctctttgccaggaaagtcccttcttcctttattccactaatcaagttccctcaaagctggtgtcttcataatttctccccacctgagcagagttaattattattctatgacacattataatacttttattagagcccatttttaggcttatgctgtgctgtatgttttgtggtttctagtttatgaggctttattcctccctccatccaaactgagaattcattaagagcaaggaagatttgctgtctatcactgggttcacaaagcctgttatccaggggcatgccagagctcacataagctcaattatacataacttctgaacattgctttcagtgataccatgttagtagctcaaaatcagccatcactggagtatttacatcatagaaattaggaaatgttataaattaggccccaccggaccaagagtcgattgttagacttttatcagtgcattgctgttagaatccttctgctccatagaagatacttcaaaactgttgaatttgaggcttttaggatatagaaagggaaatttaccttatattccaggggtctcattaatttaatttgtggcattatcgtttttagtggaatccctgggagtattaattattgtatgttgttatcactgcaggctattaacaaagaacattataagtttgttccattgactaaaaatgtgaacatctttttctttccctaatatttggcttccagggtggagttttagtaaaaattacagaaatgtgtcctcctttgaactgctcagaaaaggatcacattcttcctgagaatcagtgctgccgtgtctgtagaggtaagtgggcttggtggtgggccatgcgtggggtgaggctggggctggtcttctggggcatgagattttaatgaatagtatgataataacatgggtccaaaactctgtgcgctgctccttaaaaagttgcatatcctatttacctctctcagtcatagtctcctcaattataaaatgaggataataatagtatctactttgtaagactgctgtgaagattaaatgggataatgcataagcacctaccatcatgcctagcatgtgacaaatgttcaataaatgatagttcctataataatgctaatgttagttcttataataataaccattatcatcattattacatttttctcatgagtgagattgggaagcattcttttcagctccgtcttgttgggccagttcccatactctggtagagaatgatgtatggtgaatccttactcataggttagattgttatgcaacatttttactccctgcaaggaaaaatgcatcagataaataacacttggttgctaattaattattgggcagaaatggttttgcttcatcttcctggaattgccttcatcccaaaatttattctttatttaaatttttatttattattattattagtttagagttagagtctcgctctgtcactcaggctggagagcagtggtacgatcatagctcactgtaaccttgaactcctgggcccaagcaatcctcctgcctaagcctcccaagtagctgggacttcacaggcatacaccatcacacccaactaatttttatttatttattttttttttagagactgggtcttgctatgttgcccaggttgtccttgaactcttggcctcaagcaattctcctgtcttggcctcccaaggtgttgggagtacaggcatgagccaccatgcccagcctatttttatttttcaattgttatataatagttgtgcatattttgggtgtacatgtgatcttttgatacatgtatacaatgtgtaatcaaatcagggtaattgagatatccatcacctcaaaattgatctttgtgttgggaacattacaattcttctatctattttgaaaaagacaatagtttattgttaagtataattaccttactgtactatccaataaattccttttatctaactgtatttttgtacccattaaccaaattctcttcatattccctccccctttcccttcacggcctcttaaattgattcctatgtcttaaaacccagctcaagtatcacttcctctctgcagcttctcacccaagcagaattagatgaattaggagatcctaggatttgttcaaaatcttaaaaaaaaaaaaaaaaaaaaaacagttaaactcataggtattattttaaaactatatctaccataaatacttcagattctcaaatacccagtaagtgatatccttttaatctgagctttgaagcttccagagttaaggaggtccctgcagcatagcaatttagctcaggtaacctcatattttgctttttttttcctatcttttctgtagcagaggggtggcaaaaattctttataaagggttacaaaataaatatttttgactttgccgacaagaggtttctgttacaactaacagaagaaagttagcaagaaagcaacatagatcataggtatataaatgggtgtgaccatgttccaatgaaactttatttacaaaaacaggtggcagcctgtaactgttgacccctcccttagcaccttctggtgtatgaaaatgttgtatgtttcaccattgcatgttttcagcttaggctttctgtgtttggtcatgagagctctgggctttggtaaaattcttaggaaaatttagtgtgttgatagccagaaatggcccctagaattagtgataggctaactatgacatcagaatatcttccttgatttatctgctttcatggctatattatctgcagctggtatgttttggaaatacctaaagattgagtggaattttcagagtgatgcatttattggttagatagaatggttaggtaggtcttataatttaatgcaaaattcatcacttgctatttgttggggtgccaagtgagactcagtttatgtaaatcctttctgatttatggtttcattagagcagaatcattaattaggccacagaaattcaggagggatttcattgccctgacccaatttacaatagaacaggtgccactgcttctgttagcacttgtctggaatgtgtccattaccaatgaagatgctgagagatgtgacatctcattgacaagaagcagacatacaaggttcccgttgctagcaagcagtggcatttaccaaacctgactcaactttgagggaagagtgggaggcaggaggaagacttcatagatttgatcttaggcagggcccgtctatgaaatcaagggctttctttttcataccagttccttctcagccaggaaacagccagctcttttacttggaagctaatagttttctttggaggtatgtgtgtgtgagaaagttattttatgctctttgactgctctacatttggacaggaactagagcatgtcttcagaaaagaggtggtgggagggtgttttcccgggaggtaggtgaattaaccatttggatttcttctatattactcccatctcagagtcagactctgaagtaaaggaggcagcattgttcactgaggcccttttcagaaacatctactatcataaccttcttccttcttgctgacccacagcagagagaatcccagaacatccagcccacttgtccacatgctagggcctgctcttcccatcaggcaatcaggaaatgaaaggcatatttagtgagatgtctctttttcatgaaaccctgcaatttaaatgacaattaacaaagagcaatacagatgagttcaaaagtctgtcatcttgaactaagccccccatgaattttgctccacatctcttaattccgtctttaaaagtaacataatcatctctcacaattttgtgagaaatacttttcttcttatttttgccttttcctctgcatttctgagtggactcacaggagaagggggttggacaattactattctgacaagacctgaaaagcccagtggacttctaaagcaaattatttggttcttcttgcctcctccccttctccccttctctgaaacagaaagtaatgaaaagtcgagaaacactcaatttctatgtaaagtaatttgtatcctgcatatggaaaggcagcagcatcgtttgctttgtggactgattgtccacagactggttggcagcaaggaagcagagaggtgggactgagatgagctgaagtgtgtattttaggaaatgagcactgtggtatgctatagctgtactgcttctgccaccctgatgttgttgattacaaaaaccaaagtggctgtggcctttcaacacctgcaccgaaggcctttcaattagcatatttatcatctctctcttactgtgaccatccggtcattagtctgagagaaattaccctatgacggtatcattcctcagaagtctaagtcaaaacctttctcatgcctgcctggagaatttgaagttttccaaggtttattttctttaggactctgatgagtcaccttacctggggaggcctagactgggaatttgagaaaacttccagagagtggattttgctcactgtcattgtcatgttaatgaatgaatgacattattttcagcactagctgataggctttatatattttacatatgaaataaggttaaaacccatttttctgagttataacttatttcctcaagttatagcttgctagcttgattatgaagttaatttttttttaacttagtcttaccaaattttctcatatggttactgtcccccaccccacaattattgactaatcaagatggaagatacaggctacatctttacatttgattttttttctttgtttgaattaaacctaagactttaaagttagtaagaacaggttctgactgacttatggtgttcactgtatcaacaaactggtctccaagctaggggctcagataccttgcctcttcaaattttgtgtcatgtcaaatgctgtaactaattcccttgtcttttagggaaaaatgaatataaccaagtaaacagggggtttaatccacagggctgttggagcagctgggacacccataggagaagaactatagaattggtagggaagaaacacgcaaagggaatcaaggtgatggatactggcggggagaggccactttgtagtttgtgggactcatggtctcagtcacacaacagcaccacccagaacatccttaatcaccactgcagcttttctctgatacctcaggacagtttgtgctggcaacatgaaattcatttaccctcctctttaccttgaggtaatggatgtagcaggagcctgaccacttgaagtgtgaggccattaggtggagaaggggagtgtgcactggaataacatctgggctcctgcctgggaagaagtaataaaagcatcaatatagacccagcagaaaaagactgctcgtgaatttctggtgctctcagttaaaggatgaaaaaaaaaaaatgtcaacaatattgaccatgtattctcaggaccactccaggaaaacagacccatcatttgacccatcccggaattcttgacatactcctcagggttttattcccctggtaatcagctctaattgtatctttaatgttgccaatgacgttggaggattttgctgcatgtttatgacttctagtgttgggaaaaagttctttccgacatctgttccaaatgcgtttatctgtaattttaattcaggctcacttgccttgtcatctggcctggacggaaattagttgagattatttgtactgttaaagattttatgtccttcaattaaaccctccctaagagtcttggcatcaaatgattttcctcccacccagtcttcctcattgttttgggtgaatttataattgaaatggttttagagaaaggatttcagggaatttgagaagaaaagagacctgagaaaaaggcacttaatgagagtgtaaactagtgcctaaatagaggaactggcagttcacagatggaccagttcctctgcatattgatagatgagatctgatcaaaatgccatcaactgtgggctaaagtggactggaaagacagggctatatgctcaactgttggggctgggaacagaggatagtcttagtgagtaaatgaattcatggtcctaaacgtgctacagtggatcaaggtctatgaagcttccaaaaggaggcacattttcccagagagaaaacctgacactaaggctaggctgcctcagaccttaagggaagacccttaaatgttgactactgtggaagaaaccaattgctttctaagctagaacctgtgagagtcgggagttcagtctctattaggcctgtcctgatggccctaccttctgtccacaaaagcttaaggattattctcactttcaagagcccaggcttctcctgtgttatgtgtattgattgtggagtacataaaggcatccagttctcataaaagaccctttggccatatccttcttaaccagtccatgggtggacctgactgtacatctgaggcacatggaatatgctgccctcactataccattgctccttacgtgaatttcaaggttgggtaagcagtagtgaatatgagaggtattgacgttctaagattttagaatagaggactctggagtgcactttgagattgtccaggtatataatttcaaaggtaacctgcctgacctgctggggtatactttaggggcaggagattgaggaactattagtgacccatgtattccttgctgtggaagaagttacgggagtgaatcataacgatgtatgtctatcattggctgcaaaagcaagagattaagcagaatcagtgatgattccttgataactataaacaacataaagtgggatttggagagtggcagtgtgggggggcctcagtgtaataggcagagcttattatatgcagattaggctaatgaatttaatgaaagtaaatcattttactagtgttactggtcattcatggcaacagagctcgatacaggaccaccactgcatccaaattttaggctgcttccaaccagaggagaaagtgtgaccccaacatttacattttctttcattaatttctttgtacatatcacgggcccatgctgctgtaagcatttggaactcttattctttgtccagccaacctcattcatccttcaaatctcttctttaaaacattgtgttaggtttcttctctgcatacattcctagagcaccttgcccctctccatcatgatatccccttgtaacccaatgctcaaagacagtcacccctgctagaatgtaggatgaatgcggacatgtttatggtattttttgctgtattcctattgtctggtataatgcctgcacatgtgctaggtgcttaaaatttgctgttcttaggaggacagtggaagaggacagtgattaagaattccagcctcagtcggactatggctctgtgtaccttccacaagttcactgccttcctctaacttcagttgccacatctgtaaaatggggataataattcagcttcatataattgttataaactcttataacaattttatgggataatgtatgtaattttatgggataatgtatgtaaaacacttagccaagtgcctagcacatagtatgtgttcaataaatgttaattattgctgttattacatctgtagcagattatttggggttctccaaacttactccttgttctttcttcttcctctttggttgtcattccatttctcccactaggatctgtgtcctgctcctatcaagtttctacctattacagttttttgttatcttgaaatgatttatccttctctgaaacactatgacattttttcctgctcacatctgacttaacaaagattgccttgattgaggccataggtggtttattgccccttagggattataatttccctgcgggcagagaatatcttaaacatttttgaagtgtctccagataattatgtggtgctgcagcccacagagtagaggccccataaatattgagtgaatgactattcactcacttgtgcagaaaggtaagtgggcatggaatgaatattgcttgaataaaggcctccattaatttaaaaaacacatttttgagaagaatggttaggcataatcaaagtggatttgacctgaaggtgagtttgtctcaccggcccttcactgtccttgaaatacaatttactcaactccgggcatcatgatttgacatggtacatgcttaatagaaacatatgcattggaaaatcaacactgtttgaagggctttgttccaggctgtcagatgcatgtggaaagaaaaggacagttaaagtctactggaaagaaagagaaaagaaacacagacaaggaatacgtgtgataaaggatgcacatgtgccgttgagtcaagcttcctaatgaaggaaaatgtgaccatttaatctaattattgatcaattcagacatgggaagtgaagtccaggctcctcctctggaagagagacacgtgatgcctaaaagtacccctttggtaggaaaaaacatcaagcactgctagttttaatgattattgtaagcctctcaagcccttatagaagtgttgtcaactgtcagaggtttcagatttccagccagttagactcttgctctgatttttgactgaggcaatcaccagttaacaggtcataagtagtgaggctggatgtaactcatctaggcctatgcatctactctctaatgtcccaaggagtggctacctctttcacttttcataaccaggttttgctatctgagaggatatatgacatagtgagaagcacatgggctttggagttagccagacattatttagaaccctggcatttccactaactacctagagatttgtgaatttgtactttttatcttgaagttgaggataacagcattaagttattttgaactttagtcatgattgttgaaaatatcatcatcattattagtggccaccattgactgacctctttaacaggtataaggaactgtttcaagtgccttacatggattagcccatttaagtttctcaacaacatattaaaaggtatatattattattcccatttaaaacacctagcatgccaggcatattataagtgcatgaaacttatcattattatttaataacaatattattatctttcagaataaattctccaaatattgttggtttaaaattttatttcaaaaataattctagaatgttatcactgaaaggaattaacttgactttatctagtggagtgatttccatatttttaagccaggaactgtaattaacatgatcagtatgggccaggcacgatggctcatgcttataatcccagcactttgggaggctgaggtggctggatcatgaggtcaggagttagagaccagcctggccaacatagtgaaaccccatctctactaaaaatacaaaaattagcccggcatggtggtacacgcctgtagtcccagctactctggaggctgaggcaggagaatcgcttgaacccgggaggtggggtttgcagtgagctgagatcacgccactgcactccagcttgggtgacagagtgagacttcgtctcaaaacaaaacaaaacaaccatggtcaatatgtcaaaaatataaaagattattctatttgaatcagaggcagaggacttgaaccctgtataacaactcatctgtgcctagggccctgaggaacacagtttaaaaattactaatttcaggctgggtgcggtggctcacgcctctaatcccagcactttgggaggccgaggcgggtagatcacgaggtcaggagattgagactgtcctggctatcacggtgaaaccccgtctctactaaaaatacaaaaaattagccgggcatggtggcgggcgcccgtagtcccggctacttgggaagctgaggcaggagaatggcatgaacccgggaggcagagcttgcagtgagctgagatcacgccactgcactccagcctgggcaacagagcgagactccatctcaaaaaaaaaaaaaaaaaattactaatctcatccgttcgccatatgcatacctagaaaagcaaagtgatttatactgtttgttagctgcagatcctaaattataaattcgatctcctgacttctagatccattgttttctgtgagaacacagtatgtgatatagcataattattgtttactaaaagtactgatttaaagatgataaagcatctttatatactttatcatatttgaacttctcaaattttatggtagatgttacctattccttctagttcatctaaaatgctgcctaatatagaaacaactttctggaacatttggtggagatggcagtaagggggagaaaaaaaacaactggagaccagaatatagaaagagggtgattccattgaaataagcaagtacagtggagttgacgtttgccctgagtgcaatttcgagtctctggtggtttaaaatatggcttctagtggacactgtgtaagcagacaggagacatcctggggctagtatgagaaacataaatcaagaaccttaaagggtgaatccctccatgggtgaactaggaaaaatccactctgcccaaagagacttgcctgtcagtcttgactctagatggaggtctagaggagaaaatcttgcattcctaaaagcttagggctagactttattccacctgtgtggctcaaccttcaagcactaagacaaaaatgtagttgaaagtcatcttgggttgatagttccctcagacccctgacagaaggaaacacaaatcctctctgaagaaatgcagtttaaaaaccaaaacctcaaatctcacacattaaattccaaaaaatacgagcttacagataaaagaataactcaaaacacaagagaataagctatcatgcatgctattcagcataaacaacaaatggcaaaattagatgtgcaaagcctgaagatattagaattatcaatataaaatatttatatgtaacatgtttaaagacattttttaaaaaggaaatttaaaaaaatgaaagaataagagactatcaaatttgactaagcagactgaaaaagaatcaaataggattctaaaaataaaaatacagtaagtgaaattaaaaatgatgtgggtgactgaaagagaatataacacacctcaagacagaattaataaactgaaagatacatctcaaaatgatgcagaattcaccataaaggaaaagaaacagaagatatgaaagcaagtctaaataacacagatgagagcttgagaagaaagaacatttatctaattggaattccacaaagacaaaatagagaaaaacgtggaaagggaatgtttgaagagagaatatctaagaattttccaaaatgatgaaagatttcatcatctttcagattcaagaatctccccaaatcctaaataaaaatacatttatacctacatatcttagattaaaactgaaaaatacaaaacaaacaaaccccaacaaggctgggtgtggtggctcatgcctgtaatctcaggactttgggaggccgaggtggggaaatcgcttgagcctaggagtttgagacaagcctgggcaacatagtgagacttcatctctccaaaaaaaaaattagctgggcctggtggcacgcacctctagtcccagctactcagttgccgaggtgggaggatcactttagcccatgaggccgaggctgcaaagagcaacgattgtgccaccgcactccaacctgggcaacagagtgagactctgtctcaaaataacaacaaaacccaagctaacacacaaataaaaaagatcttaaaagcatccacagagaaaggggttgccacatgtaaaggaatgactattagattaataagtgactcagcagcaataatagaagccagaaaacatggaatgacatttttaaaatgttgagataaaataaccgtatacccagtaaaactattttttaagtatgaagatagtctaaagacacatttagacaaattgaaattgagcacagtcactatcaaaagatactgaaggaacttctaaaggctatattaggaagaaaaatttcttggaagaagtagcagggaacaagaaagactgttaagctaagaaaatgttgaacatgtggctagagaatatgccccaggaagcatgtttaagaaggttttttagcagctttgtttctcagtgaaaacccgcaaatagctcaaatgtccatccatggtataggcataccctggagatattgtgggttcggttccagactatggccattaagcgaatattgcaataaatgagtcacacaaattatttttgtttcccaatgtgtttaaaagtacagtccgatggcattttactcactggaatgtctttcaaaattggtgctgatcctcctgctttgtcagctaagtttatataatattctaaatcctttgttgaatgaatgaacccatagctaaaggcattcacatggatgaatagagaaaagcacaccatagtatactaaaaataaaatggatgttggcgtggatgtggtgaacagggagcacttcttcactgctggtgggaatgtaaactagcacgaccaccatggaaaacagtgtggagattcctgaaagaactaaaagtagaactaaaagtagaatttgatccagcattcccactactgggtatctacctagaggaaaagaactcattatacgaaaaagacacttgcacgtgcatgttgatagcagcacaattcacaattgcaaagacatggaaccaacccaaatgcccatcaatcagagtggataaagaaactgtgatatagatgatggaatactactcagcaataaaaaggaatgaattagtggcattcacagcaagctgggtgagattggagactattactctcagtgaagtaacccaggaatagaaaaccaaccctcatatgttcacattcataagtgggagttaggctatgaggatgcaaaggcataagaatgacatcatagactttaggaatttagggggaaaggtgcctggggttgaaagataaaagactacaaattggatgcagagtatactacttgggtgatatgtgcaccaaaatctcacaaatcaccgctaaagaacttatgtaacaagacaccacctgttccccaaaacctatggatatgaaatattttttaaaaaagcataccatagaagatatatacagtaagatttccctcatatggagtttaaaatgggcaaagctaaatggtatattgtttaggcataaacacaaatatgaagtaaagctataaaaagctgcaagggagtgattagctcaaaattgaggatagttatctctagtggctgggagggagattcattggggaggtacaattaaggagttttgataatctggttgtattcattttattttatatattcatatatattaattttattactctttgtattataaattttacaagaaaacaaaattataaaaagagtagtcatgtaagaatgtagtgagaagaggatgcaggatcagcatggataaaagcattcaggtaggaacagcctcagcaaatttgagtatgggtgggggaaagcctcttacgccttggacagcccaaagtttcctatatctattctgccactttcctatccagtttatccgtgcatactgccaaagtgtattttcctgcatagtgacatataataaaaaatgttacatactttattttggggagttactttatttcctccttttctgatgtacgtttttatttgttttttctaggtcataacttttgtgcagaaggacctaaatgtggtgaaaactcagagtgcaaaaactggaatacaaaagctacttgtgagtgcaagagtggttacatctctgtccagggagactctgcctactgtgaaggtaagtaagctatttaatgaagtcacttgtgagaggttgactgagaagtgtatgcctggtagatgtggttaaagagtgaaaactatcacttggctgtggtcctatgcaatcctataagaaatcatatcaattgctgagggttctctgttctcctggtttatccatgctgctcagtagcatgagaaagcaagacctttgaaggtcgttatgaagcacggcaaagaagcaaaggcaacagggacatatcaaatcccatgttctgctgctgtgcacataacaatcactagatcaaccatagacacatcatattctgttttcttatttgatgagattgccatcttcatatttaattaaatgtacagggtggtttctgttttcaaatgatactttgacattaactcatactaggctgctgtctccttgacctgacaagatcaggtttttattctttttagtgggtttcttcgtgactggttcatgcattgccaattcccaatctctactaaaagtcacagtaatggagggactcataactttggcacatgggctgatgccattacagtgggatggtggcctcaagcatcaatgacccacatttctgctctagagaaagcaactcctccgtcttaagagagcaccgttttttcaggcttagtactgcaacctgctagtggtgagcattgcatatatctattaccttaacatgccagaggagtgggagttagttcgacctggtctgtatgtatagtaccataatatctgagcccatccatttccaacgtgctcatggctcccttccatcagtttgcaaaagctttaataagcaaagtgatggctgggctatttttctgtttgttctgattccaattattcctgctgtcttcattaataataccttgcaccatgatgatttgggtagttgtcttcaatgaatgctgcaaattcctggtcactttcctctaagtggtctggctctcagataggtcaggtattctaaaggtaaagacagtattaactgatgatagtaatggtaaattctttctattctctatctcatagttgaccctcgaacaacacgggtttaaactttgcatgctgacttatacatggattttttttcaacaagacacaagtcaaaaatacagaattcatgggatgcaaaacctgcctatatgggagagccatcttttcctatagagtggattctgcagagcctactttgggatttgagtgtgtgtagatttgggtatacacaggggcctagaaccaattccctgcatatacccaggaatgactatatattgttaatccctgcttaactttttggctttgactaaagacctctagttatcaagaggatatatcttattactactagagaccagtaccttgtaggaaccctctgtttttttcatttcttctggaagactttctttgttactaccataatttttattaacaatatattctaataatatataataattttgtcttcttatttttcactgtttttttggcttgttttatggatttgaagttttaaggagacatgtcacttgggagaatgaaactgtccctttgcttatgaaccttttcatctgccctttaatacatcttagttatttgttaatttggggtgatgggagtatcaatttcaatacttcatattaatatttatgtttagatcttcccttatgctattttctatcagaaaatttaagtaattttaagaattaaaaatgtgagtattcccactatttaccatggaaaaatcctgtaagccacataatggtctaaaatatttaccttcttaccttttcctatatgcagggatagacgtcgaacaattataaaaatgatagaagaaacctcaaaaacaatgtgaatcctgattacgccactggcagaccttttagttgtttgttgaaatcagcatagccaccattcctgaccccacttctctattgagacccagcagaatatgagacaaaactgctggtgctaatgctgtttgggattctttgattcatttctcattgatgtcattttttattacaaaagactggctccatgaggagccatctgcagtatcaacctgatctttctctatgaggccttattttataatgctgagtggattttaggtctgaatcactgttttcttgggcatgctcctgtttagctcagtgtatgagcctggccttaggccagtatgcattgtggtgctattgcggttgggtaatggcaatgtgactgggcttcagtcatttccttgttgtatggagactttccataagctccaggggatgtgttcttggagagaaggatagcacctaaggagaaatggctaaacattggacccctcctagcatgtaggaacatagctcatgggttaaagcaggggtcaaatactgggcatccggctgggaggcacagagaacccagtagagtgaatgccaacatttagagcagatgcctttctcgcattccttctgccatcttcagcatttgaactttgatctttgggcctatgtttccgtgattgcatgatgacttccatagctctaagaatggtaccctcacagcagcatcctaagcaaggaagagaggaaggggcagggcttaaaaaccttgtctgtgtgaggttctgtcattttatgctcaaagaaagtccttcgtagaaagtcattccccaactctacccctattaccaccataaccacatgcagaagacttcccctgtgttatttttcagacccaggttacaccacttctatcctcaccacacacacacttctagaccgatgtttgagaaaggagaatgagatggccatcactgctttgggctaattgtgtttattccctggagctggaggagaggtttgtcttcctgaaaccaaaagagctttgctggttacaacaaaatagggttttaaccctattcaataaaatagggttttagcaaccattcttttatgattacatttagatgaattaaatgagataaatggtcatgcaggccatttccccagctctctcctaagaattgccctttgaagtgatcgggtagacaagcttacagatggccaaatgccctcctaggaacagagactctctgaggcttcattcgttgtctctccacagcctagaaagaagtaaatacttatgagctgcttgaagcaagttatttttactctgagtaaatgggatgaaaatgactcatacgataaaaaccacagtgaacaagactggcttgcaaattaaaacaaaatattacacacattgtccaggccatcttgaaaagcctgttcaggctctcagtggaaaaggaagcaccaaaggctttcaattttcttaacttcctaaggtagaagcagagaggtggcatattggctcctgctctgtagagattgtcgtagaaactgccgtagagaagatagctgaactcctggccaatcaatagaagataataagaccttttgtcagctatgatacaattcacaggaggctgtttcattttgccttttctgactccaggaggagcattctccattttgaaaactgctctagttggattttaatgttttaggaatcttgtcggctgaggctttttccttttttaatgacattttcaacaggttggtcttaagtagtttctgatgcattaggagtagtgtctgaggaaagtatagcaataggggccctactcatgatcttagttcttgaatttggagtctacctagatagagtctcataaactttttctttctgtgataaaaagttacttagaagcataaagaacaatgtaatatcatacacatcatgccatctgtcaggtgtggaaagcactacaattaacattaaatgataataccttttacttgcagagtgttttaaatttttcaaactccttttatatatgttacactttttgaacgttacaatgaatctttgagaaagttgcggcattggccacattaactccattttatgagtacagacaagaggattcagagaaatgaagtaaaaagatgatcctcaactcatttctactctagagctttctgcctgacttaaatgctccctcttcttccactacccacactgttccaatactgtgctagtgttcaaaatgttggttgccctcccgattttgccgacatcagttttggctaatgaaatgtgagtggacgtgacatgtagtttcagagtagaacctcaaggagcttttgcagaattccacatcgttctcttttctctctgaaacaaaaactggcaatgttccaggtcagggcttctcctttagctgacatcccagaatgaagatgacatggaaccgtgtgacaactgacaggtgatgggtatgtggcatgagtgagaaataatcttgtatgccactgacattggtaggatttgggggtggggagttatgctaccttgtgcgtaatagcgtaagcctacgatatgtctccctgaattaatggatccaactcttgtgggttcagaaggataccaaaattcagagctaacaactgaaagcagtttttaatagagcaagcattgagagttaccaaggtacaaattgttgagtcatcaggagtttgctctggcactgctgccaagcaacagattttttacagaccacaagttataaagcaatgttttgtcatgccaaattcaacatggtaaatggatttcccaattaagatgataatgaaacagtgcatgtcagaaatttagcaaattgtctggtattcactaaatattgaatagatcacagttattattaccattattatttacttaaatcattaatgtttatgaggatctttcttggaatttgcaggagtgtgtgctcattgagaccaatactttgagaaagagaaagagaccaaattggcaggtagcaggggagaatacatttagatggaaggactagggttcatcaattcttccaggtgcatattgttagcagtggggcactaagcctaataatgtataggtgaactcattccttccttggaaaaacacaagtggaattgtattcaaggaaatattttggaaaaaaatgacctgaattggtatgaatttagtaatttcatgtaacaaaactgacatgtctgaaacagagcagctgattagcaaggtgatttataacttctttcatatgactagaggtggtggtgaagggtctgacccttagaatggtaagaggctgggaaagtggtagagagatcagagttcaaacagaacgcagcccacagaatacctaagtgggtagatacttactagacatggagactaatgtaaatgcacttctatagaaacaagatcctgcaaattcttaattaagagattgtgtagaggaaatgggctagtttacttaattacacttctaattatccaatatttaggtaacttcttttacatttaaatattttgcattttataaaatgtgtgaacatcatgatctacatagcccagtttcttctcaagtgtgggcttcagtctcctaaagctctactttagacagcaaagcattgctttagttcgttcatgccgctgtaacagaacacctgaggctgggtaatttacaaagaatggaaatttattttctcatggtgctggaggctaagaagtccaaaatgaaggtgccagcatctggtgagggcccttttgattcatcatcacaggtgaaaggcagaagagcaagaagtgggcaagagggggcagaactggcctttttatatgagggcagagccatcatgtcctaatcacctcttaaaagttccacttcttaatattgttacaatggtgactaaatttcaacatgaattttggaggggacaaacattcaaaccatagtagagatcaaaagcctcttctgattggtcattgtcagcaaaaccttaattcttagttcctgctcccatttatttccagatattcagaatgcttgagataagaataccttggggtatctttcttttctgttttctcattagcctgcctcactaatggagagatcttccagtacccaggtatctgtcaatccccacctcccctttccaaggcacagagattcctagcctttgctttgttctggataactaacatgtcatcttcctcccagcaggagatgcagctgagccttgttcctgggcctggcttttctctgcctctgctttgttatttcctaggctacttagccaaagtgcatctattcctgctctcctacccacttgaaatcttcttaaccatcacctccccaccccctgccgccccctgccccgacacacacacgattttcttcttgaaagtataacacaaagaaaaataaagttcaaattcaaatcctggttatttcacctagggttaaaagaaggggtaaattcctaagctctgcccttaggaatgaaccccagtcaaactaaccggggcaatggtcaggatggaacttcaaatagcactgttttgtttttgttttgttttattttatttattttttaccacgcttcatgcttcaaaaatttatttgcaagatatatgcagaaattttagttatttctttgtgacagaagtggtgtaggcattgattaggttttcaggccagttcatagaagcccagggcataggtatttactagacacagagactcgtgtgaatgaacttctgtggaaacaagaccctgcaaattcttagttaagagattgtataggagaaatgggctagtttgcttaattatgcttctaattattccaatacttaggtaactttttttttttacattttttacatttaaatattttgcattttataaaatgtgtgaacatcatgatctatgtagcaccacgatcttcatgtagctgaagtattgtactacaaagatatcctgagttccagggtgttgaaaacagagaatcaggtacttttctcccaatttcgggtaagggtacatccacttagttgctcaggtcataagacatagacatcatccttgattccactcttttctttatccccaacatctgctacatcagaaagtcctgttagctttacctccaaaattaatcacaaattcactcatgtcttgctgtcttcaccactaccaccctagaccaagcttcctttatcttttggctagtgatcccagtagcatccactcttgcccaccatagtccatcttcaaacatatttaaagtgagctttttaagtgtaagcagattatgctactctcctgttgaaatttgtctcatagctcccatgcctcttagaataatacccaaatttggtcctgtgtcaggccctatgtgaactggaacctgcctacttctccaaattcatcttgtttcactctctccagtgtttactcttttcccatcacactggaattctttgcatccctccaataggcctgtgcagtagttctttcctcaacctgggaggcccttcactcagatctttccaaatctgctttccaggccttgttcaatatgtagttcaaatgccacttctttagaaagatctctcctaaccacgctggctaaattagctctgctgctatcatcagttaccccctataccatttgaatttgatttaatgtattttctttgtagcacttattctttgaaattgtgttgttttcttatgtgtgtttttctgtttaaagttttattatctgaccctttggaatataaactgcatgagggcagcaattttattttattcactatctctagcacctaaaatagtgcatggtacattatagacacacaaacatttgcttaaagaaagaaaggaaggaaggaaggaaggaagacagtgcttttctgtatctgacactgttttcttatgtcaagttcattttactagcattgctcaagggctgctttttaaagtgcagagtctgtaggtcaggggctgcttctgcccacttttgctaatactcagttcatgtaatggtgaaacgctgtgtgttaactttatttcatatgaacgtcactgcctttatttgctacggaatgcctttccttcactacatgacaagagggtagctgtcccttcattttgataaaaagataatggtttttcaaaaaatcattttatcagctgtttatagaaaattggttttctatagattttcaaatggatgttccagcttaacacgtggctcccctcaaaaccatgattcagggaccctggctcctttcctcttgtggtcctagcatgggcagtatgtgcctctcaaggtcaccagggaaggggaaaagaatggaaggttaccagtgggaggtttttatgggccagggctgttcacatttcactggccagaactcagatggtggctctatctaactgcaagaggggttggtaaatttcgtctagctgtgttcccaggaggaaagaaaaatctgttttggtgagtggctttttgatcttgccagcttttccagttatttaatgaaaaaaatctcctcattaattataagcgttttactttttatttatttcctttttcccataaatgagttctagcttcagttgattgtgctgaagcttgctcacttggagaccagataggatttgactacttaaccatgcccttttcactttcctgttgtatcatctccaggcttccctgtgccccccactgtatcatctcatttggatttattctatcctcaatattccttatgtctcaaggtgacccatctcctttctctccaagcaaaattcacagtttcccctgtgctgcagttctgagttttgtgctagaaagaaagcaattcatggaacaagcttacacacatttgtaaatgattgatatccagctaacactaccagaggtaaatgtattctttaaagaggatgctttataattaagagagtcttcaaaccattaaattccaagcaacatagcaaaagaaagtaaaaattaaagtaatgtgaacatggaagatagaactgcttagaggactaagcagattgtctctgcctgggagttggtcttggtggtcagctatcctcaaatatttctgttttctaacatttttcttccctccatttttttcccctgacaactctcaggggagtgatgtagtaaagaacaaagcaaaaaacattgaaatagggacaagaagattttgatggatcctgactctatcatttagcagccgggtaacattggagagtcacccaattcttgtgtgttttggtttctttcatgatctaaacaggacttttcaacaaggccaaaataaaggccttactttaccaattggttgtggaagctaaataagatattgaatgtgaaagcattttgcaaaggctaaagcagcatagctatgtattgtaacattatttataattatattatcatgcattattataccaacaatattattttagtcattggcagtatttgttctagaacactagaacacaggtctttagatcttcatggcgtatataaatatctaatctatctctctgtccatccatccatccatccatccatccatccatccatccatccgtactctgaacatagagatatatctaccaacatgtatattgagccatagtttgtgtagagtcattgtgggctttataaaagtggggcttctgtgttgtacaactccatggggcatcatttatgtagttgtctaggtgagtggcagctgctggaattatgcagtataaagtctgcaaggttgtacactgcagccctacgaaaggcataaaggaaagggtcaggcccagagtcttgtctcattctttaagtgaaaattaattgaccatctattgtggctgggtcttgtgttggctaaagatgattaagccatagatcgtatcctcaaggagcttaacagtttaaaagggggaaaagagccttgtatcagataagaaaattacaataggatttgttctatcctaggatttaaatagtgttgtaggaatacaatggtgagagcaatacattctgccaataggagtcagcacaggctgcccagaggaagtgacatttgaacggagttcttaagaataagatgttctgcaagaagaggtatgcaggaaggccattctcagtagggggatcagcagatacaaaagctcaaagtgagaagtttgacatggctggaccaaaggattttggtaggagatgagagtaaagatatggttgatagttggatggggaaaagcattttgaatgtgctaagaagtctaaatttttttttttgtgggccagtatatacacatataggatgctggtatcacagtgggtgcaaaactggatccattgggttatggaaaaaaaaattagaacttttatttatgcttattttcatctcatcctcaatgaaatagttgttgtctcgatgaattttcaaacatggctatgatgggtaagaaggagataaagcatcgttgaggtcataagaatgaacttgcatggccttgctttgtgtctgtccccaaactctcgcagtcaggctgcatctgattcttgatcatgtcttccctctgataactcagatacctggcatttttccaggtgaatctatcttgctctgcttgtggctggatggtgcccagaagccaagcctatgtgtatggccttacattattttttagtgatgtaccttcaccttaaaaaatcatgctgagacatttttttggctcacttaataatattttaggactttagcatatctccttgaaagacattatgcataaattatgttatttatagtgcttagcatttttatgtagcaaaaagaaggaagagaagaagaaaaaaacagaagggaaaaacgtccctgcttttcagggacaagtccaagttttagagctttaaatggaaatagaaatgtagtcgctttaaacttttttggttatttaaaaataatacctttcaactatctctaagaaacctaatatccagacagaaatgagaattgaactcactcagtttttattgtactcttgttattgcagctggtatgttactgcctgccgtgactcagcttcctggcgaagcttgcctgggtaaacaattagagaagaataacacaggtttagtggaaagtttagatttagatttggggtacctggcttagaaatcctggctttatcattgttttgtgaacttaagcagggaacttcatctctcatcattttccctttgtaaaattagtgtgctaatacttatctaagtagtctttttaaagaattgctataaagaaaatgtagcacatatagcccatggaatactatgcagccacataaaagaatgagagcatgtcctttgcagggacatggatgaagctggaagccatcatcctcaacaaactaacacaggaacagaaaaccaaacaccgcatgttctcactcataagtgggagttgaacaatgagaacacatgagcacagggaggggaacaacagacactggggcctgctggggagcggggtggggggcaaggggagggagagcattaggacaaatacctaatgcatgcagggcttaaaacctagacgatgggttgataaatgcagcaaaccaccatggcatatgtatacctatgtaaccaacctgcacgacctgtacatatatcccagaacttaaagtaaaataaaaaattaaaataaaaataaattgctataagaactaaggggaatgaaaagatttaaggcagaatccagcacacaataggtgttagttaaatttgaatataataaagttcaataagatataagtaagtcctaaaacatattgttcagggtgtgtgtcaatgagtagttaggaaggggagggctaattcttggagttagcaggaaagataccagtcaagagggggtgggttgaaagatcaggactacagtgactatgatgaatgctggatgtctgatggagaagtgtggggtggtataggaaattcacactgagaccgtagcatgagatagaattagaaactagagggaggctgagaagggaggaggttgatgtacgagtttggagcagtgtgactgaaaacctggagttaccaaaaagcaaaagagcatttagtgtgtttggagctcagtgtgggagattgagagtgttgagcgcagagagaaaaagaattgggaggcattgtaggccttgtgaaatttggattcagtaggaaatgaaatgttgatgagatttttaaaagaggtgataagatccagtttgtatttctgaaaaatctttctggtttcagtgggggacagaaggtagcagcaaatcagggacatcagttgttagtctgctgctgcagtccagacaagatgcaatggtggacatggaaaatgtgggcaggaggtgaaacccataggatccattgattgggtgtgaggagtagattggatattgtatgaaaaatgaatttagaatcactggctatttcatctttatcaaatcaaactctaatggctgactttgaggcttcctcctctgggttctagtagcactttgtcaaaccttattagagtgcctatcaaacaggatcttcattacttttttttttttttttttttttttgagacagagttttgttcttgttgcccaggctggagtgcaatggcacaatctcggctcactgcaacctccacctcctgggttcaaatgattctccggcctcagcctcctgagtagctgggattataggcatgcaccaccacccctggctaattttgtatttttagaagagatggggtttctccatgttggccaggctggtctcaaactcctgacctcaggtgatccacctgcctcggcctcccaaagtgttgggattacaggcatgagccactgcgtccagcctcttcgttactttttcttaacatattttttaggttaagagctattcaaaggccagagctgtttctgattcatctttatatccgcagcctagcacctgtaatatactagttactttctgaatgaactgatgaataaatgaaggtagaagaatgtgattccatggataaactttagtgctctatggattcttcccactgacatttggcatctcatagatatatcttgttaatttctttccaattttaagttggaaaaagccaccttgaaatgtgttccagttacagcttgcacatctttataagaaacctcgtgtcctccttttaggattgaaaggatttacagaaagcccagtgctagctaacagtttctaaggagctgctatagagattcagggacttttcccattcatttctggatctttatcacttttcctgctactgccgaatgctgaattttgtcttttgatgctgacacctggctcctcaaaactctaatgggaactttctgagcccagctaaagaaacttggtttgtcagatagattatagttcacgtgttgatgcttccagcattgtgtgaagtcatgtgttgcatttgactgaaaaaggaataagtttacttgtttaggctcgggaggaaggaatggaaatgagcattctctttacaagtgccagaatgtaagccttatgaagactgggattgttgcctgttttgcagattgttttttccctagcacctcggacagttcctggaacagagtgggtgctcagtaagtattcgttgaataaatgaacagctggtggtatgaggtgggacactccgaggtgtttgataagtttttcttgctaaaaaaggaaaactaacatttgtgtcaggcattgtgctaatcaggtcttaatacctgtcatcttgctcagtcctgtctgtaattggtcaataaataaaccaaggcttgtcacacactatatgacagagtcaggatttaatctcaggcccgtctgacatcagaaataattcatggccctataagacgatccagaggaaaaataactccaattgattcctgttatctttttttttttccccaggatacatttggttagttgtccattttctccagttctagacttttgcagatttctttcacagaaataatattttctctgaatttgtttttctgatacaccaactcagcattttttggtgcggagggtaaacagagcatcctttcacaacttctcataagctatgatgaatagcatttctcaggattgtcaaaaatctttagttagctctcccttctgggctgctcttctggaaatctatagcagactgggtgatttctcttacactgaaggcttcagtatctctattggtctggggtatagacagtcaaagggaatctgcttaatgtaaacttagaaatgcttaaatttaaaaaagataaatggttttaatactttctacaacctgatgcctcaatctacttccaggaagtggatttttttcctaaatcaacttcgacaaattgcaactcatttttagtgaaaggttattcactgttattcattaacattatttccataggtgataaaaatccgggccttttttcttctcttttcagatggagtcttgctctgtcactcatgctggagtgcagtgcatgctctcagctcactgcaaactccacctcccaggttcaagcgattctcctgcctcagcttccgaagtagctgggactataggtgcccgccaccatgcctggctaatttttgtttattttttttttagtagagatggggtttcaccatgttggtcaggctggtctcgaactcctgacctcacatgatccaccctccttggtctcccaaagtgctgggattgcaggcatgaaccaccgcacccggctggggcttcctttttgtgttctttaacacatctaaatgtatatcatccattcttctccagtccagtggtaacagcttgcccctcactgagaaggccattgaaatccactgtttattgtatgattagttctggtatagcttcaaaatagatatttcttattcttcatggatatagctacatattcaatatattatatattatttaatatatattcaatatattatgtattatatatacatatatgtacagatataatgtattatatacacatatgtagatataatgtattatatatacacatatgtagatataatacatatatgtattatataatgtatgtattatataatatacatattatatatgtattatataatgtatgtattatataatatacatattatatatgtattatataatgtatgtattatataatatacatattatatatgtattatatgatatacatattatatatgtattatatgatatacatattatatatgtattatatatgtacatatgtgtattatatatacatatatgtgtattatatatacacatacatgtgtattatatatacatatatgtgtattatataaacacacatatatgtacatatatgtgtacatatatgtacattatatatacattatatatattatatctgtacatatatgtgtattatatatacattatatctgtacatatatgtattatatacattacatttatatatacatatatctgtacatatatgtattatatacattacatttatatatacacatatctgtacatatatgtattatgtatacacatgtacacacatgtatatatatacacacattatatctgtacatatatatgtttatatctgtacatatatatgtacagatatgtgtgtgtatatatatacatgtaatgttcaggttgattttttactttgacttttgaacataatttgtaataaatttcagtatagacaatgaatgcccatgacgtgtagtaattggccaaaacacaatcagaatgtaactggctactgagtgacaagcagaccatttgatatctagatcccaacccaactttgggctttgtgattctccactgtcactgagtattgaatgcctcttgttgaaaattcaaaggggtaacttaaatgtttcagctgtgtttacttacatttcttaaagtttattccatttttcctaagaagagagggaaaatgtttccttgttcaaatatgtttagaacattttacataccagatatcaaatttgcatataatggctttgaaaagctcactgcaaactgtgtttaacatagcatctgtttaacttacttgtacatggaattattgtaattcacacatgaaacttaatatcattccataaaaccagaattctgtggatcatattttcaaaaatgctccttaatggcttttactacataattataagctttagtaatatttacaaatctgggaattcctaaaaatctctgtatatttatattataagtggcaggattttttttatggtaactgtagtgagttatgaaagtttgttttctttaacgcaaactcctacaaaacctgttgtttctcttccataatttactgaacctgtgtgcaaattttttttttttgaatcataattaagaagagaatggttcgtcattttgctttcctctttgggtaaagtttgggtatgatgtttctgaatatgtggccattaagcccgtgtatagctagaataaatatgacaataacaaatatttgtataaggcattttaatttatgaagtgctttaatatatattgtttccttagtatcctataaactctcataatttagggattttttttccttagggtattttatagttgaggaaactagggcccagagaggtaaagtgacatgtccaagattcaggcaaattaaatctattttttttttttttttttgagacagagtctcgctctgtcacccaggctggagtgcagtggtgccatatcgcctcactgcaagctccgcctctcgggttcacaccattctcctgcctcagcctcctgagtagctgggactacaggcatctgccaccacgccctgctaatttttttgtattttactagagacagggtttcaccatgttagccaggatggtctcgatctcctgacctcatgatccactctcctgggcctcccaaaatgctgggattacaggcgtgagccactgcacccggctggcaaattaaatcttagtccagattaggacttttttcatgctgtcctctcttaaaacatactcaaattattaaataaatacttaagtgcataagacactcttattagcatggagagcaggctccaagatgtcagagatttttgtctgcttcattcactgttgactctctaataaccagccttgcctggcacatagcagctacttggtaaataattgttgagtgcataagtgaataaataaatcctagttgttgttgctgctaatatttatcagtacaacttctatgtttatattctaagtaccttacatggtttttgctattatactccagtaaaatattgttattctcattctacatgtgaggaaactgagactaaggaaagttgagagacttgcctgaggtcatctagctagttaagtagtggagttagagctctgattctgcaatgctatttctcatctttgtaagagagaattgagactcaccctaagcttacctaggaagttaagtagtagagttagagctttgattctacaatcctagttttcatctttgtaagagggaattgaggctcacacatacttaaacttgtatctttttatactgaatccagttgtttctgtaacaaaccatctcatttgtcttgttctgattcagtcgtggttgacaaaagatgacaatgttgctgctgttgtcgacagccagtatttcctcagcatgtactctatgatagtcaccgcgaagctaggtattactattattcccataaaaccaaagatccaagagaattaacgatttacccaagtttatactgttaataaataaatgacatgccttcaatcctaatccaatattatatttgtcttcatgaaaaaaaaagcacacacacacaacaaagaccaaatatcagagtctaaatgagggattttgcctgtttatatttactctctttatgggtcctgagggaacataatttgtgtatcttagatagaagacatttgggcaactcttattttacaattttaggtcagcatagataaggaattagtctcccatagattcaggcatgcttccacaatccccttccaaatttctcccctatggagaacttcaggatagaatttagcagaatacttaacctggccctgtctgtaataaacctgtccttagcaaccttcggattctcatccccttccttctcccttcaagatgcaggagtcctctccctcagcttcttttctttctttttaggttaccctgcaaaatcagattctcccacgttactgctctaggtctcctctctttctaatctcccaattccctccttttctaattattatcaacattattgatgcttactgcttagtgtgatgggacatgctgtttgcagtggccacaggtagttacacttgaaaatgagtggataggattttgcaggccccccagcatatttactggagaaagacaaagggtttaaattaaaggattaattggaaagctcttaagtgcccttagtttttggtcgactgaaccaagttcttctcttgaaaggtcaatgagcttttccataatttttagctgctgtgaggaagaaactgtaaatctttccatttatttgctttataaatctcccttcagctcatttagtaaggagctgaacataataaatctgtgacttttttttagaaatgaaaaaacaaagcatatttggtaaccatgctatcataaaaggaaacctgaactgctaaaaccttaaaaaactataaattaaacttttcttgaatggaagatatgtcagtgtgtgtgtgtttgtgtgtgcacacgtgtgtgttttatgttagaataaatcatgctactgggcctacccccatgttatcttccatgtaaatagcatgttttatgatgttcccaaaacaatgaaataatctttgctctgaaataatacctgctttaaaccagcactgtaaagttggaaataatggaaaacacgttcaaactgattaatgatgtactcagagaatggcgtattctgcctaattggaatttttgagtatctgaggagaaaatcttggaactcttaaattccccctttgttgttgaaatctttaaattcttgaatcctctttctgctcttagagtgataggccgtgttcattgttgaatttcttcttggtgactaggaatactcatggggccaccaggctaacagtaggtattgcttctgagcctcttcatttacaatgttagatttacatgaccaggttgaggcttcttgcctgtagttgtgtgtgctccagggcacggttttggaggttatttctgtaccccatttatcattttggcttttttccttgaagtgacatgcaacaaaggaagaacaggaccttcttaaggtcagggatgagatcttattcactgttgctagtaaaatactagcacttagtattgtacatggtacattggtcaggatgcatttttctaaatactcaatgacttaaagtagacatatttgaatcactaaagttttttaaaagtttgaaaagttgactttccttcctcttttccttttattgtctgaatttatcgagcatctcttgttctcagatactgtgctaggtactaagactacaaaggaggaaggaggttaacgtttcctgaatccctcttacacagcagacattgtgttgggtgcgtttacgtatattattttatttaatggtcataggggactatgcagtagatttcacaatcttcatttttaaagatgaacatatagattccagaagaattaggactaagattggaatttagattggcccattatacctattcttttgtccctgtggttcttgaatgtggtgagctgcagtttcctgatgaattctgcaaaaattcactcttctctaagacctcttctggacctagagtcagagttgaatctttagagacctgaaccactgaaaggtttgtggtgtatctcaaacttttgggagagcccataagtaattcagtatttttgaaaataaaatgtagaaataagcctaaataagttctatacagttctgaattttttaagatagtaacttgacaatattgcatatcaatttatctctaaaattctgtctatctcctctctctgtctctctttgctttgctaatgccctaccccatagtctgaccactgggtaacccagggagtccaaggccctgggattctgatgtgcagctgttaagcagtgcaccaaatatttttgattctatccccttctgggcactaatgtgtttgccatgggacttgtagttctggccaaggagttatgaacagaagcaatgtgtgttgcttccaagccagagcagtgagtcagtgagcaatacctccaaaattccttccagccagcaatctgagaaaaggactgttttgtcagcctaggttcctgaggctttcagtaatctgagcccacttgctgacatgtaatagtcatataacatgagttaaatggactttgttgttttaaactactgaaatgttgggattgtttgttatcacagctaaactgtgacagctgtatgtggaatccaccatgcaaggcacttaaaactgaattttgaagtattttgccagacaaatagggagaaaaaaggatgccagacagaaggaaaggcatatgtattttgacaactttatttatcaaattcttaatttttttcattttaaaagtgcttttagaagagtttgtagaagttggctaaataattttagtaggaatcataagtctgttggtatctcaggccccatcaaaggtatgtgggtatgacagaaaagagtttctagactgagcaggagatgatatgatggcaaaatacatttgaaaagttgactatatctagaacataaattacatataggacagtggtaggatatgaagtgatgtaaagttcctactttaactatgattattaacagtgcccactatgcactcctaatcttctgagcagagcagagccatactgggggctgtttctcaattttgtgaatagtttgcaaaaatcattagatctttgacaagtgcagttaagcctaaaacatttgccttggccctatttctatttgtcaccttctgatttctcttatatcaataagctaagaaagtgtagatgtgtggtagattcattaaaataaggaactcgtgttggtatataaaagggccaattgtgctgatcaggattctttgatatgcaaatggtagaaaatcaaattcaacatggcttaagcagagaaaatatatggcttcaagtaactgaaatttcaggagtagccttcaggcaaagctggattcagggctcaaacaatgtcaccaaggctcaaacaatgtcaccagggctctctctctttctctctctctctctctctctctctttctctctctttctccttctgacttttgttgattttattcacaggcagattggttcaactgctaccatcatcttgaagcttgtcttcttaactaagtaatcccagtggatctagcaagtgtcagagaattgatgagtctgtgggggtccaagtcttggccccaaacaactcaggtatccaagaatctgtaacatagtgagtagccagtcctgaaacacagtcccatgcctggaaagtgaggatgagaattcacgttcactcaaaccatgtgactgagagtagggtagagatgcctgctcaaatgaaactgagggtgttgtattagaagtgaggggatagtttatgggtaggaaaaaccaatagctatcttttactctgacgtctttcagttttgcagatgagggacctgtaaaatgatgatatgattgagaatgattatgtggagcaaacactgaactgagatttaggagacccaatttaggtccctatttgctgctatctggctatgtgatcaaaaccccaggttccttagttgcctcacctgttcaatggtagtaatgatgttcatccgctatgagatgccacagtgcttgtagtgagatataggatgttattcatatgatgtcttcagtattatttagccccttcattttgtagaagaggaggatcaagtgacttggccaaggccatattgtcagtaaatgtagaaccgtaagcaaagtctctctctcctcatattaaagacagaattttaatagcagttgtaaaagtgccctgggagagtttaagaattatgccaatgtgatttacagtttctaaaaagttgtttgtatagggaatttttgttaaagaatcttaaaagcgtagagcttactacttgaatgatttctatggttaatgatttgggatctttgtggaaaacctccaacaaatttacctttgttttggtaaatatttttcagatatctcttttattagagtgtggtcagatctatttattacgttattttaagatctgattttcattgttttcagcataatacagtggaaagagaccttcagatcagtaagacttgggttccaatcttggtttggctcctgttaagttttgtgactgtggcaagttattgagcctctggggacctgcaagtattcgctgtttatagttctgtatcagtatcctcaatagcattctaaacttaattcacactccatttgcaccttcttaaaacacactttattgtgatatgtcactctggaatttgtgccacctcttggctcgctttcctttcctcagacaacagatgatggagtgccttaaggcttgatcccagacattggcctctgctaactccccatcccccatccccaacccatctataccagtgccataactctgataagtggtttactaacacagttatatactacaccccccagctcagaccacttgtctaaacttcatgttttaaagatgtatgatctctgccctgaacacctgctcttctttcagtgtttcctctatctgtgagtgatagcaccaaccctcccattacatagtcacatatttaggagacattcttaatgctttcctctttttcaccctaaagtccagtcgattaccagactcacttgtttttatctactgagtatcttttcaaatcatcaactcccctccacatgttttgacatcctttagacccagcgtttcatgtttctcatctcaacgttggtggtggcctcttcacttccttcattctagctctctttaattggttttggatgttgtacacagagtaatctttcacaatgcaaaactgaacattttgccctcgtggccttggtgcacagtttctcattgctgtaaggaacaagatggatccttatcacagaccacaggaaccttcaggatctctctgccttctgatctcattttgcaccatgctgcctctttgtctccattcacattagccatccctcagtaacatatcttctagtccctcttcctgcagcattcttcccctactccttactagcttcacttagttatcgtctatcttttttttcagatctcaggttagttaccaccttctcagttaacttccctgcccagttccagtgtaatttccaatatgcattctcctaggatcatgtatctctccttttttgtaccctcacaatgctaattttatatttgtttgtaggatttctcaatgattctggacattttccccatgaacattgtatctctagcacctaataaactgtttgatacatatattatgtaagtaataaatatttgaatctcagctgttattttactgaaaatggaagatctctgaagccaaacagatctgagtccgtatcttggctttacttcttaattgctacctgactttgagtcagttacttgaattgtctggattctcagttctctgatctgcaaaaagggttagtaattctactgcataggttggaatcaaatgagataatgtagttcactacctagtatgggcttgtctgatgtaattcattccctttcttctttcctcccatccttccaatccccacttagaatagaataggttatgtttcacaaatgttgggaagctctttctttacatttttcctagcctttacggccatctcctcctttaacctggccgggcatctgcatgactcctactggatgctgttcagttcattagtgatgagtcatcaccatcctgtgtcctcttggtggtctctgcagaatcatatggcaccttaatgaccaacatttatgatgatgggtcatttgcagagagaagggagtaattggcttattttgaaggtacattaactcgctttggtcgctaagactagatgattaaatttcttcttagagtccccaaatagcatttctacttggaccctctttgatttaaaccaagtttcaatgaattttaaaaatccacattggtctgaccaagttagtggtttcctctcagttacattgattcccaaaatgtttcaggttgattgggtcaactttgtttgctgaaaaatatgtaaaataatttttttggatgtgattcacctggtcaacttacagaatgattaaactgggtcaagttaatttacctgttgttagatatatctcgcctcatttcctagaatttgaagtggttactattctttgaatagtagaaaattcatttctactattttactctatttacaagaatatgcaagtacagtaaagcagtagaaatgaattttaaggtaaaattccagtagtcagtgaaatcatggctagctagaaagataaaactttatatatgttttcttagtttatctgcacaaaccctaacccacagttagtactcaataaaatatagctatcatttttatttttgaatatctgtctatattcaactttgctgagtggtaagtagaactagggagattttagaaatgatatacagttatggaaaatctatgactgctgctctcagcttgggcgtatggacagctaattaaataaatcataaagctgtgtgatgagggcaatgtgcagagttgggtatggtgccataagaacccacagatgagggactgagggcatctctcagagaatgttgggcccttttgaatctctaatttttcagtttcctgtattttgggaagtggggggaagaagattagaagaagattagagtcttttcctttatctgaagaataaacccatgctagtttagataaactggccaaaagtcaaagcaggggagaatttttatctgaatttcttggccacaagtcttatataattagtgaaattgtgctgtactttttttatggagcagaagaagaaccttggttagttgcaagattcacattatccatgcacaaaaattatgacatttcctgggaagaaggagtcttttggattcagagctaggctactgctgtcactgtcttgtgaggctttactaatggacttcacctcattgaccagtttctgtcttcgcaatgaagaagttagaattagaagcccaaagttggcatgctatgagctacacttgatatgaagtttgtttttttttggctcacaggcactttggagactttaatttgatgcctgttggcagagtctgcagcctccagtttgccatgctaccctccgctcccttttgtgatacacccagccctctttacaagccagggagccttcagcagagcagactaggcaatacttcaagttagtctcaaaagagaatatgttagatcaggacttttcagagcctcaggaccctcctttcacatttgcagttgtattccaggtcccgttctctcccatgacagatctgcccatgttccagatgtggagtgaaaggcgttgttaagaaagattgcatttttcagctggccattgtcaccttcacctccaatttggagatgcttgtcttattgaccttttccttgtgcacccttggcaactgaaatctttagcacctgcacaaggccccagaggatcagttttaccagatgctggtggttcacaaatttccatgtgcatcaaaatcacttggacccaggtgcctgggccccacccttagagtttctgattcattaggtctcaggtagggcttgataatttggcatttctaacaagttcccagaagacacagcatccttcccgtatttctgaggtcaggaacatgcttttagaatcactgttctagacatttgggcaccttttttttttcttacccttcttaagcccacatgaataaaacaagtgactgtcaatatttgtatcattgtacatgctttcaactacaatgatgggaaaatatagcactctttaagaaaattagggaatgcagttatcaccaggtcgctcccctacgtcaattttataatcttcacttacataatatgtaagaaagcattttctatgtaaataaatttcaacagtcataatatttgttattatttaactgggttgaagaattatatattttaaagaattatttcagaagaaaactaaaaacttcagaatatctaatgcaattttgcctggtacacccctggcatatgggagccaataatcaaaatggctttttttaatagataagaaggaaaccccataaggctgaaacattgcctaattctattgaaaaaggccaaagccattttaacttgggtagattttactctacactgatcctattttatttcttattccccctttgaaaccatccttaactaacttaaccttggatgtacttattcttatctaatcaaaacctacacatcatgggctctggagagatattgctcaggttaaaatcccttctctacaagttactagctatggatgttggggaactttattagtctgttttcatgctgctctgaagaaatacctgagactgagtaatttataaaggaaagaggttttaattgactcatagttctgcacggctggggaggcctcaggaaacttacaatcatgatggaaggggaagcaaacatgtccttcttcacatggtggcagcaaggagaagtgcagagcgaaatggaggcaaaaaccccttataaaaccatcatattttgtgagaactcactatcacgagaacagcatggaggtaaccactccgatgattcaattacctcccaccgggtccctcccagaatacctggaaattatgggaactacagttcaagatgagatttgggtggggacatagccaaaccatatcagaaacttaaatttcgttgtacctcattttttttctatcagtataatgaggataacaatagtacttacatcataccattgctctgagaacaaattaatatacataaaggattgaaacaatgtttaacacattttaatattataatgaaattcttaccttcttcagctcgcagagtattttgtggaataatttgttggttcttaaaaccgtgatatattgattcctagttaatagaaaagaaaactaacacaaaaaacattgggattttcctgtgtttacaacaactaaaccatccctgtgctcagcgttctgagtcatgctacacttacaacttctacttcagaacttaaatatgttgtggtatcttcaatctgctatttggtagttgaaatttcatatcatttaaggaaatagtgtttccttaatgcaataaattcccctttgccttttctgctattttatcacatagggatggactgtacttcatatactaagagcccttcttctgggtagaagttcatcatctgaatcagaattgaatgacctatcatggtgaataataagtgtaaatttaattccacaagacctattaccatctgcttgtagataatggcacaaatatacatatctctatatatacacacgtacatatatatgtgtatatatatacatatctatatatacacatgtacatatgtgtgtatatatatctatatatacacatgtacatatatgtgtgtatatatatctatatatacacatgtacatatatgtgtgtatatatacatatctatctatatacatatatgtatgtatatatttgaaagtattttcttcttactgggttgtcaggacactttagagaggtttgttcttttctttttttttttgagacgctgtcacccaggctggagtgcagtggcatgatcttgactcactgcaagctccgcctcccgggttcacgccattctcctgcctcagcctcctgagtagctgagacgacaggcgcccgccaccacacctattttttttttatttttagtagagatggggtttcaccatgttagccaggatggtctcgatctcctgacctcgtgatccgccttgcctcagcctcccaaagtgctgagattataggtatgagccaccgtgcccggccgaggtttgctattttctcaccttggtaccaaagacagctttagagttggacatatctgagttctcctcttgactcctccactagctaactatttgatgctaattcttgcaaggtgcttaacctctcttgacctcagttttcccatctgtaacaatagtgtcccttggtggtattggtgaaagacagcaaggttaagccacttgcctatactcatatagccaataagtggcagagttgggtacaaatccaagtcttcgtgatgcagaatgctctttcttcactgttttcctcagtttctgaagaggaagagtttgtgatctctggtcctaatcccctgtggaacacgtgaggcttggggttctctgaataggggcttctatcccagcagtttgtttgcagtgggtaaggcagatgggctccattcttgggtattagcatgttcccaattctgggctggaaaatcaggcctgtctattcacgcagaaaggttatgaatacaaaaaagggtgatcattacataaaaggccagggtattgagactgctttgacttctccaggtccttctcccattctcttgttaccctttctgttccattaccttatcttcttgactttgattttcttttcaggtcttgacctcatttcatacttgacagcagaatttggcataactgattaattgaacagtctgaaattagctggggtataaagcatgaagcagttttatttttcttcaataactgccctcaactattcccttgacaacatcataggcagattccatagctttttagtgacttctgtttatagaaattccagtctaggccgggtgtggtggctcacacctgtaatcacagcactttgggaggccgaggtgggtggaacacgaggtcaggagatggagaccatcctggctaacacggtgaaaccctgtctctactaaaaatatttaaaagaaaattagctgggcatggtggcgggcgcctgtagtcccagctactcaggaggctgaggcagaagaatggcatgaacccgggaggcagagcttgcagtgagccgagatcgcgccactgcactccagcctgggagacagagtgagactccgtctcaaaaaaaaaaaaaaagaaattccagtctagtttgcgacttcagtttcatacccaatttaaagctctttctttttcctccttttagcactgtccaagctttggcctgagggcttgcaatatggggggagtacagtttggtttttcagttttgccttgccttgggcctgcaaatatttgccctttcatgggtcagtaaggtctgtggcaggtcctgtatgaccatccctttgcacgtgtccctaacagggagattcattctggcctggcctcatatctaatcactcctcctttttagatccttttcttaatagcgtgcctctgtagcctcttactgctgaagtctcctcacccaaccggtaactattttggatgtggccttggcaaagtggctcaaggctagttacctttcacagtgcccacttgaccatagaaaacatacattcttgacatggcagtaccaggacatgccagtaccaagagattattctgctgttgaactctttttgtcatttttctgccatttttctccagcatttttctctccatgctcagacacagacattggtagtttcattgcataatagatacccagctgaggaatggcatctcagcctgttcttgctggcacctccaatctcttagaaggtcaaagcattccttctgagctagtgactcataccacattatcctttctccctgagctgtcatttttgcttctatgcataggcgaggggatggagttgtaatgatttagatagcaacacttggagatggtgtctggcacctaattgtttttttaactttctttaggatttgagtacttggcttcatttcatcctcagctttgatactaattctggctctggggagaagtcctgctcaacatccaattgcactggcttctctggctcttgaccccaggtgcttccttagccatgctctgtgggtatcttctggtggtttccactcctggattccacagctcactattctcctgacccagtcctgatcttgaaaaccaactctggtgtttgcccaacaggtccagcattttcagatggcctctgattcctaggatggggattatcctaaggaagtattcagacaccatgatctgatgagagcctagagccatgtgccatcacaaggggagcaaagtcttgcctactaagggaacacatgccctggactgcatttccctgtctcattattcctgcctctgacaccaacatttctggagactgagatttttgttgtaatgcattgtctttgttccagcagatcagggactgggcagagttgtagaagtccactgttttactgccactgagatttctaaggtggattttcaaaaagggagagacaacatatgtcaacccttattgagtgccttctaaaattaataatatgctcttatttaatttttgtaccaattatgtgcaataggtgaccttattcccattttaaggaggagtaaatggaggccctgccataggcaagtcacatgctcagttcagctagatcttgggctagaattaaaatccagattggtctgattccaaaattcattgctctttcccctacataacaataaaacaacaatggagaaggcatgtctggccaggccagcacattgggacgtgcctcggattggtcgtttgtttgcatcaaatggcacatgcctcagtcaatgcctcctggcgctgatcctgcctgcctttaggtgtggctgcttttgaactggaacctgctctgggaacgatactcgctagtccacactgactttccattctccaggcttatcattatgcatgttacttgcagcagcagaggaagttaatttggcagaaggaaattaaactcatctcttattctgcattctcccagaagtgttgtacttgaggagaatcacattcccaaggtgacaggtattgtacagaaagggcataacaacccctctccttctttggttctttcaaagccagtgtagcatgcaaaaaaaaaaaaaaaaaaaagttgaaaatatttgtatttaactcaataatgtttttaggaagacaaagatatttacatgcaaggttattaattcagagatacaggctgcttaatacataagtaagaacaatttctggggcaactctgtaaacagggcttctaagatggggaggccaggccaggagactgtttcaatttaaatgtgatctcaattactgaatgcatacctaacaaagaggactgggtttctaagtttcttgcttaatccatgcttttaatttctgtgcagtccttcaaaatgaattcgttacatatttcactgctgtccaggatgctggatgctaggatttgcagtctgccagaggattgaacgtttttgggtattttgttgttgttgttggttctgttttcaattttagcttgtggaaatttagcctgtagggacctttggaaattatttcaaacctgctcgttttgtagattaggaaaggagatccagagaagttaagaaggtgggttctagttctgttcatagttttttgtcatttataagtctgtagccttgggagagtcttttcccttctctggccttgaatgggtcaaggtcaggtgaagagtaattggtactgcctggagcataaactttgtcttctaaccaatgtccagggctgttgccattggattggaatgactgctacttccctaggcaaaagtggcattttttttttttttttttttttgaaacagagtttctctcctgttaccgaggctggagtgcaatggtgcgatcttggctcactgcaacctccacctcctgggttcaaaccattctcctgcctcagcctcctgagtagctgggattacaggcatgcgccaccacacctggctaattttgtatttttaagtagagacggggtttcaccatgttggccaggatggtctcaatctcttgacctcgtgatccgcccgccttggcctcccaaagtgcaaaagtggcatttttgaccaccttctagaagctttgtgttaggcggtttgtggcaatcattgccttgtcatactttcctcttttaatgaagtgagtttccacctgtctagaatgccatccttactttgtatgcctggcaaactcttacatgatattcatggctcgatttagaagctatctccttgaaattttccttgactccccaggcagacttagattttctctactaagtttcattttatatcatctactcattataattccacctaacataatcatgatgtcatgattgctgagtgacacatcattcaccacaatgggttccttgtgggcaggggatactataactagtttatcactggtgctcaatacttgtttgttgactacatgaacacacagaaatgggctgtggtaaatttgatggtaaggcttttgttggaagcatcccatcacttcttaattagacatgatggccatggagtgatttgggctagtgtccattagcttggtcagtgaacagagtcttaatgaatatagtaaaatgtacattcatccctcagtgtctgtgggggattggtttcaggaccccctcaaggacaccaaagtccacggatgttcaagtcttggacataaaatggatagtatttgcatataacctatgcatatcctcctgtgtactttaaatcatctctagattactgataatacttaataaaatgtaaatactttgtaaatagttattatactgcattgtttcaggaataatgacaagaaaaatgtctgtacatattcaatacagacacaaacatcaatttttttccccaatatttttgacctgcagttggttgaatccatggatcgggggatgggggacccatggatacagagagctgactgcattgtctttgttgccaaaaaaaaaaaaaaaaaaatcagtacgaatcaggcattaccattttatgcatcctcaataatatttgatgacaaatatgattctaatattcctttatattttcaaagatagaaatgcaaagataaactgtggtaatcatgtaatccctatctagcttacaaaataatgttctagctaattaggacaacttttaagaaatctattttacttttgtgcatttctatagcataaacaggttcagggccttatattagcttttaagccattattagttaggatttgaatgccaggtttgaaaacacatacacctatttcctccccatacagcacactatcaaaaacaatcatggtacaaactcagcaggccagttttgaaaataagcactgagtattgtcatgaaaaaacatgaagattctctgagcagtcaaagctgcggtaaaagaaatttgatgaatcttatgttagacataacagttagaaatatctgtagtgatcagtgcttctactggctcacaatagcatgccaatttttataatctgatgtattgtttactatgattcaaagagcagaaagtcaatcagctaaaagctatactttgacatccacaattaaaaacaagaaagaacaacaaataaattgctaatgaataaaaagtttttttaagttggaaaatgtaaaaccaaggagtggaaatttgtagggaaaatgtaaattacatatgtccccaaagtggtgaatatataatatttatcctcatgcttgcagtagatagattgcttacattttccaaatatgccattgtacttacattttatattacaagtgccaggccttagaagagctaaactagaattatttgttgtcccctggagttactctagttattttagtgtaatatcctgctgagatttatatgaaaatgaattttaatttctaataaggtaaccatatgctttggaggctgttgcaataaaatgtcataaataattattgtttctaacaaattccaccttgagacaatcaggtcttgttttaacagcccatgttagacatggattttagccattttcatatttccaccaccctcaccttgcagtcttcaagtggcaacaggagagataccctggtggaaactttttttctctttctactcctcacctgcatgatgttattttgttttagaattgcaagcttcaaaaggaggcagatatctaacagacttaattttctggttttttttttactcctaattgctgcagagaaaattgatcacattaggtatagtgtgtgtgacttgtccagaggaattaactttgctcatccttttcttgtgattaatagttaactaattttagtagctgtaaataactaagagttagaagaagcaataaaaaaatcagcttctggctgggcgcggtggctcacacctgtaatcccagcactttgggaggctgaggcgggcagatcacgaggtcaggagtttgagcatggtgccagcatggtgaaaccccgtctctactaaaaatataaaaaattagccgcacgtggtggcgcatgcctgtaatcccagccactccggaggctgaggcaggagaattgcttgaccccaggaagcggaggttacagtgagcagagatcgcaccactgcactccagcctgagcagcagagcgagactccattaaaaaaaaaaatcagcgtctataaattgcttcacatttctacatcccagaagagaagagtggctccagttctcaactcagttcttcccctttgttatttcccttcaaccagctttctttgccttattgtgtatcaatcaataagtcaatcaacacatatttatgtgctgctctgtttcatgctgggcagtgtgggatatcaaaaaagagtaagacatgatctctatcttctgtaaatcacctccttagagctaatctggctcactggaatgctacggaatttaagttagggaggaattcagagaaaagttaggtcactgggcactgaactagatggaagtttcatgaagaaggcaagggctgaagaatgaacgagatttggattaaaggacaaaagaagagaaacattttgtgctcattctacaggggtttatttttacttaatgtattagtcttcaggtatcagggttgaaattattaccctgccatttaatgtataagaatttattttcttcagtatgatctcattctcattccctgttcttaataaaaggaggacctgtgtgattataggtccttggatctcacttaacttaaaactgttgtttggatggactcagctcatttaggtaagctaagtattcagcttattcaaagtttaaagcttcctcacagcttttggagacctcctctttcccttatgctcaagatagtacttgcatgttctgtcagaggactggagtgactgatgtaattcctcttacccagtctttgggtgatagtctttgttcttgctgtagcctagcatgggtttccatgcatgatgagtgctgccaggaagcctttctatcttaaccactatgctcccacctctgctgtcactggggctactgattctccaggacctaatttcagcttccatttgctcacctgcctgggcggtccaccttgaaatcatctgtatctcaccctgtgactcttccctggtgacctcagcagctggatactcagtaagcttctcatggtggggatgggaaactctggatccctttcttcccatatcaggagttcagggaccctggatatgccacatccccatttctgttaaattacaacttttttctgtgggcatgggagtccatctttagaggctctccttctagacttccagacagcaaattgagtagcaaattctttgttctttaatcctcctctgccctctctagggtttttatcttcccgatttacccatctccgtaaaactgaacagttggaggtattaggtccttaacacctttgttctccttacatcctctctgaatctcccccacctccatatcctccactggaatggcttcaacttccttttcctatattttaggaacttctcctacatcatatttcttctttttccctaccccatgagcatatcgtccattttgcttttgcaaaaaaactttatcctaaagatgagagaagctataagggaagaaaaaaacaacactgtaacaactagatgattaagaggaaaaacacatcaaagtgtatttcacaaaatttgtctactaataaatacaatgtatgactataaccaaatggtacaataatatttgttggtttccaattcaatgactattgaaaggtggtgagtgctttggatttaagagtttaagtttcctatcaccatgtcagtagtatgggtgagacatggtaagactaaacattaggcatcataaaaaagctaaaggacaagatacagtaactcagtggttcgtctgtatgttacagccattccagagcactgggatcagattctatcaccccaagtcaggctgaaaaagagaatgatgctaaatgtagcatgttatcattggtggggattgtggaacagaataagggcattagtgaaaaaaatctgtggaatatgaatataatttggagtttaggtaatagtgatgtgccaatcaatgttggtttcttagttttgacaaactcaccatggtatataagatgttaatataaggggaaactgtggtagaggtattcaggagctgtctgtactatctttacaacttttttgtgtgtgtaaaattattcccacgtagaaagtttatttaaaataaattatttgggatcaggcacggtggcttacgcctgtaatctcagcattttgagcattgcttgagcccaggagttcaggaccagcctgggtaacatagcaagaccctgtctctacaagaaattaacaaattagctgggtgtgatggtgtgcctgtagtcttagctgctcagcaggctgaagcaggagaatcacttgagcccaggagttctaaatttcagtgagccatgatcacaccattgcattccagcctgggtgatagaccaagaccctatctctaaacaaacaaacaaacaaaaaatgaataaaaataaaaaattaaattctttgtacctatggacaagcccacaagcaacaagcaaaatgcaaactattatatttcttgttacaatcttcttaaaattgttaacattttccatctcctgagatttttagaatattttaaaaattataagaatattaagaagtgaaaaactctcatatttctttgtgtatgtatatatgtgtattttcattgttttacttatagccctgttttcaataaatagctatttagtaaatagccatgcagatattacaaaagagagagaaaaatgttgattttctaacactcctgatagattaattttccctcagagtgcaggatattctgcatttagtttagataacataagctttttttcattttgttttagccatagctgaattttgtttgttaccccttctgaagtttcttttgctaagatatatttttgtactcttagtttacaatttttttttccacagtgaggatggtgacaattttcattaaacaccttataaatagtcctacaccatctctatatacctccagttctgttattatccaaatttatcatctctcctaggtgtgtaagcaccttgacacaaaatgcatcttgagaactgttaagccaaagcagcagctaatttaacagctttggcttggtcaataatgttgaccagtaggaaaacatcggctgtcttccatcttcctgctggtcagcattattaactccacagtttaatgagtgagcttgagaactgctgcctgtgtatgcttctgtagaagatgagattggattaaattcaatctatataatgccagggatgatgaaaattgcatgtcctcttacattcatgtaaaaattgcttttatggagctcttccttctttctgtaaactcagcctttcttaaaatgaaatatacattttcaataggaatcagacgaagggtgacttctaccattacttgaaaagcagcaaatgcaacttggacaaaattaaatgagagttctatcacacatttggctaagttcaggtttgcaaaaaagactcatagagtccaagtttggtgtatatggtggtttgtgatgttttacattatttgccacatccccatgctaagtcaatgatggatatcaaatgctggggttaaggttccaagcctgtaagactctcagaaaccctgtcatggcagaattctgtacgtaaaagagataccacaaccttctgtttagttcctttgcttctttgtttgccacattgcccatcattcttggctcctatctaagatttgggactccattaagctttaatgtgatgctactgtctcatcctcacctcagtctgtccatagctttgcttttgttctacatgctagttcttaggaccctggctgcactctatgtggtgtatgacattttaaatggtgacaaccacctgttgttctgttccgtgaatgtgggcttccactcattgggcagaaagagtcctacctaagagactcaacttattccttagactttcctactaaaaatgtgtgaccagtttgaatttcctttgatcacatgctgttttttatttccaaagcatgagtatgagtctttaggggaagttgaggagcatccattgaattcaccctcaaaattagtagcctatcccctcatatgtatcttccagaccttgttttctaaaaagttcattatataaaacctttggtacccttgcaaaaaaaaaaaagccccaacttcgcttgagtcttccaactttaaaaggtatggacttctcttgatttgaattttcagctgttttaactggaaatgtctctcagcttcagtcaattaaggtagcttctgttgttgttttcttcattatggtgttaaagttttagctctaatctgccacctgccctgtaaaggacatcgatactccagagcatgtttgctaattatatttgattagttgaaaggtcatatgaaggttgtgtgtgtgtgtgtgtctttggatggggatgtctcagagcactaatagatgatgttcctcagatccaccaagggtaaataaatggagttgaacaaaaggtgttggcaatgattgactaaatcacagtgaaagatgtggatctggccttggaaaacttttctacttagctgacattcttagctattgtttgaccttgaataagaatcttaatcgcaccagcacggcacatgtatacatatgtaactaacctacacaatgtgcacatgtaccctaaaacttaaagtataataaaaaaaaaaagaatcttaatccagtttactgtgtcagagggtggtgagattcaagatcattataaagtgtttgtgtattacctacttaagggaacctttatgaactttgtcattcaaataatcttttcggaacccagagttaaaatttcccagagctattgttgtctgttgatctttacccagaatcctctgacgaaatcagattcccaatctagcagttaggacatgacataatgcacttttaaaaaagcaaaaggaaaacctaggaaagacaaagccagctttaagtcactttcaaagtctcatgattttcctgaagtgaggagactccatggaaaagagtgatataatgcctccaatttatctcaatggagtacatttgaccgggatttatatagatcaaattaattgcttttctgcaagatacagcagaagatgaggcttttgatagacatttctgaagttaaatattctttatgcagcaggatgttaaaatagtactctttctgtcccatgggtggaagcccacatgcgtagaacagaatagcaggtggacactctactcccccattccagacaagatcaggcacattcagggtgttatggtcgtagacagcctacagcacccggtattcccaggaggtctcccatccaagtactaaccaggcctgaccctgcttagcttccaagatcagatgatactcccccattccaaactggaaatgctgggccatgtaagcagggctcacaaagaactctcttttcttaaactaaagtgtgattgaaatgtaaaactgtccatattttggggatgagtatacactcatgaaaagagtagcatcttcaaggccatagctgtatcaatcaccttccaaagttttctcctatcccatcattattattattgtatttattattatcctgtggtaagaactcctgacttctcactttattctattaagtggttggaaaggtatgaggggagctgaggattaaataaaacatttatttggacaaagttgttaagttgttcccactttttcccacattggaaaggggagaggtggattctgtcttccgcttaagcctagtgagaacagcctcaaggatgctctggagaagttgtgcatttcccagagctaggggaagaccgttcactgatgtctgactcaccacttgccaacctgaagagtgacagctgatggaagcagccctgggcagcaggctaaggggcatgaatggaaaggatctgcacccccactggagttacattccagatatccctggtgtgttatttgggttctctgggaagcggatgctgagaccgagctagaggggcagatggtttattaagaaagaggggaatgcctatgaaaaatgaagaggaaagaaagaagcaaaatagagaaaataagagagcctcagaccaaatgtgaatcttacaaagtcttgggcaatcaacggggagctcccacattggaagggggagaggtggattctgtcttcctcttaagcctagcgagaacagcctcaaggatgctctggagaaattgcacatttcctggagctaggggaagactgttcactatctgactcaccacttgccaatctgaagagtgagagctgatggaaacagccgtaggcagcaggctaaggggccatttgaatgaagagtgtctgttagagtcccatgttgggcaaaatggcccagccttagtacccctgtaatactcagtcattggttgaagaacctcagctctgatgccactgtagtggattccagggctaatgcacatgaagtctgttggctaactatacttttcacaactgagtagcaaggtctttcttgaagagagattcaagcagtgtacctctatgggtactgggaatggcaaactgcctctccatatatttcacagccatttcagcatctctacagctagcatttcagaggagaatctacatatcgaagccataaaaggctttagactagaagaatatcaaagctgagcaagaatatattataacagttacctacattccttttgtaaaaggaaagtctgtgcagatatttggacattctgactattccgtctttggtaaatattatgcctatagcagggaaatgctgttagtggggttgggcttgggtaggtgaatggtagattggaaagtctttctgtttgtctggacagattactactttctgttttattagaaagctttaatcagaaaaataaagatagataggatactgcagagcaagggttagctacacttagggacttcctcagccagaaaagtctccatgggcctgcattaaacctgcctctacattccatccaacaacagtctaccctgctccatccaaaaaatatggcagaaagaggttctcttgtctagggttctgctttactgagagaattgcctcatgtattgtggatctaagccagtggaaaaatttcctcttcttataagtcaccttggtgaggcacagtgtccttaaacttgttcttctgccaatcctatttccacctgcagttgtcacactctgtctcctgacaatttcacttgcagtgaattattttcagcaaactttggctattctaggagcatccatgaatgctaagaatttatcttaattcccccaattcctcttcttcttgggttttgcactgaatccttaacatgattatattttttaactactaatagaattaatattaaattaatatttcatccattagtggaattgatttcttttttgtatttttaaatgtgcgatctcttctcatctaattgataattaattgaataagcattttctattgaataaacatttgctgagcatttcctatgttccaggatctgtgcggaataaatttgggaataaactaatttagatatagtctccaacttcaggatgctcagtctttagcttttcctgcaaatcatgcctataaacatataacttcttttctgaaaaaatgtgttgtttttcccatttagcttaatgattagatctctggtttcttgacagagtggggaaataattggtgaacaactacctctgaatcaagatatacaatgcaaagaacaaactcaaagtgcatcaacaatgcaatggttactaaaatgccagtttttttgctaggtcacataaatcttgtgctttggacatcctgaaaagtttaggcttgcagaagtattagaggtcatctagtgcaaactctttattttgtggtacagagacaaaagcttgaagagaaaaaaatgtcttgcccatagtcatggggcctgtaaatgaaagagctgggaccctgtctccttctctatactctgttttgccctgctgtttttggtacagagacctatggacctgtgtcagggaagctggaagagattttgtcacttggtaagctgcaggatgagttggatccaaggtcctcctctctgagggtctctgactccaagaaacaaactgtgagcactaatgctagattacctttttttaatttttttattttattattattatactttaagtttagattaccttttgcattatccataaattattgaagttcagtacctctaaactttgtagattcaaattctcaaagttgagaagtactaaatataatatacagatgaatattcttctagataattgtggagtgatgaatgtgagaaaaatagaggactcatacagattttcttgcactttccattgcccttgaatctcttcctcaacttctctgcctgggaaacttttattcatccatgcatcactaatgccctttgatccatcttgcagaatagattgttgtcccatctgtgttcctatgcactttatagtacttgtggtactaaggtttagttattttagttatttctgtgactctccctggctgtgctgtgagtttgagtggcggggaatagctgtattcatctttatgtccctaatgcttattatgtgtactggcatgtagtagatgttcaaaatgcagtaattgaagtggttaataaaaactaattaattagagtcagtctagtttagctaatattatacattataataaacatttttataatattttaaattataaagtatttttgtttattgtcttgctcgattatgattctaatatcatccccatgagggagttgtgattatcactgtttctataggaaggcacagaatcagagaagccatatttaatgttatctaatgagaaattgagttttccacccatccgggcatcagtccacatgccttggtctccacagggaggttttcagataccaggtatggattgctagtagttggataattttatatgtccatgattaagtgagataagagtaataaaagtgaagttttttaaataatgctaagatacattaatgtatagtgctaagattatgttaagatgaagggccatccttgtgtgtgtgtgtgctaaaatgtccccttttaaaataaaattagagtggcagcatatagtatattaaaaaatcgtgtgtccaaaggaacattggctgcaatttgtaagacatatattattaaaaataattttttgaagtgttactagtctgctaaacctcaaagcctaggaaccatagctacctttgtggaacacctcaactagttaattttttctatacctgtcttttggaagcaaataatgagaaaacaggcttatatcaggaatttaattaggataacatccatccaaaaaccatttagggtgtgtcctggaataagaatgtactaaatttaatttcttatatttgttttagctatagccctgaaaagggagagctcatattcagaataataactctgtaggcatgtcattcttatcaacttgtgtttcattattatatttaccaacatgagtggttaaaaacatcgatatgatgattttccacaatatggtttaaagtgaggtttacttctacttctcatttaagccacttaaaattaatattgtattatgtccagagcattgtagacaattacatgttttgtttctgtgtttacaaattaggtaacatcacagatttcactctttttgacttagaggctaatgcaacagagtgaatgtggttttatctcaggctacatttccaccctgtggctgttcagactggacagtggcagggtttttgccagggaaggaacattgttggttcaccagactggtggcatttagagcccagctcacagcacaggggtgctgctgcttgattgctggcattttgctaccttctggctcttgtctttataaatgggtagcatgtatttccaatctcttctcttgttgataaagactgtgttcatgagcattggcattaacaacacagttttgcagcctgaggttaaaagctttctgatgtctcattaactcacaatggcatttcatttttaatattgtctgtgcacacttgcttgaatcatcacagttcaaatgactttaatttgcagtggcaaacgtaaccgtgatggattctttagaaatacaaaccagagtggtgggtgccaccacggtatacttattcttggttaatgccttttcaaaatattaggaacatctcttctgtcactggtatagcaaagtagcaatcacataggctttggacttagaccaactgaggtttgaatcccacctgtgtcagttattagtggccttgagcaactcacttcatctcctttaatcacagtttcttatccattaaatagatataattgataatttcatagatttgggggggggagtgggaaattaaatgagaaaaaaatatatacttagcatctagtgaagttccaggatgagatctgctatggtttgaatgtgtgggtctgctatgatttgaatgtgtcccccaaattttatgtgttgaaagcttaatccccaaatttagatgttgatgatatttagaggtggaggctttggaaggtattagaattaggatgggggatcccatgatgggactggtggctctataagaaggggaagagggacccgatctgatatgctcttgccctctcaccatgcgatgccttctgccacgttataatgcagtaatgctgtcttccccagatatagtcccttaaccttggacttttcagactctagaactgtaaaaagtaaatttctttttcttattaattacccagtctgtggtattctgttatagcaacagaaaacatattaagacaggatttcttctgtatgttattttcctggtggtattcaaaaaacatttttatcaaatgctttgcctggaatctctaagactcagaatggcagcatgcatagtcagtctctcgaatccctttttgttttttctttccccttggcgcttataagtttcagtgacacggtctctttttgcagctggctgaagagggataagacccccaacgcctctcagggttgaaagcttcaactacatcatgtttatctgagagcttggcgttggagttttgaccactgtgatacaatactttccacttggtattaccctttacaagactgttgtctctgacaaccccacagggaagcgggcaggctgggccaaaggaaattctttggtcttagagtgaaataaacatcatctctagcaacctttaacatggtgaataccttagaatgcaaagcacaaaataaagatcgaagttaactttgtatggatatctacctgttggaggggtagctggtgatatattgatatatttatatataacaatctagaagcaaatgttggctgaccctgctttattcctatgattagaacagtcacaagaataggcctgttctcttgagcaaggaaggattctattccagacttaatcctccatcctgtctcataagtagggagacaagagaaagcagtcaactgcacctcacatctttcccttatcctcttattgtctggttatacattttgttttcagtgttgagggtaggcatttctgaaatcactagaacctttaaacttgctacaaatgtcagtttttagtgatctctcctctgcagaagacataataacatgtgacattgataggattggggcattcacaaccaatgtgtatgtgtatgtacacacacacagacacacacacacacacacacacacagacagacacgcacatcaggcatgcagtgagaaactgcagaaatgattgggatgaaagttagtcttagcctggggccgctctctgcaggaactgctgaaacccttgcctggagctttttgcatgcatatcttacactctctgttagccttcctcactggcattctcttctcactctaagatttctttttttgttagaaacaaggcagccagattccatccttttggtgtctcggtgatgggtttgtgtaggagggacacctgtacattcacacttacttgcaattgtaggtgctatgcaattatgacttaacagtgagtaattttaacacatccttccattctcaaagaacaatgataatcggatttagatgcccacttacaaaaaagacattttgaagttaaggtatggcccacttacataagatgatttttgtaacacctcagatacatagctaaagatgtcaatatgaatagaaatatccacatttgttaatttgcaaaggctcagatgaagttaatgcctcaacctgaagctttctgtgatttgtcctagagacatatcaaggaattcagagctcagagtgattttataaatcatttaattcagactcctcaatttatggtagggtaaatggttgcttacagaagtgaagtaacttgcctttaactacttggtaaaagaggttggactcgctagctctcatctcctacaataattatatctctgaatccccaaataattacagactgatcacacattttggaacttcttacattactctttattgtttcatatgtgcagacttgtctaacctacttcattgaaaatatttaacgtattttcagctataccttaagtgtagctgaatacaaactacatcttaaatcctttctattatgaaggctaaattgatgctaattatttagtagaaagattcaatgaatatttatttattgactaaaatatctaagtattttgtctgcatgattctaagtaaagggatactaggacattttttcttaatgtctgaatgtttcagatttctttctaatatatgggatctagtcagactgggacaggcgctgtattatagtaatttttagaatcatagtaggtgctgaaaaacatgtttattgagtcaatgaatgaatgggtaagtaatgaaaaatgtgtataaagaactaataaggagaaaagctatggacagaagtgtggtgtgggagagataattatagggaaaggttagctttttgggagacctatacccatcctcacatgtatcccaggcaagaatgaggggcaggtgaagtccagaggtttctctgtggggtctggggcagagataactttcttttgtatcatagtaccagctcttctagtaactcattaacatgcaattatgatttaacagtgagtaatttaacaaaagtaatttaacaggtaagggaaagtagaatttaacatggaggagaagaagaagcttctaaaatactgttggtttcgaggttccatcaactgcagcattcagtgtgtcaagtaaggtagagtctccaacgggatccaatcaggttcatcagggagagggcaactgtggcaatttgattggtgggacatgaatgtttataaacaccttgatgtccatggacctgtgtttatttggtatgtgtgaaactgttgtgctgcaatttactgttggaatcatgacagccacttttcatgggacccaaggatgctcatctctgattcacggctgcctccagcataattcctggaacattaattcacctgattgagcattctcctcggcattgatccatccctatgttgtttcacatcaacttctatgtagcctcatggcaattagtatcacttgttcatttattcattcatccattcagctaacagtaattgaaggtcttctgtttgttagatggcatgcaaagtgctgaggatataaagaggaaaagatgcattgcttgtgttcgtggtgctcactgctgatgaggagagtaataaaacccaaatccaaatttgaccctgtaagttctcataggacacatctgtggctcacagtgaggcagagggtatcacaggcacaagggtgcataattggttacccagagctcacatgcaacgtggcatttcttctgcttgaaatcacgactacccagggtctgtgtcttgctgcctcagaaatctgattttgccagtttgctgagaagagttccgtctcttagggacaggattatatttgacatgcccgtagaacttgattatatatgatatctcagaatgtcaattcagtaatttacagtaactgtcaggcaggtcagacatttatctcagactaggatattctcaccttgaagggaaggaaaaaatggtcagaagcttccttaacgagcgtgtgctcagaggaaggtttaatagcagtgggttctggtaggctggttagtacatcacaacaacatgcaaacagagtcaaggggtggcagtttttgagcaaccatcagcaccccctccccctccccccacccactgttacgggccctgccaacttgctaatcttctccctgtgctgtgggatgtggctgtttgctattctggcttaacccaggaatggtggtgtgaaggatttataggaatggattgactgcatctctctcagactgtaccacacaaacatttttctcttagtagagcattgtttaattcatataattcatgtattaatatgatatgtgttacatggcttgtgatgaaaaacagcagtctactgctcactcctccctattcctcccctaagaagtttcttcttaagttgcttctactgtttacttccattcttttcttctaataatgtgcttgtattgctatattttatacaattttatttattatctattgcctttctcttatagtgaggattcagcttgctaactaccccttgctccaccctccctgcctgtctccttctctttccaagttctaatacaatagagctaggatcaactggaagcttcaggtgaggtttgaaaggaatgagcttgcagttataaaccccaatgcctggggcataatagaccagtgtgcaaaatctccattctttgacctaacagctgactgaagacacgttaatttacaatttaggaccctggtttccttcttcctcaaaatcaaagtggtaatactcgctgtctagaaagtgagggtgaacaataaaatacatttaaagtgcctagaactatacaccttaaaaataggctaaatagggagtaaagctgaggggctcttttgaaaagtgaggtgccgtaaagcttgactaggaacattttttactagggaatttttaaggcaggcaaaaatactccctttccctgccccagataattagaaaacagcaaactgcccttagcttccccagtcttgagctgtgtcaccttgtaaagtactgttctaccttgggctgcccagccccctttctgttcagtctgtctctaaacagggtacaatgccattgattagacttccttctgcttagtaaattacaatcatactgcacttctccttccttgaaattactcccaaatcaccttgattgggggtttcaatgttcctggtttcctcagtcaaacatttacagacattttctagctttatttccccagatggttaatctcacacattgtatgtggattttatgtatttaattcccagctggcaattttatttcccctatctttgcttccttaaaatctaatcaaatgcagaaatcaacccaagaatatcctctatgatgaagtctttctggatctcctggtctagcccagagttatttgttattcattttcattgacaagtccctttcttcctgttacaagttggattctctggaagcagatatggctgagatggcattaggggtgcaaaatatttattagtgatcaacacctatgaaaggaaaggggaggaagcaggattaagcagagagagaagaggaagaaattataattctggcatgacaaagatcagtaacaaatactgtacctgagtttcctatgttggaccaaaataaccagacccttacacctttatacctccacccggctccccttgccagatgcagactgccctggggagattgtgtcctcagaccaggcatctctctggagctgaagtggaccctgaaagaactgacagctggggaatgtcggctgattacactctctgcagttgggcagcaagtccttccatgaacggagatcttaggtttccatctttgtgcctactgcacatgcagagtatttcttttaggttcttagtgaacacactcatgtgtatagttaattgattgttgtctaccttttccacaggcctgtgagctccctctcactgatcttttgttcctcgcctccaccacttagtgcataatgaacatccaataaactattaaataagcattccacaaataggcataaaaccagtgtttattttcatgttcaacttctggagttatttctatcactgtattcatcaccgtaatgtgaagtgtagaaaactattttctgtgcccctctagggtgccaaccactgcgctaagagcttctgggcaccatgctgagagcactttttgggttaagacctgtgttttctctggcttccatattaagagtccaacccaatgtcgaataacataggccacccccaagttgagccccactgcagccgctctacttttcagttgctgccgcactacagtaaggagagtgctctgctccatccagaatgctctgttttttacagcatcctggccttgcacatcttcatatggtttgctttgtttattccaaccttgagagcatatgttagatattgtctgtgttcaacattcagagttgttctccctgccagccttccattcaagaccacacagttttcttctttcatgacctccctttctccccagttagggccattgtcttgaaattagggtcatcagaaacctgctcacccccatcctgcatgggagtggctggcatctattaggacaagctatgatccttggtctctcccattgtaactgcctgatgagaacctcttgcccactgtccagatatgccaatttatcaagacaggggaattgcaatagagaaagagtctaatatacatacagttcgctaaaaatgaggctggagttttattattactcaaattaacctccctgaaaatttggaggctagagtttttaaagatagtctggtgggcagagaggttgggaatggcaaatgctaattggttgggtcagggatgaaatcatagggagatgaagctgtcctcttgtacagagtcagttcctgggtaggggccacaagatcagatgagtccatttacgagtctgaatgatgccatctgatccatcagaatgcagggtctgaaaaatacctcaaacaccaatcttaggctttatagtagtgatgttatctctaggagcaattggggggattagtaatcctgtgccctctggcttcatgaatcctgagccgtaatttctaatcttgtggctgttttgtttgtttttacaaaggtggtctggtctccaagaaaagaaaggatttgttttggagaagggctgttatcatctttgtttcaaagttaacttataaattaaatttctgcccaagttactttggcctaagcccaagaatgaacaaagggcagcttggaggttaaaggcaagattgagtcagttaggtcagatctcttttactgtcacaattttatcactgttctaattttttgcaaaggcaatttcatcgtggccctctttttgacctcataagcagaactttggccacccgctgggacctgctggcttatgccctgtgttggaatggacacttgagtcaggccctcattctggccacagggtataggaaatagtgctccaggaagattagagctgcttggagatggttgagaggggccaatttggctccaaatattgaggcaagtggtgaaaatggagagctgcagcactgggctatggacaaggcatccaaggaagtaaccagccagaagatatcacctgcctatggcagctgcctaaatggactgctgaggaataaatgggtcctacgttatctgctaaggatgtatttcccctctttctctcttttttaatgagcttcttattttagaacagtttcagagtcacagaaaaattgtgaagatgtgtacagagcttgcagtcttccttactattaacattttacataagcttagtacagtacttagttacaattaatgaaccaatgttaatacactgtgtttaactaaagtctatacctttattcagatttccttagtttttgcctattgtcctttatctgttcggtatcccattcgggctaccacttatatttagtcattatgtttccttaggctttccttgcctgtgacagtgtctttgcttttcatgattttgacaatattgaagagtactggtcaggtatttttttagaatatccctcagtttggatttgtctgatttttttcttataattaggctggggttatgtgtattgaggaggaagactcattgatatttattttacacttagggttataatacaatactgctttattttgtttctctaattgttccagctttggcaaatggaggctgtttcagttgactcttctgacagggattttaagtttgactcaactaagtcaactcaatgattcagttggatttgatgtaataggcaactgggattctgagtaggggtggcctgcactcttactgcctttgactatgactcgatgcttccacttggcagattgcatcaagccatgtgccctgcaggtcttcctatgttctaaaatagaaattcttggggtagagccaagcttgctttcttttccttttcttttctccctgttcacactgtaaattctgtttgaaaactaactgggaaagatcctttctaagacagcttaatgaagaaatgtagttgaatgtaccactttctcagcccagtaatgctggcattcctcagagagtctgaacttttcctaaccaaaactaggttacaaaacgaatataggtttcatattcacagggttgataaacccataactcaatgcctgcttacctcctggtttcagcacttatatttctgtaattatttgcctgcaaattgctgtaatctgagggtactgtgaactcttggagggctgacactatgttttatacatatttgtaaacccagtgtctaacatggtgctatgttagctgcccaataatgttgattgaataaacgaagaatattggatggggaatgtaattagtttgtttatccaatttaattaacttgaaatcttataatcaacatatatgatgaaattaatattcaagcaaagttatagtctccctgcccttgttgtggttatttcattatgatgaacctcttaaagtacttctgagaaaaatagtcttgattttggctcttgttttcgtcagctgaacttccccattgtatttatcagatattttctttttcttgattttcacttatcactgaacacacttgttcactgacttgaactttgttcatttttttagatctctggatcttttcttgtcatgtcaattctctttttcttaaggtaactgtcttttgacacgtcttctttctgttttctttcttcttccttttccccttattctgtgagtgtagtgctcaattttcttgcagctttaacatcaggagtttgatgaatatattagtttcatacatgactgggatgcctgtacaaagaatgaacaagccgctagagaaccaagtgtgaatgaagcaaggttgtcaatgaaaagcccagaagagggaggaaaagcagagattcgtcctcgccgttgaaattattgctgtgattacttgatacgtgggctcatgacttgctctgtaaatcagtacccttttccctgtgctcatagtggttcctaccttagagtgaccttggttaaaaatgcctgtccaggtggtgttggcctgacaatgtatttgcctttcaaggtcaacttctttcttcttttcacaatttgctttaagctgttatactgaggtgactttattttatttgcagctttgtttccccctgtggctggatcaatgccattgtggaaaggtcagcagcttctgaaacacctttgtttggtaatggagtgtagggcccattttcaagacttttttttccctcctctagttctttctcctttccctcccactaagaatcaattccagagtcccatctgtgctttccctctaaatgactctcctttacaggtgttaacattgcatttaagttaaaacatgccattgcccctcataagccaggcacgtcctgttgtcaacacagtatatgctccattcccacaagcctcctgctaatcatccttgcattgtgaccgtttctgggtgactgttttgctttataaatgaccatttagtcctggtttgtgtgaatgcaatgtgtagagcttttgtgtccgagggctaagctgtagggtcttgtagcgtttgccttttgtgcgtctggtattggcagaaagtgagcttgtgggtcctgcaatgagaagcgactgccattgtggtgcttatcggcattattggacactaatggatggatagcagataacgaatatatccgaagccttacctttcttcctctcttgtgtgttaggaccgacaggatcattcagggcaaggtgagtgtaataacatgctttgttttaaatgacaaatcagctttggcttaattcattcactttctccctttcaataggtgaagataaattaactagagaagctttgggataaatcaaataagtgaacatactacttactttttcttaggcctctgatgcatttggctgagtgatttttataaatatgaacttttcatgcttcatacagtcagtagctccccaaactcccaagcagggcacctcaggtttgccatgatttagttccaccacctttctagtctctttctccattcttacccacacgtaccctttgttctagccatagtgaagatatcacagttcctgtaacaaatcatgcccagtcacctcttggtgcctttatacacaatgtgttcttacctcaaattacctttccctgctatagtctcccactctgcacccaccagccgataaactcctatgctacatgcaggttactgccacatgtcctatccttgttaaacctccggtgacccctttcccacctgtatattgatcatttccaccttcaggccacatctctacttggtacatgattgtacctattctaaacttaatagcacctaaggtcattttccaacttgaaacctttcaggagtttactctcttttttccccctaacttcccatatcaacatagtggtaaaattggtaagcattgtaatatgactgcaaagtccaaaatcctggctccactttttatgagctatgttaccctgggcaaattatttaatttctctggtctcaattcctaggtgttcttgggaaagtcatctaaatttcctttgcctcaatttttatgctggattccatgttatccacctggcatcatcaccaccattcccttctaaaggtcccttctgcatcatattgcagagaaacaggaacactttcccagcatttctttccctatatgatttcgtgttagagatagccaatgacgggcactggcacaaatgttgggaggcaggaaaggaggagccaccattctccagaagctgttgcagccagacacctgggcaaatgtgacagccacagtcatttcccaagaaactcttgagaatgacttgtttgctgctgtagctctaaacagtggtagaagcttcctggagattcttaaaacttttagaggcttgctagtgagttcttaaaataagtgactttgttgctgcctacagcctaggattgctggtggctgcttcccagcttttgtgttcctagttcttcccaatgttatgattatctctaattacctattttttatacctgtaatacatggagtggcttctgtttttctagccataccctgagtggtgcaatgttctcatcagtttaatgcagagaattatggtaccggcttcagagaattaactgaaaaacaaacatacctgaagctctttgaacatattatatacttcttaatattttgtgtccgctactggaatatgagctccattctattctatacacccttattgggagccttctctactctcagtcttgcttgcataatatatccattccttattttattagaggaatactatttctaaatgcaaacttgatcatgtctgtcttcttatcacgaggagctccccatctttctatcatccttatctatgaggggaagtggaaatcagcttgttggaatgaaagaatgaagtctaccatgattgatgacttatctactcacagcctctgctgtagccctactgaacttcaaaaggaacccaaaacttgctctagtatttcacacttctgtgtctttgctgttgctattccatctgctggggagaactttctatctttcatccacgcctctgagatcctaggcacaatttgtcgcatttggagagtcctctttgatcctgctgtatttcagccttatttatcaggcttgattgacatattcaattacatatttgtgtatttgtattttctttaattatgcaggatgtttgggaagagaatcctttcttatttctcttggcatttctagcccggaaactaggatagaataggtttcaataatacatgttcaatgaatgaatgatcaaacactttaatactaacataggccttataactttcaaaggagtacacttagccgtgggaattagaggccatgctgttacagattctgtcatcctgtaagagctgtgctgcagtttatggaacttcaagcaacattttggccagtgggcacgaagagtgatctgttagactgatagtgactgggaacaaacttactgctgttgtggctacagcagtgtcagatgtttggttttgatcatcctgattaggagaatatctaattcttcagagagagagacagagctattttcctctctgtcagtctggccgttgtcactgctgtttctttcaatgtggtaggcacattagattatgacctcctgctggcaaaagaggtcctgggtgcccatgtcaacgtgaggccagtgggtaatgtcctgttgtttccccacaagctggtgcaagagaagatgtatattttcagtgattgttcagctgcacttggaaatttttagcgagtgggtttactgcaggaatgcttagatctattatttaccaaatggtatgagttagagatggatgctatgtggcaggatccttattcatttctcatctgcagaggctgcttcctattcagctctgtgttctacttcattttaagtattcctaatgtttggacatctcccactccactcaagatgatttagtcatcagattgcagttgggaagttttcgcctatctttctgctttaattggtcttttgaaagctctactcccctgcggatggcagggagatataatagagtttgagataaaagggtctgggcttgagctctagctctaacatgaactagctttgtgattttggacaaatacttaacctttctgagcttcatgttcatgctcttttaaatggaaatgattataattgctcttcttacctcctagggtgtgttagtctgattaaatttcctaattctagggcaaacctagaggtagtatttctttttctctaaatgagtgagcttttacataggaacattggatcccaagcagtgaataaaacacagctgaactttaatactgcatcttatcctgctgacatccagtcgggaaagaatgcacaagtatatgtggcccaagaagggtcattccaggcacagtatggtatactctgatggtagaaaagagtagagtcattctgcactctgcgaggcattcttgtcgaattaggggctatgtgtatcttattggttctcaactgggggcaattttacctttcaggggacatatgaaaatgtctgaagacattttttcctgtttcaaccacaggggaaggagggagtgctcctggcatctgatgggtagaggccaccaatgctgctgaacattctacaagcacaagagaagctcccaacaacaacaaatgatctgatctcaaatcccaatactgctgtggttgagacacaatgatgtatcttatttaaccctgtcccagagttccagggccaagcaggatgagctgcattaggatgcagagaactctgaggaggtgatgagcaccctgaatggcttagcttagcccctgggcccacctgaattctgcttcaggtttctagcctaataagccctgcacttacatcaaccactgttagattcttctctgttcagtttccttggaaatctcttgttatcaatatttgctaatagttaagaatttagactttgcagctagaatgtctactttgaatccttacctgtcatttactagctatgtgacccataggaaattctctatgccttagctaactaaactatacaatggagatatgagtattcatcttatatggttatatgtcaattaatatgcacaaataaaaatactatatgccaattaataagcaccttgaatggtacttggcacttagtaagtgcttagcagctgttaaccattacgtaattgactatacttcagaacaatagcataccaacacaacattattgtgtggttctcataccattttactttaattggtcaaagctttatttcatgccttgcttcatgccagacacagcgttgagcagtgggaaatcacaagtgctctaagtgaactcacaggcaataagtaaatttgttactatatagtccaacgagtgtaatagaaccgtatatgctctactatggtggcaccagattggaatgattaattctatctgaagccatctgagaagaaagttagttttgtttttttttctttttttggaaggttagtttttaaaagatgacaaagcagatcaggaaaagttgaaagtagaaacttctccttattagcctaacccaagatgtgctatttcttgaagcttctgcacatctaagctgctctgtctccccaactggtatcactttgtattcctctccctcatctgcagtagctggaagacatcactccttcttgcccctctccactttttctgcctggatacatagatttatgtcagaaaatacatctttgtgtgggagggtctctgaacaggtgcctttcattccctttcctgctcagaagagacaccactgtaggaagcccataaacaaccactaatcttaagagctcatgcagctggccagctggacattgtattgtaccaaatagcagtgatctgtggagttgtttgaactggttcactctcacgataatcaggaaaaaatccttcctggtaaggaggggccagctgatagagcagaaagaaacttagaacacacacacacacacacacacacacacacacacacagagttaaaatctctttactgtagtttttagactttcacaactaccaaatgttctttccacagagaaacagagatgatgttttgcttgcaactgtatttttatgaactatatttgccttaagagttgagataaatatgagtttacatattcagtcttacagccagtctcctgagccaagctgcatactctgaatgcaacaatgaatactgaagcttggcttgatggggctgggggtgggggtggggtgtgaatatgaagagagctttaaaacttcaatatctctttcatgtttatctgcgagtgtgaaaatgccatgaatgatcaattaactatggcccatagagttgtggataattgctcattctctttcaaggaactttggttcccccaaatagttgctttattttaggcatggggcttaaaacattaaacttattttcattatcagagcacgtcttagggaaggcaagtcagatgaaagctttattattgctaattatagtttcatatctttagagaagcacctgtgtaaattgcacatgaactgctgttctttgaatgcatgcaaattgcattatgtacatggtacttggcctcttgttttcttgcatagcaagttgtctctgagatgtgagatgatttcacggtggtgataggcccatttgcaaatctgtttatagtaattaaactatcaaaataatgttccatttctcttgaattccaaatgggctgatttcattagcttcatgtttgggctgaccctcaattaaactgtgagaagcaaattgaacttgcgtccttggcagcagactttctctaccatgtcttctactctggcgttgaagaatacagtttcaccaaatctctaccttggcattgttgccattgggcattaataattcttgttgtaggggcttgtcctgtacattgtaggatgtttagcatcatctttgacctcttcccactagatgccagtcacatcccctgccccagttgtgacaaccaaaaatatctccacgtattgccaaatattccctgggaagcaaaatttcccctggttggcaaaattattcctagttgaaaaccactatgctatttgatgcttcatgtatatggaaaagaaaggattctaaaatgttgaaaccctaaaattgtatgctggaccatgtggcaggttctttggcgttacctttaaaggaccataggtactgatttgctcaggcaactcctgtttcacacctgttgtaccaccaaaattattaacagaaccctgtttcactttcaaactctactgattctaatggtaaattgtataggtactctagttttgggggagatgctcaaaactttgtaattgcataaaaggaaattaggctcagaagttcaagtaatttaccaaaggtcaggttacacagctactaaattgggttgctaaaccttgaaaatgggactaagtccaaagttgcatcagttgctttaattttctctttccaatttccccagagtgatctacagtaaaactcttgacgctaaaaggatttcaagaacagccttgatggcaagaacttggaagagttcatctttctcagtatccagacaggaggagagagagttgagagttggacaatcctagtttcaagtctgagttcatcatttacttttttgtgaccttggcaacatgcctcctatatttctatctctagaaaatagagataataaactgaacacaaagttatcataagggttaaattagattatgtatgtatagtatggcacctgccatatattaagcagtcaatcaattgttgatatgatgattactaactccaaaagaaaggggatgatggtagagttcaagatattaaagggaaacaggcaggaccctaggggctgtgataggaaagaagggccacatgaggagtggggctgaactgaggactagggtgatatcttactcattagtgctctatggttccctcgaagggcctgcatctgggaagaatactcactgaaattttctaacccaaagcttaatagggtatttcaaatttatagggaaatttgaaaagcaaaacactataaagacccaaagccatagagatagaacagtgggatattgccttggaaggttagcacaggagttaaaatgtcagcggttaagttctttccagagccaagcagtgtgtgttcttcagccagccattcttctcctttgaaccttagttttctcattgtaaaatgaagaattgtgactaagccttagtaccttaaaaaagtcacaaaatgactttatagtaatgcgaaaagagtaccaacagaaacaatacagccagccacagctctattatctctccaaatgacttatattttgattcaaaattatgtgaatctaaggggttatcactgggtagcggcaatatgactttcattttaatttgtgtgtgtgtgtttacttatattttctaaatattctaatgtgcatatttattatttttcaaatcagaaactattcaatgctgctaaattttttttttagtgtatgaaactgcaaatttaatagactggtgggggaatactccctacctagaaaacaacttcctgcatgtcttactacttagaaagtaggcagtgtgcagccctgcttggcttgtggagtaatatagtgtggaacatgctaataaagacaatgtatgacatctactggctccagcccccacctgcatgtgcacaggtgcctggtgtggtgtcattgtcctggtctttcattttggggaaaacaaatgcatatgtcttttggctcatttgaatcaatgggtttcagtgtaccatattttactttttcattttttacatatattaataatcactaagcattgctctaagacattgcagtgttgcatagaaactattctaccaaaacagatgcaaatgtttcttagaaatccttccaaaatccttccttttgtaagaaagcttcttacaaaagccttgctacaaaaaagatagcgatttacttctcaaaagtaataacaattcctattctttatagagaagaaaagaaggcctagataagttttgatgttccagaatgtggaaacaccaggtcattcagaaattgaggaaattttaggaatgcactggtttcgttcatttatttacttcattcacaaatatctgaactaccaaaccaacttagaaaataccttctacattgatttacttaaaatcaagtaagccagaggagtgatcttgactattatttttatcattaatttgactacattgtctgttttatggctttgtttacccaaaagagtctttgaaaatctgtcagtattttggctcctggactcatatggtccccataggaagcgctgtaatagttatggtctcacatatgtatcagttccaattctaccactttgaagtgttagttaaaatttattgttcaaacttcttctatcaagcgggagtaatatctatcttaaaggattattttgaggagtaactggatataaattgcttacaagaatgcctggcatagtaagagctcagtgacatttagcttttatttgtgttatctctcatgaaaaggcttgcattctatcagtgaaaaacatgaaacaaaataaacttgtctaaaacaagacacagcagcaaaaatgatcttccttctatctatttagtttccagggtttattcaataatttccaaggctatagtttcttataattcagactattcttccacctttcctatttatgtacattatggttcattgcatgaaaaagaattacctaaaacttttcttcctgtcttgtgaatgaaatgtcctctgtccgtttcaactcccagtaatctctttctgctacaaactgaaagtgtttcttcatctcaatctgattcattcattcatgaaacacttgcaagccagctctgtgccatgtcccactccctaaagatattgtataaaccatacagaaaatgtcactgtcctcaaagagcttgtcttggggaccatggtctgtataatgttttttgaaatttttatgtatcttttattgttggttaggttgttatccttctgaggtagaatccgcttccctgtacctgacatggttatttgtgcatccattacaggtgctcaaaaagtacttgaataataattataaaaaccatagcattctctattgagcttttggtataccaagccttatgctttagatacgaaacttcacttaattctcacaattctgtaaggttggtgctattctccttatttcatagttcaagaaagcagggacagcaaggttaagtaacttcccagggtctcagagctggtaagtgagggaatctggatttgaattcaggttaatctcattctagagcccattttcttaacttgttttgctatactagatgaatagatgcatggctacctgcataattaggtgaacaaatttaatgtataggaagtttacattatgtatatatcctggatttcctctaattctctctttgctggtttctcctcacttgcctgagttctaaacattaaaatgtcccaggactctcttcatggacttttctttctgtttatactcactcccttcgtgatctgatcttgttctgtggttttagatagcatctatgtagaagtgatgcccatgtttacatctgatttcagcctagactgatattttactgattgctttatatctccacttgacgttgaaaatgaatgcaaaatttaacatgtcccaaaatgagctccagttattccccaacaacttgccctccccaaacctgcatcttctttagtctttcccatcaattaaaggcaattattccagttgcttaggctgaaacctctggagtcattcttaatttctgtttcttccattgcaatttcaattcattagtaaatcctgttgactccctgcaaaatacatttagactctatctggtcacatcttcgcatttttattgtcatcatcttgtttaagcccccataaactttcacctctgttattgcattagtctcttaactcttctctctgtttctgcccaatctcttttgcaaaccactcctaatatggtcctgttaaattgtaaatcagatcatgttattcttcttcctagaccttttcagctgcttcccagttcactcagtgtaaaagcaaagcttggaagccctacctagtgagcgatgcccttacctccctgatcctgtctcctcctgattctccccatgcttagcctccatgctggcctctgtgctgacctgccaacacagcagacaggcttctccatttgggcctttgaaattactctgcatggctcattccctcacctcttcagttttttactcacatttcactgaatcagtatggtctttgctggctactctgtttaaatagcatatgattcccattcgccatcccccttctctcttatatagtctccacagcaatcatcactgtctaaaatactatccagtttatgaacaatagatggcaagtagtataaaagcagggatttttgcctgttgcgttggttgtcccagtcactatagaacattgcctggaatattctatgcactcattcagtgtttgttgaatgaatgaataaattgtgtatttactttgtgtaaggcattgtgttgagcagtctacattcattattaaattgtaaaatattcaccgtgatcctttgagttaagtaatcttaccaaacatcctttatagatgagaaacatgagcttgagagattaagtattttgctcaaggtcacacagctaagtatgacataggtctgcataacctcacaaacaattacattctgctggcttttgtatgccagcccagattttccaccccagcccttcttagaaatacaggcaattttaggcttcttgggcttttccttcctgtgggctatgacatggcatttcccagcatcctgggaaagattaacaagcattccttgggagaaggggtagaatcaatgctagcatttattttcctctcactgagcattaaaggaagtagataaagcaaggtttaggacaaaaattcattttaaatgaaatttatatgaaaagtgctaaacactttgttctagttctggcaaggcaataactctgccatgagacagaatgccagtctgtctcacagggcacctctacttggatcatcaaaaagggagttcctgtggttaatctgggaaaagcctagtttagtttagtttagtttagtttagtttagtttagtttagtttagtttagtttagtggtttcatctctatttctggttttctatctagtttttatgatcctggatgtttttttattgccagctagtgatacactagtgattattaacaaaggtaaatgaaacaagattccaagctgccagaataaacaaatccataattacatgaagtccattcctagagatcctctttgtgaatcttcacattaggccatagttgacactgatcttcatgcttgtttttcttcactgcaggtatctctcaaggatgttgatgggattatatacaaataatgctttggctctctcagagttggcagatctcagcaataaccacctcttaggttctgggattcttcaaataagaccagtggggaagggccgttttaaaaataatttctgactgtttacagttcctgaaggactttttcttcttgttttgatttttagcaaaatgcagtttagtttccctgaaaccttaacaatctggaacagttcattgttgaacaaaaatgttcagttaaaaggcactacaaggagttgtattgctgggtgggcctggcagtggagaagatagtgaagctgagctgtgcttcatgcaatgctgaattgctgctgctgcagtgtgtgtttttttctggagtctaactcatgcacacattttataaaaagttaggtgtattcaagtctgcagcaagaatatgtccccatactcagttctcagaaactttgttcgctgaagaacgagctgaaaatagagtaaaaacaaaatgtaaccatgtaaaaatcttgtgtacccacaccctagaagccattctatatttctgaagggatgtaagagtgtcacctagcacataagatgtccttgtttggggctgttccttggatattttaatttaattagtccagagaaaatagcacatcagcattttattttaatgctctcccggtgattctaacatgcagccaggattgagaacctctgctttaagccacctctgggctgggtgggaagagaataattacctcttgcaggcttaatgcactttggccagagaaaatctgacccattcagagctaagaaaacatttacaaaacaggggctttaaatcagtgactccatgctgaagacctaaattggcatttcaaagtgcagtgataacaggtaatgcccactgacgaaatgaaaagctaggattgccaaagcagtttaattaatatatttccccaagaatctactacaactgtcccagtctgattttattctcttttgctgcacttctctcccattttcccctatcagttgtatccatgctctctctacctctttcttttttaacgttacctttcttctttgatttatatttgtctacttttttctttcccttttcttatttctccctttggccagagtaagagataaggtttattttgtgctgtttgcagtgtttattgaggaattgtatgtctctaatgatttattttaaaagcaaattagctgggcagtttttatttctcttaatttaaaaagctctcaagttattattattttatttgtatattgcccttaaaagtttataacccctaactctgctctttccctctggtggtttctggaatttagtagaaacagattccctgcctaagctgttacaacataagttaaattggaatcacctgagccagttactgctcctttccaattctctgtattgtagatttgtaagtgttgactttaatgtttctgaaaccaagcagagaagtacacagatttttgcttctttgtaaccgtcttgtttgggtggtaaggatgtgcttgctctgctatactttaatcgtattcattaaagggggaagagaaaggggttttgtcctcaacaaatgacacaaggactcaaatacagaagtatggagttcttcttaggccatatttagttcactttaacaagcttaaatttcctatcataaagttcaatttatgaagttaatttaaacgtcacattacaacgtctatactgtcttcctttgatttttatctttcgtcaatttggtgtctgtgtaacacacttgttttgttgtgtcataggtttatgtttgctgagtcttccaactcataatttcttcctcaacatctcctcctctccctcacaatcctgttatcatcaccaccaccaccaccgtcaccatcactgtgatcacacaaatgcactatgaaaacgtaattgaggtgtgaatccctgtgcaaatgcctgacctgctagggttgtctctgaaaactccattttaatgacttcaactagattaatctgattttccaaacattttttccttgaccaatttgctgccataagtcttggatttgggttcatagtcccaagtacaagcaggagaagaagaagagaacaggagaggggttgaataaagggcatggaagaacatttgatttaaataaaggcaagaaccacctactgtactagcgtccagctttcaatcctctccaatcctctttcaatcttctctccattcatctatttctgtaatggaaaagaaatgggaaaaccattaaccacttttattttgatggcaggcgcattatacctgaaaacaagattgaagatcttaaaatttctccatcatcagcaagacctctagagtgacctgctgaatgggtacttgagagattgccagtacagaagtaaatgaagtgattggaagctcatcacgatatattagatgatagatctgcacaagtttgggaaagtgacagcctgtagtattggatgttagcttgtgaattgaactttaaaattacgttagatatttctttaggggtcagcagaaaagacttggtgaaacaggcatcttgtatgagaaaattgttactggccttgcatgtcggatgtaggaactgtagatggccaggaagggtccctgattcttcctggttcaggttaaagccttgtcacattgagaagatatgatatatctctgtatgggtagtttgcactttttgagagccatttgaccttttagtcgtacagacagcagttatacatgaaatgtcttggctgaggtgccttccttgggcagcctttttgatattcagctaatgctgttaaaccagaaacttgggtaactggagtcttgtatttgattttcagttacatattggaggccagttaacttatttgattaggacccagtgacaatgagaactaaccaggccattgcctcatataattcaatttcagagatgttttattttcatctttgatttattttcttatgttattttcttgtattttttttttttttttttttacttatttaaccttgtaggggagggagatattcaaagttggcaatgcttttgcaaaaaagatgttctaaaacttatttgttaatttttttaaatttagattacagtagcaatgtgttcatttagagaataaagacaaaaatcaccaataatttgaacccctccatcgtagctataattactattgatatttggcatatttccttccagggttttactatgcatgtattctattatcattcttaattttaaaaaaggttttatttctggtttaggaacagggttctgctgtgttgcccaggctggattctaactcctgggctcaggcaattctctggccccagcctcccaagtagctgggactgtgccattgtgcacggcttttcttaatttttacattaccatctatatttgaataaaaagggtattatactttcaatataatattctttcttaatattctatcattagcatacttctcagctatttcatattcttttagaaaattaattataatgactaggtaacattgcactgtacagatagaccgttctgtgcacttccctgctgttacatatttagatcattttcaatttccattcttataaataatgcttcagtgaacatccttgtatataaatcttgtttaaatccctgactgttccctttgagtaattcttatgttaatgttcagaattcttttcaggtataatgccatttctatgagacttgctaattctgtaatttattctttggatttattgacagatgcaaggtagcagcattgtgcactgtaagaaattgtatcagagtttaggagacagattgagaacacattctgatacttcttagttgtgtgatattaaggaaggtggttcaccactctgcctgtttcccttcctcatttgcaaaaggaagaatatggaacttgtctttctttttccagttgtgaggcagtgaaaataatagcactttgtaaattttagaacactttactcttttaagatttttcttaacatttcttagtgtagcagatttttttttaagtggggcatattactttttgttttaatttattataaataaatgattttaaacagatggtaagatacaaaaaataaaattgggccgggcatggtggctcacgcctgtaatcccagcactttggaagggcgaggcaggcggatcacctgaggtcaggagtgcgagatcagccaacatgaagaaacccctgtctctactaaaaatacaaaaattagctgagcattgtggtgcatgcctgtagttccagctacttaagaggctgaggtgagagaatcgcttgaacctgggaggcggaggttgcagtgagccaagattgcgctcctgcacgccagcctgggcgacagagtgagactccatgtcaaaataataataataataataataataataataataataatgataaaataaacaaaattgaaaacaatccgtgtggctaccatctattttaagaaatacctctttatgtgttaattattaatctaggtcaggcattgtacttcggctccagtgcattgcccctactcccccaggagtctgtcattctcagcatgtctttataacttcactggctttgaagttgtatcctttatttctttattgtgggttgctacccttcaagttttaacattcagacttaccttaacaaaatctaaatatatttttgttttccttatagactttatgtagaatttttgttgttgtttttgttgttgttgtttttagacagaatctcactctgttgcccaggctggagtgcagtggcacgtctcagctcactgcaacttccacctcccgggttcaactgattctcttgcctcagcctcccaggtagctgggattacaggtgcctggcaccatgcctggctaattttttgtatttttagtagagacagggtttcaccatgttggccaggctggtctcaaactcctgaacttgtgattcacccgccccagcctctcaaagtgcttggatacaggcatgagccactgtacccagccgatgtaggatgttttaagtccaaacatctctttgtctttcttgttactttttccagacttttagttctaatttgttttgttactaccgaaatcaattgttatttatattattatactgcacagtcatgttgatgtgatttatccatgtaggctttgctcatcattctttcctaatctcaatctttcttcctggcttgctttcctttgatataactgttgcatctgtgagaagtttctttagtgagaactgttagtggtgaacacatttgttttttctttatttgaaaatgactatttcacttttatttttaaataatgatttatcttagtgtttaattctaagattacaggcataatcccatggtcttttggctctcttggtgtgaagtctgctaatgtggaccttgatattcctttgtagatgatgctttttaccctgattacctggatgatcatctcttttgctttggtgatctgctgctttattatgatttatccaggtgtgggttactttgtattaattctgcctggtaataatttcttgaatttgaagattggtgattgtcataaaatctggaaaattttcagctattctccaagtatttttttaaatttaacttctattttaagtttaggggtaaatgtgcaagtttgatatatagtactcaatagttattttttctgatcctttccctcctcccaccctccacctccaagtaggctctagtgtctgtagttaccctctatgtgtccatttgttctcatcatttagctttcacttataaatgaaaacatgtggtatttgattttctgtttctttattagttttctaaggatagtggcctccagctgcatccatgtctttgccaaggacatgatatcattctttttttatggctgcatagtattccatagtgtatatgtaccatatatttttttaatccagtctaccatcgatgggcattttggttgattccatgtcttttgctattgaaaatagtgctgcaatgagtatacacgtgcatgtgtctttaatatagaacaatttatattcctttgggtatatacccagtaatagaattgctgggtcgaatggtatttctgttttttgtctttgaggaatcaccatactgtcttccacaatggtgaaactgatttaacttctactaaccctgtataagcattcctttttctccacaacctcgccagcatctgttgttttttggactttttaatgatagccattttgactgacatgagatggtatctcattgtggttttgatttgcatttctttaatgatcagtgatgttgagcactttagttttattagattcagtttgtcaatttttgtttttattgcagttgcttttggtgtcttcattatgaaacctttgcccattcctatgtccagaatggtgttgcctacgttgccttgcgggtttttatagatttgggttttacatttaagtctttaattaatcttgagttaatttttatatatggtgtaaggaggggatctagcttcattcttctgcccatggcttcccagttatccagcaccatttattgaagtgggaatccttcctccattgcttgtttttgtcacgtttgtgaaagatcagatagttataggtacgtggccttatttctgggttctgtattctgttccattggtctgtgtgtctgttcaggacctgaactgagcactggatcaaatcaaccacagaactctctacccaaaaataacagaatatacattcttctcattgccacatggcacatactctaaaattgatcacatcattggaagtaaaacactcctgagcaaatgcgaaagacctgaaatcataacaaacaatctcttggactacagtgcaatcaaattagaaatcaatactatgaaatttactcaaaaccatacagttacatggaaatttaataatatgctcctgaatagcttttgggtaaataatgaaattaaggcaaaagttaaaaagttctttgaaactaatgagaataaggatacaacatactagaatctctgggacacagaccagagctaagagggaaatttataccactaaatgcccacatcaaaaagctagaaagatctcaagttaacctaacatcacaacaaacagaaccagagaaccaaggtcaaacaaatcccaaagctagcagacgacaagaaataaccaagatcagagctgaactgaaggagattgagacacaaaaaaatttaaaagatcaatgaatccagaaactcattctttgaaaaaactcaggaaaatagactgctagctagactaataaagaagaaaagagagaagattcaaataaacacaatcagaagtaataagggggataataccactgaccccacagaactacaaacaaccattagaggagtctatatatataaactggaaaatgtagaagaactggatacattcctggacacatacaccctcccaagactgacccaggaagaaattgaatccctgaatagactaatcatgaactctgaaattgagtcagtaataagtagcctaccaaccagaaacaagcccaggatcagacagattcacagctaaattctaccagatgtacaaagaagagctgatactattcccactgaaactattccaaaaatcgaggaggaaggactcttctctaacatgctatgaggccagcatcatcctaataccaaaacctggtagagacacaacaaaaaaaataaaacttcaggccaatatccttgatgaacattgacgcaaaaatcctaaaaaaaaaaaaaaaataaaactggcaaatgaatccagcagcacatcagaaagcttattcaccacgatcaagtaggctttttccctcgaacgcaagcttggttcaacatatgtgaatcaataaatgtgattcatcacataaatagaaccaaagacaaaaggcacatgattatctcaatagatgcagaaaaagctttcaataaaattcaacacccctcatgttaaaaagtctctataaactgggtatcgaaggaacatacttcaaaatgataggagccatctatgacaaacccacagccaacatcatactgaatgggcaaaagctggaagcatttcccttgaaaactggcacaagacaagggatgccctctctcacaactcctattcaacatagtattggaagtcttggccagagtaatcaggcaagagaaagatataaaagggcattcaaataggaagggaggaagtcaaactatccttgtttgcagactacatgatcttgtaagtagaaaaccccgtagtctcagcccaaaagcttcttaagctgataaacaacttcagcaaagtctcaggatacaaaataaatgtgcaaaaaaattaacgttactatgcaccaacaacagtcaagctgacagccaaatcaggaatgcagtcttattcacaattgccacacaaaaaataaaatacctaggaatacagctaaccagggaggtgaaagatctctatgaggaaactacaaaacactgctcaagtaaatcaaagatgacataaacaaatggaaaaacatctcatgctcataaatagaagaattaatatcattaaaatggtcatactgcccaaagcagtttatagattcagtgctactcctatcaaactaccaacgacatccttcacagagctagagaaaactattttaaaatttatatggaaccaaaaaacagccaaatagccaaggcaatcctaagcaaaaaggacaaagctggaggcatcacactgactgcaaactatattacagggctacagtaaccaaaacagcatggtgttcttcaagtattatctctttcccatattctctattttctcttccttggaactccaattagacttgcattctgcctttgaagtctctcaatcctgatttccacactttccattttcctctgctgcactcttggaaatttatttagatctctctgccagttaatgaattcttcctttagtcactgaattcataatttcagtgatctctctctctctctgtctcacacacacacactcacacacacaaacacacacacttctagaaattctgttagtttaaaattttgttttctggtttcctttgataggatctttttcctttgttgtatttttagtccatgttaaatttttaaaaacatgaaaaacatttatttttatgacacgtattagataatactattatctaatgttattattagtcttatttcactgtttactcatgttctacttactttcactcatagtgtctttttttcttattcatctagtagtaattttggattgtgaacttattttcagcagcaattatcatagggatcctgtgaagcctggattaaggatgtacctgcaagtaccagtactgtttaatagaaatttccacggtgatgaaaatgttttatatcttcagggttcattaatagtagccactagccacatgtgattattgagctcctgaaatgtggctaatgtgagaagccaattttgtaacttaatttaattttaattaattaaaaatgtgaatttacccaccttactggatagtgcaggtctagagagctttgctttggcttcttctaagtgcatttgggaactgctaaccttgggccactctatgttaattttttggaaatggctatctcactctacacaaataaataaatttgaccttgaaactgtcagtgtaggcctgtgcttatacaattctaggggatatttttatatatacaaggaagacatattcctcattatccatctcccttttctggtgggcagataaatttttagtccacatgttccccgatgtatgcctagttttttatatgcatacattgcatatgcatagagccccagctttatttaaggatttaattttccattttgagaaaatctaaatccttctctgctttcccaaacagtcatcgaaacctggttatagagattggtaaacagctccaaacagttatttgggcagcaaccacttatatctctcttttcagtccctccctcctttttttgacccctgcaaacttcccttaaattcttacaagctcagagagtcatctgaagaagggtttgctatattttatccaacattactgttttgtaatacgcagttttcaggacatgtattctgccttattgctggaaatggaagtgtccccagttctttttgactgattaatttctttattgtggacaggtattggtagattttcttgctgggcatgaagagagatgtttgttggttgttaaataacagaacaggaatgtaaaaatgttcctttcatgggccattaaattcaggaaaaaaatagatgaaacatgatactatgtattggcaactgaatgctgtttatgtgtttatagttagggtttaacatacctggcttataagcgaactgcaagcatccattctcccagctgcatcagggcacaaaggattattaatatatgagccacgagtccatgttgtgaaggtcatattgccttattgcaactgtacaaaaggcctggaagataataatgagattcaatcagtgaggcaatagatcataaatgcttttgttgttttatgtgtttttggttgtatttggaaagataatcttggtttgatgagtctattggttataactagtcaatatgttttctatgactctccatttaaaaatgcatatgtaaattagatgctaacacaagaaaaacaactatatgatacagaaacagaaggccaagggtaacttctactagaaagagaagtatataactatatttggactgaggtaaacagggaagggttagcactgctggcttattttctgatatttgcttggctaagtttttcttaccaactcaaacgccactgccaatagaaatctttcctgaccatcctggtctcttactactctctctgtgctgtggccctgttttattttctccattgcatttatcatgatctgaacacactgagatataattttggagagagtggggaggggtagattagctcaactcaacagtgtggcctgtggaccaatgctggcctgcaaatgtgtgttactagtttatgacaagaaaaagactttgctctagactgtaaatcaactatgtcactaagcatgctgtttatttcagatgatttttttgttcatttgtctgtttgcattgtgttctttctagcaagactttctctttgaaggaagtagtgagtgctgacttacattctgatgtgaactccttatcctgtggactgtaggaaaaagtactcagactaaccactttgagtaacactgggttagaggatgaagaaggatcaaaaagatcaagggggtgataaggggttgaagtgacactagtgggagataaatgtaaggtcagaggtgaatttgaaggagctatgtttaagggaaaggggaagagtttgagataagaatgactccaggaatttttctttttcttttttttttctccgagacagagtcttgctctgctgtctcccgggctggagtgcactggtgcaatctcggctcactgcaacctctgcctcctgggttcaagcaattctcctgtctcagcctcccaagtagatgggattacaagcatgtatcacaacacctggctaatttttgtattttgagtagagacggggtttcaccatgttggctaggctggtcttaaactcctgacctcaggtgatccacctgccttggcctcccaaagtgctgggattacaggcgtgagccaccacacctggccaggaatttttctttttaaagtttatgtttactctgtcacagaaaagttttatatatgacccctaaagaaaaagttaccactgctcattgattttctagatggagcaaaattcagtattctggggaagatgcgtaccaaggtttctggtaaacatcttcaatattattattgccaactggtacaattttcattgtataaaacaaaaaggtgcaataatatggcaggtttgcctttattgagtccccatttaggaactaacagagagaaaaattcttatctaaaatgaataaaattggagggtaggaattcccaaaggcagtttgaggtcattctggagctgatatatatctctaatgcccttattctattaacccacacctttcttggcttttggtgttacaaagccctcttttgaaggagctcaattttgttgcaatggatgcaataaatcttaataactttgtagaaattgtataatttaacttttttaccaatacaaaagtaacatgattattttgaacatggtggaaaatacagataaaatataaataaaaatatatttcctcctaatctcaccagcctaaaattatcactaatattggtattttttcccggctttttttttcttgtgccctcatataatttttttttacaggttgaaattattacacacacacactatatatgtgtgtgtgtgtaaatttaatactaggcatcatgtgaaaaaactatttcattagaattacttgtaaacatcaattgaatggttgaacaatatcctatcacaaagagaataaaatatataaatattctacttctttgaacatttactttgctttacattttttcctattatatgtatgagttgataaacatctttttactcatctttgtttacattttgaggaaattgctgtattaattaagtagttgtatgcaaatgtattatcgtgcatcaaagccttgtatctctctaatatttatacctgtgcctatattcctgcctctatcatcttgtgctctttaagtcatggatttgttggtagtcctggctcggacccttcctgatatgagcacaaagaaggagctggtttactcttaatagagattttttatgtctgcttggacactggattttctccatcagtatcattagccagtctttgacttctttggtcctcatagccaatcttagattaaaaagaccagaatgagtagttcatccaatttcagtagttttcatggcaaatgtttaaaccacttattactcatattatcttggattgttagaaaaaaataactgttcgctgacctaatataatttataaagctattacacatcctgtttgtagcatgaatcataatagaccttaaaattctaaaaggataccattgtacgaggaatgattaagggagagcagaggaaaaaatgagattgtcaaggtcagtaatcagtgtccttgctttaaaagcaatgtcacctgctgtggctttccagctttcctttgtcaactttctcctattttataaatatctttaatacattatttatgaaataggccctttcttacatctataagcaagctacaatatacgattatgttgaaagaatttagagaatgattcctttggtcataatttgacatagtacagtgaagagaacaatggcacttgactgagaaggcttggtggaaagtccaagccgcactatcatgtatcactgcatgactctcagcaagtctctccactgctttaaaactaatcttccacgtcaataaggtaatgccttaccttgcgtagtcgctttgagttaacacaacatagttaattgttaataaaaatagttaatataaatataatatcatggcattaatggatgaacattccatggatattgagttcaatttttaggctacttttttatagcaaaaagtcagagagtcacgtgaaaggtaactgagttttatttctcaccagctataggttgggtggttagtatatattaccttatcacctttcatgatgctcacaaccactctggagaaaatgtggttccaagagaatgtgtaagttgctctgtaagaccatagttccagttgcttgcagaagtgggatttgagctcacctgggtctgattcaaaaattcaaggtttttatactagaccattattcacaaagttttaaaagtggaaaatggacaagaaaacctagaccttgatttagttatgtttattctaatagtccttaaatatgtacaaacaaaatcaggtgtatagtgctaataattatgggtcttacacaactacaaagaaagttactaggtaactgtaaacaaaactacagtcgaatacaattcaaattaattacaatgatttaacatgaccaaggatggtgttttgctgaagtgaagtcagcactggcagtgtgtgtgaagcgtggattctaaggtacaggttctttggggctggtgtgtgcaccgccacatgtggcatggtgattcatgtttctcttcttgctatatttgaaccatcgctaagtcttcttttgagaagcatgctgtaaataccatcttgccttcatttagcttgaatacatcatttatgaatcaagtctacttttacgttttttctcatttgctaacaatacttaaaatataacctcttaacacaatgtattataaacgaaaaacaaaaatgggcataaaaattgcatggcagtattcagttataaagaattcatcaaaacaatccagaatatgcttaaatgaaaatgttaaggctattgtcaaaatatattgttgtatgggattcatagatcctggaaacatctatgtattattaatgtcctgtggaaccattttcagggcagtgggccatagtgctatgggccatactactatgctcatgagcagcagcccacagggaagataaggtttgagaggcaacaggacaaggggctaagaaaatgaatattcacaggtattacggagcacagtattgctgtggagcagtatccattgaaagagtcaattatggtgctagtccaaacagcacatcacctacatcacccagccaaaagctggggcctcagatgacagagaagccagaagttgtctcagcaccaggtgcctgaaatggaaacccattctggagacagtggcttccttactgtagctaccttcttgtcatctcttggtggtgagagccagtactttgccatactgacctgaggacttgcaggtgatgacgtttgaaaacatctgaggtaaatgggaggtcagggagctgtttccaacataaattccaagctgtgtgttccagctctgtttgaaactgtattttaccgtatttggcttattaccatggcagtagctgtatgatacagaatatgctttgtgagatttcatttcatttgaaatgcctatttttttttatttttagtgaatcaacatgtcttttcataaattgaggacatagaatgaatagcaattgcagatctgtacattgaagcatcttctggaattgcaataagcacactgaaaattgcttacggtgctattaataactcatagtggtggaaaagggggcatggctatgaaaaaatatatttttaaaacaactgaagatggatgcaagaaaatttgccagtcccatttggggagaaagagctggtgtgggcaatgagagtactgctattcattcaccaactttaaaagtatttattgtgcacctactatgactgggcccaggcatctgtgttcattgcaggggatataacagtaaagagattgaaaagctctggctctgaacttgtgaaagttatattctgggtgggagatggatattaaatgagaaaagaaacaaatggacagattttaatacatgctagatgtaaagtccttaaggttagaaagaacatggtgtgttctagggagtgtggcttttgctgagagagaaagggagacagaggcaggtcatgatgtgcctccaccatgatgtccatgtaagggttcacgttatgaaaggtccatgggctatgttaaggaatattcaatttttctaagtgtaagagtttactagtaaaggattctaagcagagatgtaacatgtgatttagatttttatgtgatccaacgactggtttttggtgaatctattggaggaggcaatagcgaaagcaggaatgccagggaagcttctccagtgagagaggatggagattgggtggttgctgtgaagataaaggaaagtgaatgagtttgagatatatttattgaagttaaatgcatggtactcgtttctgaattgaatatagtagggtaaaggagagggaggagtcagggatcactccagggtttctggctttagtaaccgcagataatggagtcactttgagaagggaaattgcaagatttctatttggaccatgttctttttcagatatctgtgaaatacataagtggagataagcagtagaaggttggacacattaagtcttaagttcaaagatatctgctactggagatatatcctgggagttatcaggatataaatgacatttgaaaccataaaaatgcttgagattggcagagagaatgatagggctcagatcaaatcctgaggatgcttgaagtttagagttagggtgcagatggagaagccaacaaagaggatggatacattgtgcccagggtgatagaaggtgcctttagcaagaaagcagcagcaggaagggattttaagaaggaggagttaattctgtcaaatgctgctgagatacattaggagatcagaaacatatctactgtattttacttatcaggaggtctgttgctggtgaccttgttgaagcagttttcataggagtggtgagggcagaaagctgccagaaaggaagagtgaattaaaagtaagaatgtggagaaagcatgttaagcaacgcatttgagaagtttggcgtagtagcagaaaaatggatcagaaagggcagatcaggggacaaatggaaatttgttttgctgttgtttggttatgtgtatgcatgttgatgttttaagatgagcgataccagagcatgtatataagtgaatgggaaagatccaatagagatgtttgaagtaggaaggaggggaccttttaggagcaagtggcttaacatctaggggtcaagtggggaaactgcccactgataggggaatggacatgcctttttttcttaacaagaagtaaaagatggatgcaggtaggagtgttgatttgatggttggaggatgagagtgtttctatattagacagtgtggtttctctgtgaagtgggattatcaaatgagagctgtaaagtatacatctgcggcctctgaaggtaagagaaggtttgactagtctcagagatggggaagaggggctaaaaggaatatgtagtaatgtccctctgacactctacacagctggttgtgtgaacttgcttcagttagttgtgtgaaagcacagaaaagtagaaagttgagttcaaaaaagtttagagtttagcctgggcaagtacatcggaaaacagatggccaagggagttgagcttaggaaaatgattaaaaagaaagattatccagggcaagtaaaggcaggagggcaggctgatgaatagtgagaaagtaaatagattaacggattggtatcctctatgagtgagaaatgtggcagaggctaaacaatgaaagtgagttgagagcctaagagatagtattttgaatcgtaaaaggttttaggtgagatggttggagctagcacagtttctggttatgataaggcgagggtgtgaataaagttgtgaatgtctgaagtggtttgagggaagagagtgttgaaggtgacaaggtcaagaaactgagagtccagggagactttttcatagtagtattttgagtgtttttcaaattgttctgtggcatacagaaattatatacataggaaatgttttatagagaagagtttcatgttcaaatacacttggtaaacactgcatactattctatcaccttcttcctcacaatctgtattagcataatagtttatattagcatatagaaagctccaagaagctctgctggaaagatacctgtttaatgtacttaattaatttatgttaattttattttagaacttttctgttcttgaccacctcctcatttcttacctttgctaaattttcttggctgttttcaccattgcagtcttccagactaacatagccacatttcagtaataatcctatatggactctaattgaaattaaattaaacatataattaaatttcagaataactgccttttaaacattctttagtttagtcataaatgcctttccacgtattcaaatactcttgagtctctaggtaaagttttataatccccccaacacacacatatgtcctctctgaatatttcttgttaatgttatttctggttatcgtttgttgtgctgctaatatggtgattatctttttccattgtattttgtaccattttattgcaggcatttaaggatgctattgatttctgtatatttactttatatctgtctttattactgaactcttttgtgagtattaatggcattttaattcattctctaaggcagtgtttttaagtctctgtaaggtatagaccaatttttaaagagaaaaaatgttttgagcaacctgacaatttaaattatttttgagataataagaagaatatttctaaaatgtaaaacttataactaagagtacacttcttattctggtggcttttaatcataaaccacaaaactaatcaacatcaagttaacagcacttatcatatatgttcttactaccattatttggctgaattcaaaccagtgcttttggtatggctgtgtactgactgtttcagcctagattgggtttagcatgcctcaactataatgtgttctgtgcaggctcaattctctctctggtttcctcttttcccatcactgcaagaccttcgtttatatcattacttgatgaaaatgcaaaatttatgttatgtccgactttgttcttttcttatcaatactcagtgattaaaacagtaatacttaggagcaattgtgtcccaatcaagtgacattcacaactataattattcttggcctgcaggccaaatgcagctttgcccatttatttactcaattatttatttatttatttatttatttatttatttatttatattgaggcagggtctcactctgtcacccaggctggagtgcagtggtgtggtgtgaatacagctcactacagctttgacttcccaggctcaaggcattctcccacctcagcctcccaagcagctgggagtatagccatgtaccaccatgcctggctaatttttaaacttttttttttttttgtagagatggggtttccttctgttgcccaggctggtcttgaatacttgggctcaagtgatactctcaccttggcccctcaaagtgttgggattacaggtgtgagccccagcacctgggctatttactctagatttgttaaaagcttatatttgtttttcagatgattagaggaataaagatacaagtatagaatcactgttggagactggaggatccctgataacatacccatgaacttttaggcttctgtgaatttaagtatgagaaatgttgctcttgggaagtctagataaaacaaaacaaaacacctactttctgcaaaaaattaccaattatatccctttcttttcagttgctatatatgtttgtcagccagaactttctgatggtagctcatgtttgaaaaaatgatagtatgcatccccccgtttttttgtttataatttaatggaaatacttttttataatacaattttataataattggtgtcaaattttaccacattgactttaggcatgtattagatgaacctaatggctattaataaatgacttcttgatgtcatgtaatatgctaatagcttttctaatgtcaagccattttgcattactgaacaaatgcctacttagttagtagtagtatacaatttatttaacatttcagatgtacaatttctagaatttctaaatttcttaaatactgtttcctagtattttacaccagaactggcttttatcttggagctatctttctgattctttcgtgttattgtattaggttttagtaccaagtttatgctaacatataaaatgggccaggaaatgtttagccagacttcagagggctagtttaggttcaagaatgataactcacaattagtttaatgttacttctacttggtttgtttcgtgaaccagctaacatgcagtctaaaaggtgtacagcagctgaggatgtgagcgaatggacactgctccccagcatctctaattcttcagagaagtgtgccaaaaactaggtaaccagcgcatcacgtagaaggtgaatgcttcaagtcagggaggcccagagctgaggtcttttgcctttacacccttatgctgatggcagttccacactgaattgccctataaggcatttcttgtacagttgggtactactttctgtgttctgtttctgactcttttacccaccctagagtagacccagttatgacttattaggaaacatccatttttttttccttaactcaggatactaatagaatataggagctattggtagttttgaagtttgaaacaactttctggtgaaaagagatctggagctttttttgaaaataattgctagatgtcttttcccatttattgtacactttttgatctactcacgttttatacttctgggtcaatctatggtcatgtttcctaggaagttatctgtttcctcagaattttcatattcatttaaaaaagtgaaagtgtttttcatacctttgggtcttctgtgaaatcctcatttgcattcctaattatgatgatctgtctctttgcttccttcactctgttgatgtctttgttccttttacaatcctctcttggataatgtaaccatgttcccttgcttctcatcctccctcttacaggagaggagtttttaacctgctgggttccttttaattttctggcacctgtgacttaggcttgaccttttcttgttgtaaacaaagatgattcttgctttccgggggctatgcaaaccacagggagacagccataagcatgcttagcactgtttaccaactaccttacgattcttaggctctcacttccctcccttcccttccatgcacatggaatgtccacgcctccgctggcttctctcattttcctctgttggcattgtcctgttatgccatggcttccctccatgcttgctgccctttattgttccagctggcaagacagagctcagtgctgctgagagtctctaagatgtgcttccccagaaagcacactctgacttggagactagcatgcaggaatttattggggggtcttctcaagatcgatatctgtgaaaaaaatggaagaaacagagcaggaaaatagagaagttgaactgccatgcagtcacaataaaaccctcagccagttccacaggaagctctgatgctggtatggctcagctgagttgtcctgcattgaaataaatggatcacatcaacctggcagacgctagtcattggatgtaccccctaggaaggagacataattctggtaatcctattccgacagaggcagctcttctccactaagggaaattcccagaaagagactcagctgaaagctgtcagttacccacacttccagaatcggaaggaataaatgtttcaggcctttataagggagctaggccataaagcccctgcagttattaaaggaagctttactgttacccttttcaacgtgcttttgattttgtttttgaaacttctcctgagcagccaccccattgtaagagttttcaaatttttctctctcccaaagaaattacatctcttttagccaactttagttgatttggcttctagatgatgccagaaacttgtaaggtctgtcattaaggaacatagagcaaattacccccaagatgagaactagattgcatttgattaaatgtgtggaactgcacataaacaccttctttgctaaccagggccactgccatagggtgtatctttagagtctgctgcctcagagtgagatattgactcaataacttttttttttttttgagatgaagtctctctctgtcacccaggctggagtgctgtggcatcatctcagctccctgcaacctccatctcccaggttcaagcgattctcctgtctcagcctcctgagtagctgggactacaggtgcatgccaccactcctggctaatttttgtatttttagtagagacggtgtttcaccatattggtcagtctggtcccgaactcctgacttcaggttaattaattcgtgccattaatttgtggcctattgcaggcctgaattcaatgctttaaaagttaaattgggaaacatatatatgttaattaagcgttagtttgacaactgatgccacaagcaaacgcagatgtagacatcaatcactggtgatggctaatgctgcatcttaaaagctttcagaggcgatgaataaaaaatataagatataattatctgcctttgtcagcagtattattaacttggcttgccccactccttcttagcacatgagataatatgtatggttttatttagcattgtgatattagaggtatgtgaagaaactgaaaaaggaaaacttgcaaacccatccccgccccccacttttttttaacagcttcaatctttcttcagtaaactaataattttaatcagattcctggaagtgacaatctgaatagagattacttaaaactcataaattatataaatgtaatttttgagacaatctattttaaattggcttttttttttgaaggaagttgatttaataaggtgtcatatgaatgttagatagcacaggctctgaaatgactggaagaattaaaatatacagtgttatctgactcggagaagagaaattatttctaaatcttctatgacacataaatattcagacccatatcctggatcagcctacaaggcttggttcagggtcagtaagaactacttctaaagataaatgatttttaaaaatgttttctctgttaatgtctgtcttcttctttaactaggatgaagaaataccagggtcacctcagcctcctaaactctctgggacttagttttctcatctgtatagtaaggaggttagactctaggaccacaaagattccacctgattctgatactctgtaattctgagatctattctagatagccaagtggctgtgtctctatagatctggggttcaggaggctacttcttacaattcctcaccaccttactggctccccgaggttgtcctagctgctgaggttgatggctttccaatggaaacggatcccagggtcaggagcctcatatagacacctttctcacttcctggactctgcacccaatgctcgaaacccggtggttgtctactcagaggaaagaaagtacttatacaaaaaagatacttgacatacatgttcatagcaacccaattcacaattacaaaatatggaaccagcccaaatgccccttaatcaactagtagataaagaaaatgtggcatacatataccatggaatactactcagccataaaaaggaatgaaataatagcattcacagcaacctggatggagttggagaccattattcttaagtgaagtaactcaggaatggaaaaccaaacactatatgttctcacttgtaaatgggagctaagctatgaggacacaaaggcataagaagtatacaatggacttttggaactcaggagaaatggtgggagggggctcagggataaaagactatacattgggtacgtgtacactgctcgggtgatatgtgcaccaaaatctcagaagctaccactaaaggacttattaatgtaactaaacaccacctgttccccaaaaacttgagaaaagtaataaaacctgagaaaactgagaaaaataataataataataaaagaaatccagtggttggattgttattagcatccgtgtaactatggcctcccatctatgggacatgacacttttcatttgtagattccagggctaggagtggtgggggataaggaagtgatcttcactgcatgtctagcaccagtgctgccaaaataaatacttgttttctctcttctcctggcacattctttcattcattcaacaaaaattgagaacctacaatgcatcaggcatggttctaggggccagggagggggctgtaacagtgacaaaagactgagaaaaatccctgcttttgtggggattacatcctagcaagagtaaatagaaaataaacataatagataagtacattgtatagtatgttagaagatgacaagtgtggatgagaaaaatacagcagagtcagggagacgggaaatgctggtagtgggaagcgtacgatttttagtagggtgttcctcactgagaaggtagccaaaaacagacctgcatagagtgagtgagctatgtaggtatctggagaagggtgtttcaggctgaagaaatagccagtacaaatgccacaagacaagaatgaacaaccaggagaccattatgtctggagtgtggtgagatgggggaaagtgggatgtgaagtagagattagggtaggcaggatctccaaggtcttgtacatcattgtaagaccttttgcttttgctttgggtgaagttgggaccacagaagagtctgaactgaacagtcacatgatctcacttacatttaaacaggatcagtgtggcaagcggggaggcaggcagatcacttaggaggctcctagaaaaatccaagaagagatgatggtatcttggaccacatggtagcaacagaggtggtaagaatggtaacattcttcatatatgttgggagtatagccaataatttatgaatgtagtgagtcaatcaataaacatttatcgagtaatcttctatatgccagctacagttccaggtatgaagaaatagtgaggaaggaaatctccagctgtgctgtgaaggaaataaagtgggttatatttgggactctggagagtgagtgggcgagaggactggtgcatttagtttggtcactgatgaggttgctgaggtctgagtgaggagaagcccccacatcaaaccttgcagtagagcaatccacttcagaggggatacggatgcaaaggccccaagacaggtacaagcttggcctgtctgaagaaacaaggagtccagtgtctgtgggtgagtcgagggagtgggaggtggagataaaagatgaagttggaatggtaggcaggaccaaatcaggtggggaatttgtagataagggaagagagtttgggtcactgaggcttgtggcagagacaccaggcagcttgaagggagatagacactctgtgtttgatattagaccacccactgaagcagaatgtcagctgtctggagcccatttgcaggagggctcccgtcccaacctgaacagtgggtaaagctggaactggtctgtgttaggatgacccattgtttttattattatactttaagttctgggatacgtgtacagaatgtgcaggtttgttacataggtatacgtgtgccatggtggtttgttgcacccatcaacctgtcatctacattaggtatttctcctaatgctatccctcccctagccccccaccctgtgacaggccccagtgtgtgatgttcccttccctgtgtccatgtgttttcattgttcaactcccacttataagtgagaacatgcggtgtttggttttctgttcttgtgttagtttgctgagaatgatggtttccagcttcatccatgtctctgcaaaggacatgaactcaggatgacccattttgaacttaattgcactcttacagctttgagctttcttcaagagccttgaagacttcagggcaggagccctcctcagggaacacagagggatgcactcagtactgcatcctcagtgttagcttagaagtagcagatggtgctaggaaaaccttcctgagtcccatacagtgaagggaaaaaaccatcagcttttctttcagtcttttctgtcactttcaagagcatcctgccacagtctccatcagtcaaaaacagatggagctggagaaattgtcaggcctgggaaggtttccctaaaacataattgtttggcaaaattgcttttctttgtatatgtgtccatgtttacactagatctccttcaggctgcagggtgcctttctggagcgaatgtgtctctctgataaaccagattcttggtcaaaatcaatttctgcttatatgaaatctaaacaataagaataacaacagcaataaagaacttagtttttttccccattcactattttgtaggttcttcctacgtatctttcaaaacatgattgctttccatgatttcagaagcaatacattttcattacagaaaagttggaatgtagaaaaatcttaaaaatgaaataaaaccatccataatcctattacctagagataaaccatagttaacattttgatttgaactcttccaatttctgcctgtgtgtttccctctctttttttctctctctcttaccctttctctgtaatataaatatttttctttttacaaagttaggataacagtgtagttactatttgccaacattctttttcaaatagtaataatatattcttcaaccttaaatattgaaaccataatttttaatgatttcttgcattctatcttttatgtactatagttatctaatgtttaatattgtttaaacacagtgttgtgattatcttgtatatatatttttgtgagtatatttattatttttcttacagtacttggaatggctaaagaaaatggattctatcattttaaggttcttcttaaacctcagctgataaacctaatttgtcctcaaaaaagtgtgtaaccatttatattccacagcatagataagtgctattagccctaccggattgtcttcactaatattatagtttttgactttgttaatttggtaggtaaacaagcgagagcccatttttgttttaacttacattatttttattgctaatatgttaaacatttttgtatgcatattatgcattttatttcttctgtgaattgcaaattgatgtcctttgctcatttttctacttgtatattcatcttagtcttttttatttttatggcttaaaagatggtcagttatttcctaagtttataatttgcctcttaattttctttaatggtgttcatgaattgtcagacatttttgatttatgtcatacccttaaaatctttatcatcttgcttctttccttgcttttataatttgaaagtcagtcctcactggtagactatttttaatttctatacaattttatagtttaattttaaagaattaattgtttagttgtggcttaccttgccttatggtgtgaggtaggtgtctaatgttattatttttttctcaaatagttgatcaaatgtaccagaactacttattaaataatcctaattttattgctaatttaaaatgtcttttattatatggaaaaaattatgtatacctaagtcagcattttagtttttgtagcattatgctgtgtttttatcatcaggttatacatatttttagctcagcttattttcaattttaatttttctctctttttcctttaaaaattgttttattcttcttttttattgatttttctaggtgttcctaatagttgtatcaaatttcaaatatacattttaattggaattgcattagatttataaatagttttgagagtgctaacgcttttatgtgaacacagtatccctcttttgcaagtcaacttctatatcccttaataaaattttgaagcttattttctttttatagaccttacataattctttataaatctgttactgtgtctttgagcatctggttcactaatatgaatagaaaccttctttcttctgttatctgttctaattgattgttggttttatttaggaaagatattgaccgacggttttattttttgactcatctcatactgaatggagggagtacccaggagggattggttaaacatggccaaggtgggagaggtgggtcagggatgcctctcaaggcaaaacactgggtcatggactgttcctttcattttctattcctatacagttaaggactgtgttgaacataccacagaagctcagtaaaaatcatttaaaaatgcttttttggttattcaaataatccttttttacttctggtaataatgaggatgggaaaggagggctaaacagcaatattgacttccactctgtatactttggagtattataatatctaggtcaatgtattaccaactgctaacagttactgagcactatcagtggtctaggctctgggccagacactcatcatggattaatgcatttaatcttcacaacatgctgatgaggatatcctctatttgaggatagaaaagctgaagtgagagaggtccagtaatttgcccagatcacagagacagtagggatagagtcagactgaatgaagcagggcagcagttcaatagccctggctcctaaaggctgagctacattgcttcttgggcattcccctcatgaaagtcccttccaagaataatatgacatcgtattatccatggcattatgatattggcaaacaatgataccttatttgctaacttttagaagtcaaactgattatagttgggatctcagggtaaagaggtactgtagcagaaagacttcccctcagaagtgaggaggtttgggtccctgttttactcttcatctaactccttattaagtcaccttccctttctgacctcagtgttgtcatctaaaaaaatgagggaggattatgtaaatttcagggaacattttaggaacactaacaaactgtggttgttataatacagtcttctggaaaatctaccttttaaaggaacattcatttgagacacatgttttctcgctggacagaaagcttattcttttaacaaatcaattactttagcaagctcttttctccattacattacatttcattttttattaaaacttaaaataaatgttcctgtaaacataaatgcacatcaaatgaaaacttccatatttgccaattcatagaagtactgaattttagaacatgaaagtatattagagattatctagcacagataaggaaactgaagctctgggatcctgaattacttcctgaaattacacagggagtaagtggcagaaatatgattgaaaaccatgtttggcttctagctacagcctgtattatgacagtgatttccactgtaaaaatatttgggtagcaaaaacaaaaaaaatgaagaaatttctaggagaaaaaggataagaaaaggggtttatgagttttaaagtttgaaggcttgaaaaacaaaagataacaaacttgccatatatatgagtgagtgtatgcttaatatattaagaactttgtcaaatcaataagaaaaaaggtaaacatgtaaattttaaaaatggggcaaaacaaaacacataagaaggcatttcataagacataaatggcccattgaaaactgttaaatttctctgctaatcaaatatatgcaaactaaaatgattagatgcatttttcatctatcgaataagacaagattaggtaaagatcacaccagcaggaaaaaggacaccctctcacttttcttttgggaagtggatgggaactactttttttaccagagaaatttgtcagtttcatcaagtgtcttaaaatgttgcatatcctctgagccagcaattttactcttaggaatttatctttaggagtgattatgcttgtttgtaaatatatcaatatatttatctacctattatttaaaatagaaaaagtcttgaaacaatgtttaacaacaagaaactggtcaaatgtattagtctatatccatacaattaaaaagtagtatttaaaataataatatagaaaatatgcaatgaaaagaaatgaatatttggtatattattatgtatacaaaacacaagctgcagatgggtgtttaattaaattcctattttaaaaaattataccagtacttaaaaatgtatccccaaaatataaaaactgactatagattatggatagtttttaaaattttgcctatctgtgatttttaacttttctataatgaccataaattagttttatgctaggaaaaaattaatactagaattatttccaaacatgcttacatggtttaaagaaactgttattatttttttcttatgctttctcctataggcagagtttgttgattaaaacctgctatgtcaattgtttgccatctttcagaagaggaggttgagtttcagcttgaaatctaggccatagaaagttccagaaatataaaaaatgtcactgtgtacaaggctaaggagattttaatactcaccagtgggcagagctctcataatatataactgatagactgatggatagaaagacaattgtatgggtatgggaccatggaaggcatatgaaacaaatctgtacaaatttggtttctggtttaggcatacagattcataagttcattacaattttttaaaattagaatacattttgaattactttgcctaaaaatgtattgtctttatatcctccttcaattataataaaatagtttgagtctgacagtcatcttttgaaatgaaaacatgatttaatgaaatgacatattccaagctctaagtgaaacaaatgtttggtttagcttgtttaaattaaatcgttgttctcctttgctgttattagtaagcacacttaatgtcatttcttgtttcacactgtgcatttagatgtattatggaaatggggtgggagactttgtagcattttatcttgcttgcagagtgacacttaagcccctgattggcaaaactctaatggtgatgatatttgtgtttatcccctactagtaaagaagggtgatcttctagatctaacatgaactttttctttctccacagtgccaagtgcattttctgtgggttttgggggagatataattaactgacatgtagtgatgtattatttatataaacagggctttagcactctagaatatcttatggaaatgtgacatctaattttgatgagggcacttggtcttgcattgagtgtcagagggactagcttagctgtgggacttcccacagatttatagaacctaatttctttcatctttttattgttatctttttggttttgtgtcaagttccaggatgagattcatgatttctgtgcaagtggaaaataaaattgcattgaatatggactcagagccacctttggtggccaatcatcatttttttctgatcttctctgtttgagtaccattggcctttacattctcaacacttaataatatactgggcacaggatgaattgtgaaatcctgcttatccttcagggctcagcacaaatggtacccttctttatggtagaacagaggtttacatatgtttcaccttttttatggcagttgcattttcttaactctccatctctacatctacactttgagtttccaagcttcctgagggcacagaacaagttttgttttgtttttttttttttcaaatttgtatctgcagataaaaaatgtacctaactcatagtcagtactcagtgaacatttgctgcctttgctgaccggaaccttgggatttttccagctgcttttcatacttcattctgaatccattctaagaaagcctttcttaaatgtagccttcacccttactccccaagaagaatctttgctcttctcttggattttagtcctgatgataccaaaaggcatcccaataagaaagtattaattaccctggtataatattttatttcaccaagccatagaaaaattggtattttaccaatttggagaaattaagagctttttactttcggatatacactagggtctgaaagtgattaacgtaatatgacttaattcccctactctgtaggacagtagtcatctcttctatgccctataggaccccaggaataacagagcatggggatgagtaaacaggtttgcctttcgctactgcatcttcctttgctgctactggaattaagtagaataggcttttgctgagtcagaggttggagctatgtccttaaattaaaaaaatcagttcatcttatgacatcttgtgattatggttgtgcataaatatgccaatatatttctctctattatttaaactagagaaagtcttgaaacaatgtctagtaacaagaaactggtcaaatttattaaaaagctcttattttctcaagagcccatctgcctggacccagcacactagccatagtagcgtgccttatgctaatgaaccacatggggttaggcacattaattaggtaaataggaccttggtgtcactctctgcttctgctaggaagaccatgctgtcaccattcatttctacaagctgtatctgtagctgtagcctcacttggcacagctatggctctgaactcccacagcctggtcttgaatcttgactctgctacttattatctttgggacactgggcaagtcacttaacctctatgagtctcgatttctccttctgtattatgaaaattttatttccttcataggattgttgtgattattaaatcaaactatgcatgttaatagcctgtaaacacttaaaaacgttagctgttgttgttaattaataagttcagtcatttgcttcctgtgaatatgtgccttagctatgccatcattattatgggggattgtctttgtgtgtgtgtatgtttctatataacattgcaacctagttctcattatacttgctgacatctggtaaaatgttatattattgatatcagcattccattatgtagcaaataatgagccagagagttgggagaagtagagtacaaaagaagaaaattcttgaattgtctaggactagctccattatctctgaaagcacttgtgtttgtggacatcctccacctttgtttttgtttttgatttcgtttttgttttgagacagagtctcactttgttgcccaggctggagtgcaatggcatgatctccgctcactgcaaccttcgcctcccaggttcaagtgattctcctgcctcagccttctgagtagctgggattacaggcatgctcagcctcctgagtagctgggattacaggtgtgcaccactatgcctggctaatttttatattttttagtagagatggggtttcaccctattggtcaggcaggacttgaactcctgaccccatgatccgcctgcctcggcatcccaaagtgctgggattacaggcgtgagccaccacgcctggccccaccctttcttttttatgcctaaagggactttgatattgcaaagcctaacaaccagcctaaatctgctggtagaagtgttagttcttcctactgtgcattaaccacagatttaaatcctggggatacaacagtaaacaagacagataaagcctgagttcacatggagtttatattctggtggagccagacagtaggcaaacacataagtaaggagtgtatgtgtgtgtgtaaaatgatttcaagtcatgataaaacactaaatcaaccagaataatgaaatagaattgactggagtggagtgacagtaggattggctttatcaaagagatcagggaagacttcactgaggaagtgatatttcagtagaactttgaagggtacacaggagttgaccagataaaaaagaaggagaaagctgttccactgtaaagttttagttaggaagttagactttggggccagatccacttttgactagctagccttggacaaggtatttaacctcattatacttttgtctacccatctgaaaaagggatttgctataaggattagattaaaatgtatttcttacattgctcaatttggtgctgtgctcaagaaacatgaactgtcattaacatttgcaaaggccttagagtgagagaaagggagatagtcttcgctgatacttcggattttgctgtcggtggtagagaagcaaaagtccatttttgcttctcctccagagaactggaggtgggagcatttatgcttctttctcactcacgtctccaattagactggtaagagtctgagacattaactgagccatgttttattagatgaggtaaatctctttaggaatggtctgtgttcttttcaattagctgaactctcattcttcctccaactcagccttagtctttctattctctctccttgaagggagtgagttaggcaggacttgcctcagaccatacattctccagattgtctacttgcaactggttggtctatttttccccaaggtagtttcaaatgtttagaactatgcatccaatatggtggccacttaccactgtggttattgatagcacttgaaatgtggttagtcgaatttgagatgtgttataagtgtgaaatgcacactacattttcataaattaatgtgaaaaagtaaaatcattaataattttttagtgttgattataacttaggctaatatctaagacatagttggttacataaaatatataatgaacattagctttacccttttgaatttgttaacggtgattactgaaaaacttaaaattacataggtggttcagatttgaggcttatatttcttttgagtagtgctgatctagaagtatgagaagactagaagcttccattctcccttagatctaagccacagttgtcaatccagttattaataaatctattaactagaaagcttttggctaaactttcttttctgtttcatgaactagttataaaccaaaaggtagaaggagtgaactttggttcatttgcctttagtgtttgagggactatattccaacatcaattggtatactgcaattcagttctggcactaaccccctggaattaccattgatcctacaagctaaagggcacattccacggcaagactgccctcctttcatactaactgactataaatctggggattcttatggccttccctgggcttgataattcatgggaacaaatcacagaattcaggcaagttctacagttatgattatagttttccttttttgtttgtttgtttatttatttatttatttatttattttttagacagagtctcactctgtcgcccagactggggtgcattggcacaatctcagctcactgcaacctctgcctcctgggttcaagcaattctcatcccttagccttccaagtagctgggattacaaacgtatgccaccaagcccagctaatgtgtgtgtgtgtgtatgtgtatatgtatttttaggagagatgaggtttcaccatgttggccaggctggtcttgaactcctgagctccagtgatccccctgcctcagactcctgaagtgctaggattacaaatgtgagccactgggcccagctgcttatagttttgttaagaagaatacaaatcaggaacagttaaatgatgagacacagaaggtgagttctgggagaggccctagcacagagcttccatggcttcttcccctggaatcagggcgcatcaacctcctggcacactgaggtgttcaccaaccaggaagctctgctgagcttcggtgtccagaggttttattggagttttattacacaggcatggttgattgaatcactgaccatttagttgaactcaatctctagtcccccttctctccctggaggtcaaattgcttcaaaatcccaaccctctaattataggcttcttctttttggtgaccagccccaatcctgacattatctaggggtccaccatgagttatttcattagcataaacacatgtgtgatacaggaggctcatatataacaaagacacacttatattacttgagaaatttcaaggattttagaagctctgtgccaggagcctgaaacaaagaccagacaaattctttgtaacacaacagactgaaaagtgcagtgtgagaagagcaaaaagacgaattcaccatttaactaatgtttattgtgccgcatttttctagacacttcagatatattagtgaatatcaaacattcctgttcttgaaccttacattccagcaggtgacacagacaacaataaacaaactaactaataaatcaattataaaaactatttgaagttggtgctatgggagaaagcaaaaataaaacagattgtcagtgttggtgtggtgtgattggcaaactgtgggttgtaatttgtaatacactgttcagtgtagatcttctaggagagtggcactgaagcaaagacttgaaggaagtgatggagttagccttgcagcaatcatggagaagaatgttttagtcaaggaaatagccagtgcaaagggctgaaggcaggtatgtttctgtcatagtcaggaaacagctagaaggcccttgtaaccagaaccagggaagacagtgggagaggagagaaatagaggcagcaaggggccagatggtgtagggactcataggccattgtgtagtctttgacttttttctgagtgaactcttccatttggagaatggcactaacttcctctttaataaatttacacaggctgctgtggtaaaaacggactataacaaacaagaatagaaggaatactagttttgaggcagttgtcattttccaggagcgagatgatagtagttcagaacagggtgttaagagaggagggggtgacagtcggtcaggttttggatatgttttgaagctagagccgataggatttcctccgaaattgaaaactgaggggttgagtagtccaaggtaagactgggtactggatgtcttctaggctatggtaaaaagttcagattttatcctgtgtgcaatggaaagctgctgaagagtataagctgagtggcctgattatattagcatattataaaagtcactctggaggttctatggaggaaggatgggaaagtggggaagagtggagggtggggggtggagaggtagcatttaaactccttgtaggtattaagtgctcttaagttagatgacccatgtcatttcatattagacattaaaacacacccacatctcctattaaataacaattttgctataaaaattgtaaagcagtttaataattttgcttgtgaaattatttgacctggattacccatttaattcacaaatcactttgattcctcagcaatcattatgcatacttaagtgagaaaatctgacctacaagttgatttcagatgtaaacatattttttacaatttgtaatttttaacaatgtagagtttaatgatacagtggtacattgtgtagacaaatcaacacatcttaatattgattatgtctgattatgtcatcttctttttgcatttttgagcacatactttcttttatacaagtctctaaggtttttataggctcctaaaaaccttataggctcataagcctaatggattaaatgactctggataccccgagaacagttagaaagctgtgttgtctgagagggacctttaaaaggatctggttttcactagcttcataaaggcaggattttagagaaatccaagtgtttaccatgtcctagggtttgttatataatttctacattcatttttcagaagttaccttctgtttcttgtacaacttatcttgaacttgctagaatgattggatgattttgctccttgactcgatttgctataatacggtctgtttatgtcattgtggaactattttccactctgattcagtgaggatgtctatagaattattaagaggctgaaaaaaagacacaaaacattgattttgtttttaccacccttgataatggattctctttttattttcctggtaacctggcattggattgcatgcgttgcattcaaagagaactctagtcctagctatattacacagggctagatgtcaactgtggagtaaataattctaaggggacactgctcattttaactctgaattcacttttagttactataaaatggcaaaagattttgcaatgaatatgcaaagaaatgtcttttctgtattcaattgaataagtgcttttgagattaaatgttctgatattgtatgtgctacacaagaaagaggaaatagttaagaaaaatcaaactagaatttttaaagatcgagttattttccccttgttcatcagaatggacttgctaggaccatttataaatacttgttcctttgtaggggaactcacccatgtctaccctacatgttcctaattcagttgtaattttgaatattacaatttatctgatttgcagcctattcctgagtggtattcttagtttcacttttaaatgaatacggttcatcagatttgattgttcttttgtgcccatttgctttggagtccttgctagtaatgaaacaaaaggcttttcagatggatatttgagtgatgaatgatgacacctttttctctttaccttacttcaagctgccaatctcttcacaaagacattgtgtctccctgttctcttagtacaccattttcattgctgtgatagaaaatcttaacagtcagcactgaaattgccttcctcacgtgatcatctcacactttgcatggatagttgcctgtgataagtattttactttcttctcttactgtattagtggagttggtagcaggatgattttttggcctttatttttgttttaaatacaacataaaaaagtacaaaaggaaacaaccaaaaatatggactagggatttagacttttcaatccacagcttttcctttctctgcgtactttgggcaagttaatttatttctctctgtgttcatcagctcactaatctgtgaaataaaggttgctatcattcattcaatgcatatttattagaatgcctatctttcaggaagtattctaggtactgagtatatataacactgaataaaagagttccaggtccagtgtggtggctcatgactgtaatctcagcactttgggaggctgaggtgggcagatcacttgaggtcacgaattagaaaccagcctggctcagcaacatggtgaaaccttgtctctactaaaaatacaaaagttagctgggtgtgatggtgcacgcttgtaatcccagctacttgggaggctgaggcaggagggtcgcttgaacccaggaggcaggggttgtagtgagccaagattgcaccactgcaatccagcctgagcgacagagcgagactccattgcaaaaaaatttaaaaagtaaataaataaataaataaataaataaatagagttcctaccctcttggagttaccttttattaaggtgtgaaggagacagcaagtgagaccatctgacacatatattccttcctatattgctatttctttttaccttttctcccttcacagtaaggaattagcttcatgaaagtatatttataattattatttttgtgcttcatttttgttgctttgctttcaaatctgaaaggggaatttgtggtgaagttgtaacttttaaacataagagttcctaacaagtacaaggaaaggaaatgattaggagaaatttctggacagcgctgaagtcaaatgtcctagattctgactgcttgggagagttaaaaccttctaattttgcaaacatgatttttttttaaagtcttgcattttaaagtagtgttcaaaaatctcactggcccagtctgggatgtaacactactgtctctaattagagtaaggcttgctcttccgaggcctgtatgctgggaggaagacaactcacagtgctcagaggaatatcttcagaaatgtttttgaccaaaggaaaaactaatgaagaaattttacagagaggaagttctctttccttggggaaaaagatgtgttaacgaaggagtctgaaaactaactgcaggtgaattgcaaaatgctttggagagcattggcttagtatataccatgaataagatatatttctaaaatagtataatctatattctttaacagatttgtcactttgtttagaactctattctaggccgggcatggtggctcacgcctgtaatcccagcactttgggaggccaaggtggatggatcacttgaggtcaggagttcaagaccagcctagccaacatggtgaaacctggtctctactaaaaatataaaaattagccgggtgtggtggcacacacctgcaatcccagctacctgggaggtcgaggcgggaaaataacttgaactcgggaggcggaggttgtagtgagccgagattgcatcactgcactccagcctgggcaacagagtgagatgccatctcaaaaaaaaaaaaaaaaaaaaaaaaaaagacctctattctagaactatattctttaacagatttgttgctttaagtacatttttctcatagatggagatgtattcattctggtgtctagtggcctttggatgtatcctagaccctgtgcctggatgaatggaggtctttgtgcaagaaggggccctattgatataaatgatggctaacatttctggagtgcatatcatgtggtatgttcagttttataccttttacatatattacctcatttaatcatcacaacattctctccattttagaaataaacataaaaggcttaactaatttgcccaagaccatggagttaataaatagtagagtcagaatttaaagtaggaccatctgagtcaagtctactctttccacttcattagataaacaacggataattctataagaattagaatccactgagtggcctggaataaatgtagacatggaataggaacttgctatattagtctgattcttactctcttctcacttctctttgcccttcaacacacacatacacactgaaaacacacataatacttgaaaacacatttgtacgcagagataaatgggtgcagccagtgggcggggctgctgagcaaaaaggccagtccaccgataatgcagattgtttgctattgacgattagattcaggatcccaagtgcctccaatagctgtgcagtgtggctagaggtgcattgaataaatacttggggctgaattaattgagcagaactaccttttgaatacctaaagtttgcctgaaggaaatcttcagggccttggagagtgcttaatatgtattaaataaatgaggctttcggggcctggggagcccctaaattaaggcagtgacaaagggaatggattagctctaaacatgggtgtatacataaatgtacacattcctttggagtccacatttctttggactcaaatcctacagaatacaaccagacactgcttttcattcagaattttctttcttgtggaaacactccatttggctcttgtaatttggatttgaaagtagtgaatgtctgtgtccatttggcacgaacagaaggccttagaatttggacacaggaagaatagctaatggatacagggcttaataccttggtgatgggatgatctgtgcagcaaaccaccaggacacacatttacctatgtaacaaagctgcacgtcctgcacatgtacccttgaacttaacataaaagttagaaaaaataaaaaagaaagaaaacagacatgtttgttcttcaactcttttgaatggtttattgcatggaaaattgttactcacagtatcatccatttacagtgagagcttctataagttgtcaacaccacttaaagacatcaataagtagagtctttggacactactgatggctggcacctgacttaatagagggactggcactctggagggaggaggaatggaagggaagcaacatggggagtaaaatctatgcatttagtccagtaagtcccacccttttgtgaagctgtttgacctgatgtcatctaattaaagctactcttccatacaaagcattgtgtgacatatatatttaaaattatgtttaaaattaactagatttttggtttgaagtattatttgtagaattttagtatctttcttgactgaaatgattgtgatactgtagggtgggaatcactgattaagggccggtggtgtagactagaaaaatatggattttgcaggcaggaggccaggctcccctgtcaatttcaccacttgctatctgtgtgatcctgtttgggaaagccatgtaacctctctgagcttctttaagctttaaatagttgaaatgtgtggacacaatgtccaacacacagtaagtgcgctataaatccttactttcattccttcccttctttcaaatagatagacgctcatagataataatgatgctgtcaggaaccatgtgataacgtatattggagggacaaaatagtttccttgcctgaaatgacgggtttgctcatctcacacctcgactaacctacttactgagtcactccaaggctgtttttttttttgaagtagcctaatgccaaacatatgctgacagtgatttcaatgtggagccttgtactaaattaaatgagaagaaaactcaaaggcagctggatgtacactagtatctatacatatcttgtctccttggaggttttctcatttaatagaggtagaaaatttcaggagttaaactgcccttataaagaaatgaaggttttaaaattagtagacttggtgtttgaggatcctggatgaactttaatctagagttttttatactctccaaatggtattataaggttggcttctcagagactaaagtaagagctaaaaggaattagaaaaccagatgttggggctgattcaatagcagtaaatcttattgctgttccaggggctccatgaggattctgctactgaaattgaacaatatttttcctaatttgcaaaaaaatacattaatacagagagtgtgcttattttctaggtttgcatccatgctttttcttaattttggcacctgctatttcttgccttttccagagtcttgtgtgagccgagcatataccattcagcacagtattatttgagtataatgtttcaatagttcatgatgagttgcagagcaaccatgacattcaagttagcgtctcataaaatctgagaatcattgtctgagatttgagcctaaagatgccttaaaaagcatctttaagtatgagtgaccttagccaggtcaactatccctcttgccagatcgaaaatatcagaaaaatactttttctctcccttattctgacaacagggagcactacttatcatgcttacttaaaaactgacaaacacatctcccattgtaaagacgctaagcattttaagtgctaaccttgtttttagccctcctacttcatatagtccaggtttgcctcagaatctcagaacatcaccatagctatgaggttaagagtgtagttttgcagtcagggtgacttggttttaaatcctgccccattcgctgtgtaatcttgggcaaatttggggcctcagttttattatttgcaaaatataaatagtaacacctcactagtaagtttgttgtgatgataaataaattaataagccagaattgcatactctctttggagaagggatcacctctggtttaaacattgcagtaactccagtgcccatagcatacactcagtaaatattacaaaagaaaattaatggataatgcatcttaagcagttggcaacatgtctggcacatattggcctctcaataaatagtaaagatggcaataataataatggtagttgttgtatcattatcattaagttactacatcttttgaaataaattttgaaaaactacaaagaatattttgcggctggaagactggatatgtttaaaatgacatttccgaaggcagcctcctaaacttcaatgcccttttcatatcatcagtgtagctttggacaaaacagtctctggccatgtcttatttcacaaggccaaactttgagaataatctgacttccagtctccctctcttgcaagctgtgtttccagactgttgagtggctcctggaagcagcaggtggttcatggatgcagacatcaggaatcaaagctcggctctaagaggggagaggatggaaagttctttgagtccttttggctgaataggtgtcttaatgagatgatcactccaggaagcatttctatttccttcctttaaataatgagagtatctttgagtgaatgtatttaccttccttcaggcttagtttctttgatctctgatgactcactttgtctcacaacaatgatcagggtcttcattatgctgcccaatttggtagcagaagcccatgagaagcaaaaatttggaagccacaattttctcattatcatggggattaggttgccttgtcaacaatatatgcagaagagaataaatttaaactagcaactaagatatatttatcaagacctggtctattaacttgtttagctttgttgtgcaagccattcaagtttctaatgtggcaggtgaacttttgggtagcttatgttgctaatagccaaatggcatataataatcaaagcaataaatgtgggtattattaagcacaagcgcaatggcccgaaatagaattgctgagtgcttataaattactctattattatttgaaggaaagaacaatccaagttgaaatatggaagctacacaccacacagttctttcactattattgtcctgtataaggtgatctctgggttttatttacaattctcagataagttattttttctccccagctgcagaactcagtcttgaattccattttcattttaaacatcaatagttcattgtataagagcattcttcatgctgcaagttcttggcattttctatgaggaatatagcacagtaacaattctttatagggataggagaaataagacatgacagactaaagataggtggttaagttgtaacaaaacccagcatataaagcttggcaaagatttatacagagaagcaaaactactgttcatgccagagaaatcagtaaagaggaactgaaaaagaagtgaagaacgtatgcttcaaagctataatgagacttggctgcctcaggcagtatcagtaaggaataacatgccctaattttgttgtcttagaagcaaaacatttctttttctgttgattattcagaatatgtgccattagccatatgtgtacattttagtcagcaatacagctgtagcccatatttcattaacatgtgttctgcttcctgctcgaacacacaacacgcagaaatgtgtccctgaccttttaatctagcttgctctttcttccttcatttccccatcgtttataatagcaagatccctgaaccctctcctagaccacctccctcctttttctctgttgctggcattgtaggtgtctcgtcaatttggtagaagatgtcttggaatagagcctctcaaaacctggaaattatgttgagtctgtttgatctgattaccttggaggcagatgacaaactttcatcagctctagcattttgtaaataatctttggtaaccatcatgggtcatctttgagtagattacttgggatccatctagagtctcagtgcctggagattttaaagaaaaaatcagagggtacacgttccaggatggcttgggtcagtttgctgaatggaagaaggaaaaatacaggtatacaccaattttgggtccattgtggtctgacaattttgggaatctatggttggatatatatggacgtcagcaagtacaacttatctaacgaatgagttgattttcaagttgagtccttgtgtaatggcttagtgttgagccaaagaaatgccagacctttgaatctgcatgtcttcatgggtagggcaagaccttgatgcttaaagcccatgtatggcatcacagctgtatgtgatcaaagactacttggtggggtctgaaggtaatacaagctcacagaaccaaatgttattatgaacaagcacagtcagggaaggcttcctggaggaagtagcatttgcaatgagatttgaaggaagtaaaatgaaaacattaaaagtagttgagttgtttcattattttacattttagtaatatatttctaaacgttacttcggttgctagattcaaccaattaattcgagtgctataaatagaaaatgaataaatttttcaattatctgtttagaaatgtacaaagagaatggaggtagttttaaagaggcttcttttaggcaaacaacaacaacaaaaaagatttaagctaaagaatataggaaactacctcattccaataggtgttgaatgtcaagtagtcagaaattttttaaaaattggaattatatactggaaaactagaggaaggctggaaaagtcagagtctttaagccttattggttgaggatgagttctcgtgtcaaattacatttctaagagaataagattcttgcgactcaagatgtggttctgggaccagtaacatcagcataaactgggattctattaaaaatacataatctgagtaccctcccagacctactgaatcagattctgcatattaacgagactcctggatcatttgtacacactttaacatttgagaggcagcagaattctcagatggacagcctgttgtaatgctgtggtacccagctgataatcagcagaatcatctaggtggtatttgttaaatttaattaaaacatttttttaacagtaactcagatctaatgagtcagaagttgggggctgtggtaggcagaggttgtagaaactgtattatatataatatagaggtttctacatttcaaagagtttcacaggcaattctggtaatccaggtttggatgctgctgatgtatgagactagagtagtgattcataactctaactgctctctagaatcatttgtgatgtttaaaaaaattataatgctaggttcagtcctccagagatactgatttaattagccttgggtggaatttacacatgtgttttttttttaaagcagacttacttagatataatttatataccacaaagttcatccatacagcaactttttttaaaaaaggtttcaggataattctgatgtgcagtcaagcctgagaacccctggagaaagactagcaggaggctcttatatactcccattgggaaacaaagagatctgattttcagtagtgtcaatgaatgaagtctgtacggatgtgtgaggctaagatgtagagagaaattcagagaattctctgaggttgaattaacagattttaaaaattaattttgcatgggtagagaactaattcaatagtctaggattatgtcagtttcatttgaccgactagatggatagtgacacctgtgggctcacttccctctttcctgtgtagggctcatttttattcagagattagggaaatggcaagaggcataaaatatttagactttcagattatttatgaaattcaacatagccaaattcagcaggagcaacaataggtatactacacccaagaaactcctgaatatcggaatttagtaccttttaaatctgcaattaaagacaatctgtgttgtgatctatcccttgtttgttgcacagacccttcttcatacctccatgtatcttccttaaaggtgggttgataagaagtacatatattgctacactctgaatactctttatttacacatgcctgtttttactataatatcacaaggaagaggcaggagcttcatgcttgaggtaaccatgagtggttcattctcagatcagtctttgtttgtttgtttgttttttgagacagggtctcactctgtcacccaggctggagtgcagtgatacactacaatggtacaataatgtctcactactgccttgaactcctgggctcaagtgattctcccacctcagcctggataatttttaattgttttcttgcagagacatggggttccattatgtttgcttaggcttgtctcaaacacctatgctcaagtgatcctcctaaagtgctgggattacaggcgtgagccaccagacctggcctaagatcagtctttgacaagatctcagctctacagtgttttcaactcactttactcttgaattcataagaatgtaaatttccagcaattttctccttttatttttctataatcggtcatggggtacagagttcagaagaagtatagttattgagcatggtcaggagataaacctggtcttagaacagtaggaataattgttggaatctattagaacctctaactatgaatctcttggaattttattgattctgagcaaatttttataaacacatacaaacacatacataactggacattttaactgttaactaaggatgactaaaacagttttccagagtctgagggaagttttattgagttggattgaaaaacagctgtggaaacggtcttttattctctgtatgtgattggcacagttaatagaaaaggattggaagcaggctcaacgccttcagtgtttaggatgaatgagattccacatcaaccagaaatggggctgaccctgtgtaacacggataccacattctaggtggatggagtcagggtttcccctcagttcctcttcattggcccctcactttcatccactagagcctgtaactgtaaacaaggtttgggacgttgttgggatctgtggttatttcacacacagtggtggaggcaaggctgatggagaaagtgacctggaaatagtacatgtgttaggaattatggcttttcattggctgaatttggttaaagaaggaagttaaactctctcagtttcctaggacaaaaatccttctcagactcacagagccaggcagtggaggtaagagaatacgttatctctagccagcggagctgtatttgatgagtgagcaaaggtttattcatgttgctataatttggatgcttgtgccctgaaaactcatgttgaaatttgatccccagtgttggaggtagggcctaattggaggtgtttgggtaaagggggcagatagcgcatgaatgccttggtgctgtcctcttggtaatgagtgaattcttgctttattagtttccatgagagctggttgttagaaagagcctggcacctccccatctttctctctctctgcttgcttctttctctctcactgtgtgatctctgtacacgctgaatccccttcccctcctgccatgagtgggagcagtctgagatcctcaccagttgcagatgccaacctatgcttctgtatagcctgcagaaccacgagccaaataaacctcttttctttataaattaccgagtctcaggtatttctttatagcaacacaatgaactaagacacatgtcaacccaccttcccattttaagtatggaaagggcaaataatagcatgcaagggaataaaagtagtgataaaaagggtcattcacaccgagttgctctctgtttctttaaagatgcataaaaaggaaaataaatgagctaatttaaaaattcacctgagtaacatgacaatattattctaaagacatagaggaaatgcatactcttgtaaatgatgctttacaggcaacaaaaggcaatttaagatgctatctcattatgataggaaataaagatatatatcacaaagagatatcagaatgctataaaaagccaataagccataaaaagtcaataatctgagatgataggcatcttgactgagaggaagaaaccaccacaagaatattgaaaattcaagagcagaattagggccaggaatggtggctcacgcctgtaatcacagcactttgggagggcgaggcaggtggatcacttgaggtcaggagttcgagaccagcctggccaacatggtgaaaccctgtctctactaaaaatacaaaaattaccctggcgtggtggcacgtgcctgtaatcccagctactcgggaggctgaagcacaagaatcacttgaacctgggagacggaggttgcagtgagccaagattgcatcaccgcacttcagcctgggcgacagagtgagactctgtctcaggaaaaaaaaaaaaagaagaattaaaattcccatactgtaacataaataaataacatattacaaaatagaactaatggtaaataattcaaaattaagaagttgtcttagaaagcagagggaaagaaagacagaaaagatgagtctgaaggtagcaggtaagatacaaccacagcagtgtttctcaaatgaaacataccaaaatatagattagtaaattatataataacattttataaagcagaaccatacattcatctgtagaacacaaggctccaggtaacaataatagagtgttacacctaattacgtccttatgattttttcaaagataatttttttcaaggatacaaaattctatagaggaggataaaagaatgaaaagtataacctcaaagaaacaaaaatctagtgcatcccagagcttttctctgcaaaagaaatcaaaacataaaagataaatgctactacattttaatggagaaaattatgtgattcaataaatacatatccagccaaatttttctttctatatgatgataataaaaagtttaagagttcaaaaaacacattgaataaggcactccacataccagcaggtaatttaaaataaagaccccaagaataatcacttcattaaagacacagaaaagaatatcaaagccagttgctcatagaagagaattaaaataattgttttacataaattaactactaaggcagaacacattaaaaagaaaatataaatctaaagagaaaaatgttccataggaaataggcagtcatggtgcaaccgcaagggaaaatgaatgcatattaaattttatatttcacatgtgagtctgaagtgatatattgctctacaactatctatatgtctctatattctcacataccaacatacacacagagatacacacatatatacatgcatactgcatgggtatgtgtgtatgtatatattatgtcatacctgcaatatatgagagaaggtggggaggcagataagatttaggtgttgaaaatcttaaaagtaaattctagtagaattaaagatagattagttttccaaatcaccacatcaggtacaagcaaactaatcgtagtcctcttaataaaacatatagatttttaaaagataacagggcagcctacaatatagaatgtcaaatataaaataataaaatattaactatatggtataattaagtataaatggtttagcttcccacttataaagcaaaaactatgcatttgtattttaaaaatcaacaacattaagttataagactgataactaaaaaaaaaaaatccagaattgggcaaatgtaaagcaattctgaacagaaagaatgcagtggaggtaatgttaatatctgtaaaaatagaattcaagggaaaaaaccttgaaagaattgtgagtgactagacacttaatattgatgaaaggtaaacttcatcatatagacatcatagatatgaatctgtgtttactaataaaacatgaaaacacataaagcaaatatcttaagcaaggaagattggcagaaacagacttgcagtggcagattttaatgcaccgttctcagtttgtaacaagcgacacagaaaataaatacaagaataaggattaaataattcataaaggtgaattaccacatatatctcaaaatttgtaccctatagagaatattcctatttttcaagtgttcatggaatattaccaacaatgatagtagaaaacactagtcatgtttgtaaaccaggaattatttggctatacacagtaaaactctgaaagaatgacaaaagtttccacaaaccaagaaaccacaactactgagaaacgtctagtaaagtaaacctcctaaataacaaattgttcaaagaaagaataaaacatgagtaacaaattatttagaattactagaatatatgggaataaacacagcactatatgccaaacttccacatggccaaaactatattttgaaataaattcatatctttgcatattttgtcattccaggaagtgtgctctatagcactgcctagaacagaaggtaagttattggaaataaagttaaggaaaattgaaaggggcagttgtcagttgctaaagtgctatgaatgccacttacagtagaagataataaagtttcttagtgatgtgggtggtactttttgaaagtgatttctggatgaggaggggaatagaggattggtagagaaaatgatgaccttggttttgaacatactgatgtgtgattcattactacattaaaacaaggtaataattacaatcataatgacagtaaatatttttattaagggtttgaaatgtcctagacactgtgctaagtgctttacagtattacctcaatgaattcccattatattcctatacctttaaagtatttgtctatgtcttattttttcatttcaattaaatataatggctttatttttaaaaagcaatacagcacgtcataaaaatttaacttgtaaaagagattattgaatgaaatgtgttaatatagctacctcttgctatctcagaccaccaacagccctgtgtagaaataattacttttcttgtttcttggatgtccttttcatgatctggcatgaatattcggaaaatatgtacgtatagatttatgcatataaccctttttatttataaactagaggcatattatatattgttaaatacctcctttttcacttagtatgttggatatagtctcatgtgtgcaacatatagaatcatattatatctttctatgcctatattgtattcttagtgtggctgtggcatgatttatttaaacagatcactattggtgaatcttttaggttttttccaggtttacttccaaaaagaacatttcagtgaataaacttgtacctatctgtgcacatggtacatgcatatgtttatctgtagaaaaataatcttgtaagtggattactatgtcaaaggtatgtacattttaaattttgatagatatttccaacttgccttccaaagaatttgtagcaatttacatttctaatagtaacatatgatagtacatctttctttacatcctcgccaacaaagtagtgttggattatatgatctttgccaatctgatatatattacatacacacacacacacacgcacacacacacagagataaaatggtaccttattattttaacttgttcttctttgagcctttttttttaaacaggatcttgctctgtcacccacatcctcctcccatccatatgacctttcaagtcattttcttagaattggctctgtagattgttgtcaattctttatccacatccattccataaactgttccaattccatttccagccttatcactcttctctgacttaatgttggcagctccaggagacatatcactgctgtcaccttatttgatgtctcagtagcatttgacctttgtcaatcaccaacccccttcttgagacactttcttctcttttctgtggtaacacattctattgtttcccttgccacctttctaattacccttttttaataatctttgcaggctcctgttctatctaaactaaatatgttgaagttttctaggcttccaacctggtttctcttttcctttttttcccccctataaacgaaggtgatcacagatcaacatctccagcccatatcttttctttgaggtctgaatttgtatccaaatgcccaattactatttcagctcacaaaatagtgtgtcttaaactcaacttctaactttctactctaaatatatctctggcagtctttactatctcagcttattatagcaccgtccctccaatttgaacactggaagcatgagagtcattcttgacttcatctagcaagtcttgtctagtttctctggaaaatgtgtctcaaattcatataattttacccatgttcaaactgctatgatctcttttgtgaactagttaaataccctcctttctgctctccatatctctccttctactcatccaatctaatgcagccagagtgatcttcgtaaaaagtataaattaaatcatgtgaatactaactgtgtgttcagggacttatgaaggttatctcatttatttttcaaatgatcttatgagacaggaactactatagcccttaaagaagttaaataatttactcagatgggggaactgagatttagacgcaggccacttggctttagagcctatactctgaaacactacgccatactctctcacaaaaatgtaccattttcttcctaacagcaacttgaactattgtagcttaatacttcacctgtattgcctctggggaccttgaaaattacagctgaattctttacaatggcgatcatttcttttcctggcactcggcatcaaagggagtcttggtttaggcagctgaattaggacatgcttgttggggctgcatcctgaactcctagagggctccattcaggtgaacaggattttatacacactattttatgatgctgttgatggggatgcactacaggaaaaaatcattttctctgaaagtacagattaatttagaaaagcaccaaggtgattctatggaaatagcatatttacatacatttctcagcaactgcagaatacctactagtctcttatcagttaatcatagtaatcaaagatgcagagagagaccgtgtcattatatgacaattttcccatgacgatctgcataaaaacaagcactgctagttctttctctccaatccatcctctctatactgttaaattcatttttctaaaatacagcccaaatccaggaagttcgtggtttaaacttcaaagtcttctcttcccaacaaaggccagatcttgctctagcatttgaaagcctctaggatctggttcctatgctattttttctcagacttatctctgtctattccatttatgtacatgattcccctccccccaaaaaaacagttaatttttcctacacaagctctatattctcactctgtgtcttagtcttctttgttctcatatcttcttcaactgaaatgcttcaccctacccaacgtctgcatttaaaaatccttatttaaggtgcgaaaacatacagcatagtgctaggtagaaattaaattattgttactatttgctactctttatttttcctgtagcctgacttttagtagagaagtggctcaggaaattggattaataagaatgcagagtacagtggatagactatgttggtcagctagagcctgcggcttgaataatgaatattcagatagaggtctctgaatctccaggctagtcagcaagagtaggcatgtggccagctcttggctgaagtagagagaaaggagcaagtccatacataagaattaagtcagtatgtgtttttatggggccattggtaggtaaaaaatatcaaaggtgtcaaccacggggccattggaggaaaatgatcagaagtgtggtagacaaaagatagcccgtagcagattgctgggtgtgtgttactcatatggcatcaaatggtctgaggtcagagggtataggggtgttttgcccagtcaaggaccagtcttcccaaactttactgctaaatttccttttataagagccttacggaagaaaaggaggcttggagaaacaagtgacttgctcgaggtcacactgctagctgtattccttatggtgccagtgttaacaggttacacactgcttctcagaacaattcttgttggcagttacaatacaaattgtgataggattcaagccctatcacagggtgagtggaaggaccattcacacagatcttgaatgctaaaataacatctagcctttgcttgtcagccactgggaagacattgaagtttaaaaaataaactagatctgggctgtatcttagtttagagtatgtatatgtccctgtcagcttatacctgaactacagagacattctgagagtattgaaagtgttcatctgtcattcaactttaaacttgggtcttattactgtccctcactgcatgtagtatcatataaattaaaacacattaaatacttttattattgtcttgccaatgacaaaatgaaaatgcactattatgttaaaagtgttaatttatataaggcaaaagttattaccatttttgtaatcgtattttgggatttcattaagaaatatacaaggagccttataaaatagaaatgacttggcagggacatgatcatgatggtgtaggctgcacttggcactaccccagggagctcttgtggatgactacagtgagcgttctcattgtaattactgcaggtttatattgttattatggtgattttcaggcagatgacattgaaatattgtaagtaagagatgctttgtttcccttgtttgtccacgattgccgttgcagataatagtgatgctatgtcctgagcttctcctgaacactgaggtcctggacatatgtgcatcaatgttagtgtcaaagatagtttatgtatgcatcatctccattttctagtttttctggctgtttaattgctgtaaaatagaccaatatgccattcaaccagcaatttctttatctaataatagagtgattataatggcacctactgcatatgattgctgatagcataaaatgagataatgaatactttctaaacatagtattttgtccaatagatgttaactcttatagtgatcgcttgatttattgatttatgaagttggctctgggctcagtaggtcagagatgagagtctcgctctccacattacgatcaaggacttctctggccctgggtgaaatggtggtttgcagggctaactctaggggcataccaagagaatagaggcaccaggggcatttccggatgagtgccatttattagtctgtggtttatcagtagtggaattgccagtcatcttactgtgtttagttccctttgtcttgatagcgcaaccactgtgcgtttgtgtcttatgtttctaccccctctcacaatactatagttgggagagcttagtggcaagctgtgcatagacccagagacattaaaaatacactgtccaggattttcctttttcagtgtgataatggttaagcgcacatcctccagaattagactacctggtattgaatcctagctttgccatttattagcagagtgaccctggactagaacttgaccacataatatgtagtttcctcagttatacaatgggggtaagacatacttatcttttatggtgtaggaattaaaggtgataattcatacaatatatttataacaatatctggcacctaaaattaaataaatgttaactattatttctgtgtttacatgtttagctattcatctaaatatttattgagtacctataatatgttcaacattattctgagtattggggggcacaatgagccacactgtcatggaacccacatgctagtggaagaaataggtgacaaataaaaagtgaataaatgaactccatactttcaggatgatgtaaaaggtagaggtgacttttgagttgagacataaaagggactagctttggtcaaagtttattttagtctgggcacagtgtctcacacctataataccagtactttgggaggctaagttgggaggatcacttgaggccccaagtttgagatcagcctgagcaactaatgaggccccacctctacagaaaaatcttaaaaaattagccagttttggtggcccatatttgtagactcagctactcagaaggctcaggtaggaagatcacttgagcccaggagttcaacgttacagtgaaccatgatcacaccactgcactgcagcctgggtgagactttgtctattaaaaaaaaaccaaaaaacaaaaaacgattttctagtcaggggacaacaacaaatgccccaatgcaagaaggaatttgaaacattcaaagaacagatagaaatttggcattgttagagtagaataggggacaggacaggcaaggtgataggaaacatgggacaggtcgtagaagaaccagaagaaaaaatggattttattctaaatgtaacgggaaagcaaaggagcattttaaggaagagaggggtatgacctgatttatgtatttcacaaaagtggctcaggctgtgggaagagtgaactttgaggaatgagttgaagcaggaacaccatcaagctgttggagtttatgttttcacacccgtgagcttctgaagggctcatctctccattctccatttttcagaatgcaataggtacttagtaactgcctattggatgaataaataaattgaatgaaccaggaaactctgtaaattccacgtatgacaggtaccttgccctcatcccttgtaggcaggggctgtgtcataccctaacacctgaccagatctgttttgttctcagtaattggagtgaatattcctaaggaaaggaaaatggcaaatgatttagaaagaaaggagagtgttctgtatctttttttttcagcctcttgattttcaaacattgaacctagtgacattaaacaaagtttttactttctgtttgggcacatgaactattttagaataagaagattttgtttttgcaggatactaaaagcactagtattttcatttactaaatattatctttacgtgtggggtaggtagcattggtagaagtcttttcaggtcatcaatatagtagctaaaagataaaatttgggctgagtctgataccggaatcttcacccaccaccagcaacaatcacctattggcttctgtcgttggattaacttaaacggaaagcttgatgtacccagttacacgtgggaacttcttacttcatcattgttgatcctagaagctttcatttcctttcataataattcattaaccctttatcaacttttaccctaaaataggttctaactgaagataaaactcagtgtgactttcagataaagagcttctgatttgaaaggcagatagaaaaaaccttgaatagaagagaaaaagaatgaataacaagtagactgttgagtcttaatggatctttttttttttttttttttttgagacggagtctcactctgtcgcccaggctgcagtgcagtggaacgatctcggctcactgcaacctccccctccccagttcaaggttcaagtgattctcctgcctcagcctccagagtagctgggactacaggcgtgtgtcaccacgcctggctaatttttcgtattttttagtagagacagggtttcaccgtgttagccaggatggtctcgatctcctgacctcgtgatccgcacgcctcggccgcccaaagtgctgggattacaggcgtaaggcgccactcctggcccagtggaatggttttaactacatataaaacttatctttgacattggaggtagcagaatgaaaatgttccttttatttcattgtcaagagcaaaacaagtagaatcaaaattttcaccaaacttcaagtgaagaacaagataggaagaggaaattttatgttcatatcctggaactttttaagaaaatttttttgtttgagtcgccttaggttttgactaaggaatttaatgctggtgtgatctgaaaagaaaaaaaaaaatattttgctagttactagagttgcaaattatagcagaatgccaaaatttatggaaagagatctttattctctatttttctattatcatactgacaaatattattatatgtgaatgagaaattattatgttaaggccagtaagaacttctttgcttttctctaatatcatttatgaatgttcaaaacctgatgtcctgggaagttgtttgggacataaggtgctttaaacaccagggtcagctgaaatgcagcaggaaggagggagtatgagatattgagtccaggcgaattgtttccctttagattaggagtcagcaaattatggcccatgtaccaaacctggcctcctgacggttttttaaaaaattgatatgtattagttatatagctgattgtttttgtaaatcaggtttgattggaacatagccacacttacttgcttatgcattacctatggctatttttatgctacagtggcataattgggcagttgtgtcagagacgtgttccagaaagactgttactatctggccctttataagaaaactgctaatccctgtcatagtgcagattttaaagtttgccatccctaattccccaaagcaaattgtctatcagtcttctatgatgacagcttgttttctgtgagtcccagtagctctgtgtgtgtgtgtgtgtgtgtgtgtgtgtgtgtgtgtgtgtgtgtgtatcactgaataaattttgtagcttcaataaaggctattgttctagattttatgtacctggccataggagtttatagatgaccacgaccataccctccgggacatagagaatgtgcttcaaaagatacatagcagcagtttgggcaaaataataatcgtgatagaagtaaactgatattgacagagtgcctctgtattgctggatctgtgtttcacaatggtttttttctcattatcataattactatgcaaagtacagttagagtttcacatgaggaaaatagggaactgaggctctgagaagttattttcttaaaacaacaaatctagtgagtccagactcaaacctgcctttggctccaaaacccatatatgtcctttctatcaccacatttgggctcttcttgggtaaattatacacataagtcagacaaattcaacagatttgtattgatagcaacaaatcatttttttcttaactttacacaccatcttatactgcatgtaatcttatgctgcctatacaggtcaagtgacttttttttagctgcgaagtgagaaagtattagtttcttaccacgaactgctattcatacctcacgtctaatttttttaaagtgtatcttcaaaatggttatagagggcaatgttcatactctttgggagatttgaaacataggtagagtgagacataccccatcagaattttcatcagcatttaatttttcaaagaggtacgaagtccttcaaaatgccacagctaaaggttgttggggtcatggggaatttgagatcaattatatgggtagcctgctacgatttatcatttgaagatagcatctatgtgaattttaagagaggctagtcaatatcacagcacagagacaggacacagccagtataagagtattagacataaaaaagagagaagtgaagcctccctactgtggcccctcatgaatgggggatgggacatagataaaaatgctgagtgctattttagcataattgcttagagtaaagcaaggctaagacaagaattacttatttttcagtataataattcagtgtctatcctgagccaatagaggaatcagatgtaatggcttacaaaagtgaatcatgtagtagccaagtggaaattggtttaattacattaatttgtctcatttttcattctccaaggtgagtgaaaagcttttatgaaaactaaccaaagtgctaatcccttgaaattcatccaaacatttaaatagcattacataaaattatcaattagattagaaggaaaaataattgtggatgaatgtcttctcccctgtggtgcatgtcttctctctttgaatggtttcttatggacagcaatggtgggctatatataatgaaacaaacccccctcagtaggatgcatatttgtacggctaactatataaattttgtcggaaacaaatcaaagaccaagacaaaattaacaaaggctgtttattcgtaaacttgtggcaaggtaatccatctgccgttatttgtttctgcaagctgcaaagatatcagaaaggagagtaagttttatagaattaaaagaggaaagattgaggcagtctctgattggcaatcattctatagggtgcgattttaggacgcagaggagactttctcattcatctttaggaatattggtagtccttggttgatggctagggagcaagctagccatttggggatatttcaaaagaggaaggattgttcaatcttagggatggaggactttctgtggttggccatttcctggaacaagtgcgggcaaacgaggtgcttttattgtggttaggctttcgtatggtgcttatttgaaagtgagggtctgccatggcaggcagtttctcagtgatttcttactagctatagtggaggagagaggcagggcttcctatggaccatggtgtatttgtgagctatcttcatctcttattggagattagtttccattttgccacttcctgtagtttgagatgtacaataatacagaaaataaatagagtctacaaagaagaggaatggtcaaagaatgggtgttaaatggcccagaaacattggtctcagctgggtttataaaggctagttcatctttccagtattcaacgacctcatttgttgttgttgatggtgagggtgttagccacaaaattatggttaacactcatctctaggagggtaagcaaaatatagtacagccatgatgtggatcatacataatagaaaaaggcattggggttctccctatttgcctgttcagtgtttatttctctagttctaacagagctattttggctctattaaaaaaagcatttatgttcatggtgtggccatgtatttctaacaagcagcagtgaacttggggtcaggggtttgagatttgggctcggctctgtcactttgcagctgtgtgacgttgagctcatggaaagacctggtatattgagcaagacaaattaggagggttgagaacaatgccataaatgcagagaggtctgcttaaactttggctacctcgacctgcttacttttcacttatttttatgtggatcttaacaaataccttcatgagtaaggctgatgggggattctttctgttaggtgagatttgaattgaggcaaaacctccagctccttgggaggcaaatgagagctttacccagatataggacatatatgatttttcttaatcaactgtcctattattggatataatctctttatggatatcatataactgaaagagcctggagtgtcaaaacaaaatagacttggatttcaaccctggctctgccatgtgctaagcataagagcctaggaaacttaacttttcaaaccttagtttccttttctgaaaaataaaaaatgccttgcagaatcatgtagattaaagatgatgaatacacattttctggcacataataggtgtttaataaactgtagctatttttatatgacatagattttgcctcaggcaacatcaggaggtccatttctggctcagtatctcctcaatgataaatatccccttctctgaagatcttttctggagctgggaaatatataacattatctggtagattttaccccctctatttaaacagcctagataaagacctcagaacattttttgagcattataaagaatgccttgaggaatttccagctagttaaaaactggcctttatataactctggtttaaataactcagttatgtgagaacggggactcagcgaataaagttatttctaagccaacagcgaatgcatggaaacatggataaaatggatgataatctgaaaattcattttcaactttagagagcagatatttttaaatttttaatgcattttcaactaacagactaggcaaatagggaaaatgatcattctagggtctactgttatctcaccatgcttctaattttgattttgattttaatatataacatattcaccatacgtcttatccattgctgtgtttgtttatccagctatccatccattcatccaattatttgtccttagtcatttgtttttaaatgttattcagcccacattcgatactagattccatgtgtgctgagggttaaagatacagaaatgtaagacatcccctgtgtttaaaaaaaattcaggccattgaagtagatgcatgcacaatgacaatgacaatataattgaactttacagaatttaacttcataaaaactgagaagggatggtgattcttctctcagggtaggccctaagtcaaggacgtgtacaaggtaccatagggggcctagtgtaaggatggaggatgggaaggcagaacttttttgtggagtgaatctcaagatggattttgaaggatgagaatatatttgctcaaggaacaggtgagtagagcatcccagatggaaggaacaggatgagaaatggcaccgagtattccaaggtgatgtgatttttttaaaacacataatatctactggatggctttttcattttcttggttcaaatctgtcaataggactcagtaagtagttcaggattttggtcaatagcagcttggattagaagggcaagttaggtagactgaaaatattcatggttagtagaaggacagtgggaacagtgtctatagggacaatagctcagtggttaagggtcagcaccctgtagctggctgactagcattagacctggatctagtaggttttggctgtacagtcttaagcaagttacttaactattctgtgccttagtttttcccatctgtaaaatggaatgaataaagatactattacatgaggttctagtgagaattaaatgagttaatacatgtaaagggtgtagaacaatgtctggcacgtgggaaatgtgcagaaagaaactgtgtatttcctaaaatgataatgatgatgatgataatatatgccccctagagaggagaaaaattgaggcccatctgcattttaggtacagctctaggaaatttacatacctgatcaatttgctgtcaaaaaaatccagtgagggtatttctacaaaatagccatttgtagaaaaggaaacagacaaaatgaatgtgtgcaatgttattacatagcaaggtacagaagctgaatctacatcaaagtctacttatctatggttaatattatgtggagacctgagagctagagaacttgctgatgggaagtagttgggaggctttgggacctagaaggcctagggatagctctaggatgatagcatgtaaaggagaatctagatgcagatgaacgcagaaatctaggtgaacagacaattctcttctaggtggtctggcgggatcagagcagagaagagtcagcttggagtctggtatacaagtcttgttttctgtgagcaacaggaacagggctaggcaggcagtggagagctactgaatgtttaccattggttcaggggtgggaggaggaaaagcccgatttgtagtttattgatttctttggtgtaaatatttccatcaacaggccaatgtgaaatcactgactgtggatttgggaagacatgtgcagagtcagctttcatgagcctgtgtgaacttggggaaacataccactgaagccagggccccagactgagatgcaagatgacaaactgtagggattattctggtaacccacaaagtccatctttgccatttgggcagagtcctactgattgattgattttttttatttttatttttttgttatcatgatgcagtcactactagttgtacttcttctttggccaactctctagcattcaatttggtccccaacaaagattgtacttgtcaactgaaccatacactgccaggttcgtcaggcctttcatattgcctcagatcctctcctgagcctcctgtagccatacagccatctctgttactgtattagtttgctttcatgctgctgataaagacatacgagagactgggcaatttacaaaagaaagagatttaattcgaatcacagttccatgtagctggggaagcctcataatcatagcggaaggcaatgaggagcaagtcacgtcttacatggatggcagcaggcaaaaagagagagcttgtgcagtggaacttctgtttttaaaaccatcagatctcatgagatttattcgctatcatgagaactgcatgggaaagacttgcccccatgattcaattacctcccactgggtccttcacacaacacatgggaattcgagatgagatttggttggggaaacagccaaatcatatcattccacccctgtaccctcccaaatcccatgtccttgtatttcaaaaccagtcatgcattcccaacagtcccccagagtcttaactcattttagcattaactcaaaagtccacagtcgaaagtctcatctgagacaagacaagtcctttcactaatgagtctgtaaaatcaaaagcaggttagttacttcctagattcaatgggggtacgggattgggtaaatacagccactccaaatggaagaaattggccaaagcaaaggggctacaggccccatggaagtctgaaattcatcagggcagtcaaatcttaaaattccaaagtgatctccttggactccatgtctcacatccaggtcatgcagatgaaagaggtgggttcccatggttttgggcagctctgaccctgtggctttgcagggtacagcctccctccaggctgctttcacaggctggcattgagtgtctgcatcttttccaggcacatagtgcaagctgttggtggatctactgttctggggtctggaggatggtgtggcgctcttctcacagccccactaggcagtaccccagtagggtctctgtgtgggggctccagccccatatttcccttccacaccgccctagcagaggctctccatgagtgtcctgcccctgcagcaaacttctgcatgagcatccaggcatttccatacatcttatgaaatctaggtggagtttcccaaacctcaattctagcaagcttaacaccatgtggaagctgtcaaggcttggagctttcaccctctgaaaccatggcctgaactctatgttggcttctttcatcggtggctgaagaaggctgggacacaggtcaccaagtccctaggctgcacatagcacgaagaccctgggcctggcccacaaaaccattttcttctaggccactgggcctgtgatggaaggggttgctgtgaagacttctgacatgccctggagatattctccccattgtcttggggattaacatttggctcctcattacttatgcaaatttctgcagctggcttgaatttctcttcagaaaatgggtttttcttttctatcacattttcgggctgcaaattttctgaacttttatgctctgcttcccttataaaactcaatgcctttagcagcagccaagtcacctcttgaatgctttgctgcttagaaatttcttccactggataccctaaatcatctctgtcaagttcaaagttccacacatctctagggcaggggcaaaatgctcccagtctctttgctaaaacataacaagagtcacctttgctccagttcccaacaagttcctcatctccatctgagaccacctcagcctgaaccttattgtccatatcgctatcaggcttttcatcaaagccattcaacaggtccctaggaagttctgacctttctacattttcctgtcttcttccgagccctgcaaattgttccaccctctgcctgtaacccagttccaaagtcgcttccacatttttgggtatcttttcagcagtgccccactctactggtaccattttactgtattagtttgttttcatgctgctgagaaagacataccagagactgggcaatttaaaaaagaaagaggtttaattggacttacagttccatatggctggggaggcctcacaatcatggcagaaggcaatgaggagtaagtcacgtcttttttctttttttttcaagacagagttttgttcttgttgcccaggctggagtgcaatggcacagtctcagctcactacagcctccacctcctgggttcaagtgattctcctgcctcagcctcccaagtggctgggattacaggcatgcaccaccatgcccaactacttttgtatttttagtagagatgaggtttcagcatgttggtcaggctggtcttgaactcctgacctcaggtaatccacccgcctcagcctcccaaaatgctgggattatagatgtgagccactgcacccaggcagtcacatcttacatggatggcagcaggcaaagagagagctcgtgtaggggaactcctctttaaaaccatcagatctcataagacttattcactgtcatgagaacagcaagggaaagtcttgcccccatgattcaattacctcccaacagtctctcccacaacatgtgagaattgaggatgcaagttgggtggggacatagccaagccatatcagttgcctttgcccactacccagatcaccaggcctttttatgacttaccctcttctagcgccaatgtccggttctatttttgtgtgtcctaggagctgattcttctctctgcctgttcttttcccacccaccacactgtgttctttggaaaccttattgcattgtaaaaaaacgtcccctacatcctcattgaactcttcacagaatgtccctctgtctctcagcctttttgaattcctttggggatacagctctcctacagctctctgagtggaggttgtattttctcccagaagcagcatcaacttttccaaagacagctttgctgcatctagagtaatttcttccttcctcatacaaaaccctttctcttctgaagccccagccatctgcttataacacctgttatcccttctaattgctgtcagtgacaaatctcctggccactccccctcatttgttgaggtctttggcacctacctgctcaggctttatctctatcataaactgtaccatcattctaggcagaagtccagccttgaagatttctattttggggactacaatcatcttcactccataccacttccatatgctcttttgtttgttttttctcttttttgatacggggtctcactctgtcacccagtggcacaatcatggctcactatagccttgacctcctgtaagtgattctcccacctcagcctcctaggtagctgggactacaggtacacgccaccacacctggctaagtttttgtattattattatttgtagagacgggttttgttgtgttgtcctggctggtcttcaactcctgggtttgagtaatcctccttccttggcctcccaaagtgctgggattacaggcacgagccaccacccctggccttcctaatgctcttgaccttgccattgcttaactactctactcctaaaatcataaattcagactaacctccaggtagaatctttcagcccaaagtttttgcacactctcactccactcatcaactcgctgcagccagatttctacgttcattctacttgtactgttcttaacgtagtcaccgatgctctgctgactgtcagatttacccttcatcctgctttcaaaatgacattgttggatataaaatgctccaggaataaatgcttggtgccgtgaagtaaaaccagcactcaggcaaaagtttaattctctcagcaaggcaatgtatttctgcagaagggtgccactcgcatcagtcaagattgcaagagcacagagaacaaaggacaccagggggtttttatatcctggacgcagtccttatctctttgtccctccctatgggctggggatggactgcacaatctgaactgacccaactggctacttgtacatattttcctaaatgtactgggggagggggatgtgaggtacagaggtggagtgtgtgagatgtgcaatttcgggggaacaatgggtacaggtagccgagggaacagatgtgagttattgattagagctgacgggaagcagggtaggctgtttacagcaactaggggcaaggaagaataagaaagttgagtttgagaacaaaggataaggaagttaacaggctaaatcctttgaagagaaactcagaaagatttattttgtcttacaatgtgttaaaactgcatgagttatcatgtcatttcctagcttaaaaacttaaataattgtatattagtttatgcattcattcagaggcatagaacagtgaactaagcagtcaagaaaacactgctctcaaatgcacatatctcatttgtgttttttaagaaagaaagaaaaacatttttaaaaatctccctcccaactccaaaaaaaaaaaaaaagctaccctgatcagtttgtagtttcatgcagagcatatatccccattgtcctcaggatgaagtttacactctaaagacattcaaggtctgcctggatctgaccttccttatgccacagctaagttctggttcctaacaccagcttccaattctgtgaagtcacattcatgggtggggcttcttcatgccctgtgtcttttctatggtaattatttttccaggtattcttttcttttccatttcttaccttctcctttatccatcttttatgacatcttgtgtcacgaccttttctagataggattacttatcaccttcttgtgacagttccatgcatatttcgtacatgtcagggtcctttatttttacctctgtctcttcttattaacggtgaaaggcatggccaagcctgcctaatctctgtaacctcatcgcccagcatagctcctgggcagctgagctcctaagagcaggtgaatatctaagggcttgtgtaggactcaggtaaacactctcaccctcagaaactcatagtgaaaacacctacctggctctgtcctaccccacccaaaacagtagagtagtatttggaaagaccagtggaaatttccagtgggactttttccctgatggtaccactttgttgaaggtctttatgttgaagcaggtgctccagggtcacaggtgtgtgaggaagaagaagctgtcattgattgaactctggcccatttttttactccaggtttttcccccagtaaaactttttagatcagcatttgataataaataccccccaattcctttgctaccctctacccttctctctctctctgtctgcctctcgtgtatgtgtgtgtttgtgtatcctaaaattctaaaatttgtttgtaactctcaggcatgtctctgagttagacatcaacatatatctaaaaggagtgatctcagcattttttaaccttcagaaaattattattattattatatttgtgtattttaattgtatttttccaaaaactcgtttcctttacctaatgtaggacgaccaattcatctttgttatcagccttttatttattcaagtctcttttattttgctactcctaaagaaggtttccactcaaaaggcataaattctgagtttttttaaacttaggagttttaatttctttcacaatttattggaaaaagacactgaacaacacacacacacacacacacacacacacacacacacacacaaacacacacacacacacacggatcagctgtcatcccatggcatagtccaaggaatagcagctgggctcaggcagggaaaaggaaaagtcagtttgcctgagcaggaggcagcagccctggggttgtcagcagggagcagcagtccatggaggaagagaatgcctctctcatctcatcttgtgaagggacagtcaaggggcattggctggctcggtggatgagtcagggtaatcactgacgggtggcaacaccaacttgaggagacgctggctttcgcttaggtccccaaggctggctagcaaagcccagtaacctgtcaagaatggcttcctttgaaccaaaaaaatgagaggcagcagcttgagacatgtattgaggcataagacgtggtgcaaggtatattatgtgcaccagctcactggatcttcacaacaaccctgtgttcctcagatgtggaaacccaagttcagaaatcttagggaactttcccacagtaacactaataggtagaaaatctggcatttgaactatttgtcacatttttttctttccagctatgtgacattcagctactcaggggcatgcctgttttcttgtcctctgagtgaaaagaaatacaggcctgggattggtaccctttttatttttcaacaactttactgagatataactcacatactaggcaatttacccatttaaagggtacaaatcaatgggatttcagtatattacagtattttacaaattgtgctaaaatgtatagaacataaaatttgccattttagccctttttttttttgagacacagagtattgctttgttgcccaggctggagtacaatgtcacagtcttggctcactgcaacctccacttcccgggttcaactgattctcatgcctcagactcctgaatagctgggattagagacatgcagcaccacgcctggataattttttgtatttttagtagagacagggtttcgccacgttgcccaggctggtgtctaaatcctgagctcaggcaatcctcccgcctaggcttcccaaagtgctaggattacaggcatcatccaccatgctcggcctccattttagccattttaagtgtacagttcagtggcattaattacattcacaatgttgtgcaacaatcatcgctattttcaaagcttttttatcactggatacagaaactctgtgctcattaagcatcgactgtccaatcttttctcccttcagctcttgaaatctcccagctcctggaaacctcaaatttatggtggaaccacaatatggaaaacagcttagcggtttctcaaaagcctaaacatggaattaccatatgatccaacaattccatttgtagacatatactccaaggaactgaaagcagacacttgaggagatacttgtacaccaatgttgcagcattattcacaacagccaaaaggtggcttgttctaatcccaaccacatatagagggcccaagactctgctataccatagcagctttgcttaattctattttatatattgttcttccaagttaggtattattccagatagagacagtatagcaaagtacaatgtttctttctttctttctttcttttttttaattatactttaagttttagagtacatgtgcacaacgtgcaggctagttacatatgtatacatgtgccatgttggtgtgctgcacccagtaacttgttatttaacattaggtatatctccaaatgctatccctccccactcccccaaccccacagcaggccccagtgtgcgatgttccccttcctgtgtccatgtgttctcattgttcgattcccacctatgagtgagaatatgcggtgtttggattttgtccttgtgatagtttgctgagaatgatggtttccagcttcatccatgtccctacaaaggacatgaactcgtcattttttatggctgcatagtattccatggtgtatatgtgccacattttcttaatccagtctatcattgttggacataagggttggttccaggtctttgctattgtgaatagtaccgcaataaacatatgtgtgcatgtgtctttatagcagcatgatttataatcctttgggtatatacccagtaatgggatggctgggtcaaatggtatttctaattctagatccctgaggaaatgccacactgacttccacaatggttgaactagtttacagtcccaacaacagtgtaaaagtgttcctatttctccacatcctctccagcacctgttgtttcctgactttttaatgatcgccattctaactggtgtgagatggtatctcattgtggttttgatttgcatttctctgatggccagtgatgatgagcattttttcatgtgtcttttggctgcataaatgtcttcttttgagaagtgtctgttcatatccttcgcccactttttgatggggttgtttgtttttttcttgtaagtttgtttgagttcattgtagattctggatattagccctttgtcagatgagtagattgcaacaattttctcccattctgtaggttgcctgttcactctgatggtagtttattttgctgtgcagaagctctttagtttaattagatcccacgtttctttctttctttctttctttttgagatggagttttgctcttgtcatccaggctgtagtgcagagcagtggcgtgatcttggcctcccgagtttgagcgattaatctgcctcagcctcctgagtggctgggattacaggtgcttgccactgtgaccagctaatttttgtgtttttagtagaaacggggtttcaccatgttgtccaggctagtctcgaacttctgacctctggtgatccacccacctcagcctcccaaagtgctggaatgactggcatgagccaccacacccggccaaagtacaatgtttcttaacctttttgttaaaaaattattgcttccctaaggagtcttttaaacatttttaccttatccctgtcccatgaaattttattaccagagatacactatctgttcatgagcatggccctttggggaaccacagacctttataatatctaatatcaccaccattactaccacctctagacccagtttttcacccccttagaggtaatgtcactctagttgagactgcatggtgtagaggttagaagcaccacattaggagccaggtctgcctggatttttgtttggctctgccccttacctgctgtatgaccttagactagttgcttagtctccatgtctcaatttctttatctgtagacttgggatgctaaaaaacaatacctacttcaaagggttattatgaggattaaatgagttaataatataggacagcacctggcacttgcaaaatgttatacaaatgttacctgttgttatttttaacagagttctttcacttaaaaaatgacttaaaatccactggacattatgggcaccagattctctcctacttcccaccttttgcatggtgttttccgttccacctttgggttgtgttttcagtgataatatgaataattattatgcatttaaaattgttttctcttctttccccatccattcatttttgtctcaacaatcacattgcataggagtctggacttagtgattttttaagaaccagcttcagtagtttatggttttcataataaggtcatagatatagtcacatatataagaatttggaattgggaataaggttgatttcagttaaagaagcttatttcatctaaggactctctacatggcgaaatacatgaaaaagtaacgtaactagtcttcttgagtacatttagctgatcatcattcatcatacaggtggtagaggacaaaatgtttttaatgaaccgaggttgtgttcattaactacctgctcataggtccacaggcccttgtttgtttgtgtaattcagtctggtgtttaatcattggttaatttgatcctgtagtgaatcagatctaaacctctggcaccaaatcatttatttttaaaggcctaaagcctgttcactctattttgactgcttgaggggaggggtgaatgaataatttgaccaagtaactgtgggaaattgctatcgaattaaccaagaaatgtgaatacttttaaaggggaagctaagtttgccttgtagagaggcacaacagagtagatgccaggggctaaaattccccagaggtcaccttcctgctagttaatctcttgagcctccataaggtaaaaatgttaataatacctacctgtgtggtacttgtaaaggtgaaatgaattgatacatgcaaaatgcttaaaactatgcttggcataaagtggtggttaataaatggtacctattattatataaaaaggtacaatcagagataaagaggatatagacagctttgctggtagtattgcactcttacatcttgtttactcttgactgaattttctttatctttgcaaaacaagagtagctagctaatggaatcagagagataggaaagaccatcaatgttttatgaaggcatctttcttgcattttcaagactcaaaacaattattattttctgggggattccttccccagtctctttcaacggaattagcctcttctttctcttgtagaaattttattgtttttacaaagttcatgttcttgtgactgcctctctgctggattgatacagcttctgtgaaggcagagaccacatcccactgacatttggaaactttacggcctatagcatttggtagcctctcaatattttttgaatttccttttccaatttcagggaatccaaaagacgatagtagcttttacatttctagggtgttctttgataagcccaatggactgaaaagtcttaagtccattggacctttttggaagcactcactgggtttgttggtaccatcagttgaagcagagttcacaccctgacagattgaggtaggctgaggcacatcctaaggccaagactgaattgatcacccttcactcaatgtgtttctttccgtgtggacatttaacatcagttttatggacaccctcaaaagtcagaaataccaggttgggaagaaagtcatggggtgttgtcttatgatgcctttccagtgccagctagaaattcgtatgctgtgattcccaggggcacaaaaagatatgttactttatgacagtgtttgattctgaaattgagcctagcaaggggaaataaaaatgacttagcatgaattcccaaatatttaacatagctacatgtggaaaatacttgaaaaatgtcagcaatccaacactctaatttgtatttcatggtgtatgtaaccttgttgaagaagacttctttaccatacatgggatgaccaaaatgtcgtttgaatttttaatctgaaaatatttgatctggtaatcaacacatctgcttgacgcatatgttagaagatgatgttaaaattcatttcactgggcacctgagaaatgtaaagtgttatgttatcattattagtcagctcaagctgccataacaaaataccatagactagatggcttgcacaacaaatgttattttctcacatctctggaggctgatagtctgggcgccagcatggtcagggtctcatgaatgctctctctgacttgccttttccttgtgtcttcagaaagagagcactatatgtctgttcttataagggcactaatcccattgtgaaggcctcaccctcatgacctcatctaatcctaattatctcctaagggcaccatctctaaataccaacatattgtgaggtagggcttccacatatgaatttgggggggacacagttcagttcatagcagttatctaggcatctccctagattgtcttactgaagcagcatcattgtctggggtaaatacccaaggtttgttgcctcatgccaaggaaatcaaggacacagacacacgtggagtggggttaagagtggaggtttaataggcaaaagaaagagaaaagagaaatagctctctctcctgcagagagagagagggccaccaaagtgggaatttctgcccaaggcaaagtgcacagtgttttatagacaggcttgatgagacagtgtctgatttacatagggccaaaagactggttgaaccagatgtggtgtttacgtcacactcaaggaagctggccaccccaccttaatcttttattatgcaaatagggtctctacctggccattgccatgttgcctgctccctactgtgaatgtggttgacaaagaaaggagaagatggagccaccatgttggacatgcctagggcccggatagccttttcctattggcacagctgccagcatttgcccgtgcaagcttccagcttgcttatctgtgtctgcagctcgattttatgggttgctctttgttagaaaagaaattgattttggtgctgcttttcattaaaaggaaaatcttaccaaggacttccttaccctcactatctgcctaaataatttcttcctaactcctatatcattacctctcccctcccctcccctccccaaccttccccttccctcctctccccttccctcccttcccctctctcccctcccttccctctctcccctccccctccccttcctctctcctctcctctcctctttattcttcccccttccttccctccctcattccctccctccctcccttctttcctccctccctctctttcttcctttcatctttcttctttctctctgtttctctctcctcttggctcactaatgctccttgtgataacatgccttaaggcacagacctccatggattaaatctgatagatagctatgttttgcttggttcaaaatgtttggagaaaaatatgaagccaatatttaaaaaataatgctaagattttcaccttctctaaaaagatcagagacctagcccacaattcctgagaggcaatacagactgtggagttgtgctgcctgaactcctctcctggcagtccaggtctgcttcctagctatgtgaccttagacaatttactgcatgtttctatgcctctatttcctcatctgtaacatgaggatgattctaatatgcacctcatagagtgtgaatattaaatgagttaatccatttaaagcacttaaaacttcctggtgcatagaaaatactatataagcactgtttcttatcacaccttcctggtactatttcactagagctacagttttctacagtccacactcttcctattgtttttctgccactggggttaagtgtcactttttattaccattggccttgcatcgtgttttttctcttataaaagagatccattccattgttcttggagtaggaaaatgagaaagaggaaaagaaagagagagagagagatagctggctttctgtgttaagaaaaataagaaagacttgatttctttgtggaaaggacatggtttgcatatatatttttttacctgacttctgtaggtatttgatttatattcctaggttctataggcatttgtttttccccccttgctttagggaggacgctataattatagaaaaacatggaacattgagtaaagcactaatttcagaattagaagactttgattctattcccagtgcaatgattatctgtgttcctttgggcaagttggaaattttctctgggtctttactttctcatctgaaaaagggaagaataatttacatcttgtgtgcctcgatgtttttattgtttttaattttaaaagtatttttagagcagttctacgctcatagcaaaactgaaagcacagagattgcccatatacctcctgctgttatccgttatcaatatccctcacctgagtggaacatttgttacaattgatggaccttcactgacatgttataattacacaaagtccgtaatatacatttagggttcactcgtggtgttgtatattttttgggtttggacaaatatataataacctgaatccaccattacagtatcataaagagtattttcactgccctaaaacctcactggatttttataagttcaaatcagagataataggcccaattaaaaaaaaatcagtatgacacaaagggaaagtagtgattgttctaatataccaaccagttagccaacaccactgtgtttttatagctcatgatctctgcaaagtcagtaggttcaagtctgataaaattgctctgcaagttatcttaccagtccatgaagaacttgccaagagctatgcttttgtgtggatatctgcttgttcaccctagttgctcttagttttcaggggagatgtcaacgcagttgacacagctatcaagaaatagtgtgggggctcgggtcatctagatagtattttcctggacctgtatcttgggaaaggcatctggaacatctgcaagctcctcttgcaaaaagagggggtggcccaagagaagctgctccagaagcaggcttgtatgatgtggacaaaatacctgaatgtgtcaagaactttagaagtgatggttggctaaagggtttctggtccaactccctgaatgtatacgtgggaaaaaccaaggtcttgagaagaaaagtgacttgcccagtgccacagttagctaaatgaaaaagcaagaatagaacttgactcttaactgtcaatccagtgttctttgtccaacagttagtgtggaacaactatcctctttggagtcataagaaccttggttgaaattttaggcactctacacgtagtatccgatgtcaatccctgggatggttaggagcaatgagatgagaggcacacagtgcttgaccaaaaacatgttctcaagagctgttgatcttctttcctttttaaatgtacacagggagtggggaatgccttttcccctcctaagtatatccctccctgggttctttttctagtaaatgtttatggaagaagtctgagtagatcatatcattttattaagagaattctttgcatcgcttctatcggttacccaggccctgccttctaatttaatgatgatgatgccaaatttgagtctgtgtttgttctgaactcttatgcagatggaacctggtgatacatgaagaatcattatgccacatcaagtttcattttacagtccataagtacaccttttaaaacaaaaacaaactatttcaccatcctggggagggatgtaaatcatgtatttttattacctcaaaagaccaccagaaaatgagctctaatatttcaaaagcgacaagcaatttatatgaaagaattgcaatttaagccccattatactcaagatgatatatgctgcaatggggtttatagatgtttctctaacaatagttaataataaaaaccttaggactctttgttactcttttctaattccatagtctcaagcgttatgagtagacgctgtgtcagtctgtgagttccagctgggagcaaaatgcttctgtctgttttggggccttgggtcactggagcctaaagtgtgaaagtataaggatttgatttaaaagagccaaggaagcagtgatgcacggagcagaattgccattttaacagagaatgtaatgccagaacaaattcatgaatggccttgcacacggatatagaatttggagatctatttgtttccatacacatcatgatgcatctaacataatcacagtcataaacatcagctacagcgaacataatcatagcatcaaaatgttattgagtgctaaaactggcacagtgagaacaatgacaactttgtggtcatattgtttggatccagacccaggtttctatgcttactgattttgtacttgggcaagtgaagtcacctgataacctccgagcctcagtttcgtggcatggagatacctaccacgaggagtcaagataaatggaaggatgagatgctccatataaagtatctagcatagtgtctgatacctaaaaaacagcatctattttttgggtatttaccaattgccaggggctgttcctagttttcctttataaggtacgtactattagactcttagaatatgggtatcagcctgtgcccaaaaatgtgcttttaaaatagttcgtccttccagtacatgtcaggttaactgtggttcttcctagtaaagctttctggactgattcaaatttttagcgtgaacatggatttgtgtatgttcaacttccactctgagattcagcttcaggcttagcctcttcttgtctcctggcttctggatgaatatgaccattgctcaagatatctgcttcaggcagagtactgtcaccacctgggcaaaggtcagactgcatttcaagtctgtggttagcatactaattgctttggtccaactcaatttctctctttaaatgtcagtttgttctttcattagggagttatgatttttgttttgtaattattcaatacccttcagagccttttttctgtgaacaaaaagcagcctttgtcctagactcatctataaaatttataaaatctcaatcattcgctatttctgaagattgttttctcaggatagcccagctctctaaagatgttaattccttttttactccgtttataatcagatttgcttttgatacacccttgaatcctattgaaactgtcttctgggttgtgtgtttccctgaggatggagaggcaatcctttggcaaacgtgttgccattccatcctctgttcccatcccaaaaccgtgagagttgccaatttctttctttcttttatcttcttgtttcaagagaatcagctggagtactccacttcactttctctctcttctccccaccatttttaccacaagatagcttttatatctggtggttacatgatgaagaataagcaatgaaggcaagattgtgacattttaattttctggtacattcatcaacttttcatctttatttcagtgctttctctggactagtaccaggaaattattagatatgcaagagctgaaattaataatggtataaactgaaaacctactcaaaaacacatcagcagagcatcagggacgtgtgggcacagagtctcaatgacatgtagagagcaagggttggattaaatccatgtaaaaaattctcactggggttttctaaccatcccttgtttgatttttgaaaatatttttattcagggccttggaatcttatgaaacaaagaaatagcttggctggcttgactcaaaataagcttgttatagccaagtaactccttcaaatctagatgaggcagaggcctctcagcagcttggtgatggcctaagaaaaatgagccaggaggtttctctggaaggtgttgacaagggtccatgacagggaaacattcattgcagtcagcaggctggctggcagctgtggcccatgggctgaagattgaattgcctctaaggcaagtcctgactagtttctcatcttaaaggatggctgggcatcccagcagagtgagatggagttcagtgtggctgtatctctgtgagtaaaataccaatgtgatttagccttcagcgtactctgctccaatcaattctcttcactacagccagagtgatatttttaaaacagagaaattgaattgtgttactaccctgatgaaagtctgagctccttcacacggcctgcaaggcctgccggaatctaaaactggtaatattttatgaacagcacactaatgtccacaaagaatctggcccaagcttatttttccagtttcatttcaaatacgcaaagctcctttttgtaattaagtcttctcaaacattcttttctgtctggtaggttattgctcttcccttggcctgtttcacttctgtttcatgtctcagatgaaccatcactaccagagagaatccttctctgactctctcagagtaggtcaaattcctcttgttgaaagatctcacatccttggtagaatttattacacattttgctcaatgccttgcctgtctgcgaggtctatgtggcattttgttcatcagtccgcctctgggcttagtagaagcctaattaatgttctttgaatgtacatgactaaatgatgctttccatttctaacttgacagacaaaaactttagcctctatagtttccctaccttcattctctacctgatgaattcttgctcatctttcaagatgaagcgtaattatatcctttcttgagataacttttgtagtcattctctgcaccaatcagggaaggcatggtggcttaagtcaacaaaggcatatttctagctcatgcaacaggtatatggtgcttgcttatgcaacaggtatatggtggcttgctcctcacttgggggcccaggttgaaagagtctccatgtctttgcttccatgggttacaaggcagaaacaagaaaatgtggtaagctggatgctggctcttaatctttccacttagaagtgatatgcttccactcagatttcatgatcaatcatgagattaatttaaaccatgcttaaatttgaaaaggatggggaaatacaattgtgctatgtgcccagagagtggaaaactggtaatattttatgaacaacacactaatgtcaagcagccctctctaatacctggcttctcttcttgtttccagcctctcacttgttatgcctattttcacccaacctttcatcgtcctaccaaagaccttataagcaacaataactaaatcacttccaaaatcttaatgtcaccatactactctatgactccttcttttagttttccatctcttggattccagtggtctgactgtaataattccttgccttcatcaggattcttggtggaagttgagttccccaggaagcaacctctgtggttggcctgcaggaagttgattgcctgagttatttcactgatttctggtgttttgttcttatttcatggttatgaaagtcttgctaactgtgggtctccttcttagatctcaatgacctcgcaataacttttatttataggctgtcagatctttagctctgaaaagaatctgatgttatttcaatatattttattaggaaataaatcaacttacttttcttttaagataaatagattaatgagtttcctagtgactcaatgtagccatttttatcctcggtttctgtacattaataatattaaagctctaatgattattgtaatagaaatactgtatttgactaatcaccattttcaagaagctttcatgaagtaaataatagtaaataacttctgaattcaaatcccaggtctagcgtgttctaacaggatgactttatgccagatatttaacttctctaagccccagttttctagactataaaacgggagtagtgtttgtattttgctcatgggattgcatatggattgaattagataatatctttacagatataaaacattgggttcagaattgaccattgggacaaaatgatgaggatacttggacccagagtagttgaatgcaagtcatagactattaatcagcagaaccagaactagagctcacattttctgtcttggattcccatgatgtactcatgtccttctttctctaaccatcacacacaagcagtctgagtaaaaggaacataaatctgtttttgaaaacaatctccagaaaaggctaaactctgtgcttaaggttgtaggttattttaatccctatcacgaacttttatgagaaagcaggtgatgctctgaactccatcccaaaaagaacaagactttttgttgaatcagcccattattctatcacatggggaggagctccaggtcaaaggatgagagacattaatttgcatcaggcaacagcagttgtctatattcatagtacaacatgggagaaactagctacaccatcattttgtagcgtttgaattgaagcatgtcttagtaagacatacaagcagagaggggctggattcccttgatccctctgataaaagctataccatgtactgtggacacctaataaatattcattgatatcgacttagtggacacagaactccttgaatttggacatttaaaaagagtattctccttggtaagaaactaatagttgtaaattcattcttcatacttcttgggctcttacctgttttgtctcaccatgcatcgttctggaaacactttcagctcaggatgggatctaacgtaccaagctgaattttcacctaagcttttgtgtttaatgcatgttactttttctcttggcttctatggacatttatcttttttaatttatctgcaaaatgattacactgttgttccattattttgctaaccatgatcttacttattttttttccttcagatattgatgagtgtgcagctaagatgcattactgtcatgccaatactgtgtgtgtcaaccttcctgggttatatcgctgtgactgtgtcccaggatacattcgtgtggatgacttctcttgtacaggtgagctttaagaagcagtgttgtttttttaattcatccattctctgcaccatgtctgtgttattatgtttaattcctagtgcacaaagtactatttttatctaaatagttcttctctttattacttcaccccaccttttgagaaaaaagcaataataaataaattatctgcataattgatttccactcccaatatttctgcctctgtgtgtgtgcttgcatacatgggtgtgtgatttgaaactgaagtcccagttgccaatagtaacactgagggagttagatatactagttctaaaaatagaaagtatcaattattttcgttgcatcatgatgaggtgtttttgtagataagaaaatgtactttgttcccactgggaaagacaaggattaaatttaaagaggtgacagggagtacttggtggtcaaagtttaggtatatgggagctggtcgaaactgtatttaattaatatatgcttgttgtctgtgtcccacctctttctatatcccttagcactacagtggtcactgactctgttggagtagcgctggttttatggggcatttggtttggctttccagtatattttcaatcatgtacatacagacatgaacagtaaattggataagggtggtagaagattccaagtttttcttctcttggaccaaatgtgtttaaatactaaatctgtaagttataagaaaagggtcccttgaacccaagatttcaatcatgttgtaacttttcctgatgtctgcatctttctctttgttccaatcacgttggtatataaaaagtggattctttactcagaatataataccgctatttttaatgtactttttttttctgaatgaccttttcagaagtgcaaaaagttgcaaaagttaagggcacatgttagtatgtccaaatttctttgccagtgatgtctatttataagttactattctttgggtgaagggctggagagttcagattgacacaggtttctgaggaccacataaagtcacatctcacttatctgtcttttacatattataattaatactcttaggaaaagaagagagagactgcataaacatagtgcgctaggatttcagtgttttaaaggatcaaaactttttcggaccaataaacaaacactttctaaaaagctgtaaagttacagggcctatcaatctgttcttaatactaaatgtggctcttaacgtcttttaaccctaagattagaagaaggcagtgaatatcctcctagcccaagagcaccatattatgcaacttaataaacattaattaaagccctgctgtgtggaagaccttgttgaaattctaccagaatgcttgactttgctcggatttcctcactgagaaaggaaggcaagagctggcacttgtcgaatgccttaataggataggcgctctgtctggtggtttatatatggaacaagatggaaaatgtgttatcttaagaactggctccacaattacttttagaaagggaactatgtggtttggaataaaaggtaacagtgtgggtatcagtgggcacccaagtgcccttctcccccctacacaggaaagagtaaggctctgcaggaaaagtctacatcaaacacacacacacacacacacacacacacacacacacacacacacgcttttttgttttgttgtgtgtgtgcctaagagggaacacaaaagacagaacaaaagagagaaagaaaggaggggagaggaaccagtcagagaacagaaggttgggtgctgtggaggacagagggctggtgaaaaccacccaatagtaggatagctgaaaggatttttaagagaagaaatattttatgtgagtttttttttattgttttgccatacagtatgctatgtgagttttccttcttaccctcaaatcttcaataaagtcttcccaccctgaatgcctcatgagaaccgccctccctcccctattagaatgtaagttcacatggtggacaacagaaaggataccagtgcatttaggatgtggggaccacagaggtaaccattatcaagtaaccattgttacagttctttctgctgcccccaccaacatacacttactaatatacacacacatcattatcatcactgcctcctctcaggaatttcagaaatcttgatgaggactgtggattttcataggtcacaaaataggtgaggtttttttttctttaaaaagccttcctttgatcccagatttctttcaacctgcttccctatttttctgcttttcctcacaacaaaacttcttaatttgcctgtggttattgtcctcaccttacatttattcagctcacatatgctcctcacctctctccagtcagacttccatactcaccattctgcagaggatacatttatcaaggccatttatgaactctgttttgctaaagccagtgttcttatctcagcagcatttagcagggctgaccacaccttgctctttaaagcacatgttttcttggcttttgtgccatcctatttcctggttttccctctttgtcacttgtcactcttgcccaatgtccccagctattcttgtgctgctgacttctgaaaggttagagtaccctccggttctatcctggtccccttcccctgtttacctataggttctttttagatgccttcatcaatcttagagctttaatagtatctttatgtcaacaactcctaaatgtatcgctccagttccaatcttttttctgaacttctgaattatatattcaacttgacatgtacacatagatgcttagtaggaatttcatgcttaacatggataagacagaacttgatttctttccacttctacaaacctccttctctcccaacttctcccattccagcaaaagcaccatttacccaatttttctagccaaaaatgtagagataactccttcctctccccaggggttacacttgatcacccctccaatttcaatccatgcatctgtcttgttgatgctaccctttacgtcttgtcctaagtccatccacttctgtctatatcacctattaccatcttagtggacttcagccatggccatcacattggactttctgttccagtcttgttccatcataacccattcttcacatagcagacagagcaatttttttaaaaagagaaatcatacaactctacttaaaactttgatctagtgtctcattacatggaaaatcaaatccctgtttcttatttcaatatataaccctatatagttttccttctttcccttctgtcttttaccgtttctttccttgtccattatgacatggccatgctgacctttgtctttttctccatgtaacaagcttgtttctgtttgttaagacctttgcatgagctattgcccttttatggaagtctttttcctcttgatatttgtgtattgagctctcttctcatttacctcttagcctaagcctcagagaggctttccatgatcaatataaatagccactctgttgttttctgtcataccacctgattttagttctctgagtaatacatattattatctggaattttcttatgtataaatgattcttttatctgtctctttccactagaatgtaaactcttgagagcaggggcctttttccttttgttctctactataccttgactacttagaacattacctggcacaaagcagtgctcaataaacatttgttgaatgaaataatgcataaagctacttgactttgggcaaatttttcacttttgaaaacctcatttataaaatattgctcacatctgtcgtacccacaggttatagtgaacgtcaactaatatatgtgaaagtatttatcatagcacttttatcagtaaggataggatgttctgtaggatgttcagaacattctattggatgttctaaatataagtgacttaagataaattttattttttgcttatgctatttgtctatctctgatcaacagaggcgttctgcataccatattcactttgggatgcaagctgttggaatggtcactatagtgaacatttccaatcatcaagacagggaaaagagatcctggaggccctccatcagccattaaatgttctgaccaggaagtgacacaaatcacatctacttataactcattgactagaactaatcactagttccatccatccacaaagggatgagaaaatactgtcctacctcatgcctggaatggtagaggaccagaaacatttggcaaatggtacccatgcctatatagtgagtgatactaacagattgccaacaaatatggtttattttgacatgagtagctgttgattaggataaccttttttcaacagcagttcataagctatgtaggtattctcaaaaattaattacaatattaggcacattgtattaagtgctatgatagaaatgcaagcaaaatacaatgaaaaatggcccttgattgccaagatgaagtgtttgaaatgttttctgaaagcaatggggggctgtgggaattgactgaggcatgctagcatgcaatgactatactatgttagggatttacaatggggaatatggatgggagacaggagacaggaggagagcctctaggccagattcaaggaccttcattagacgctttcatagtaagcttgagtctttggaatgctgacatttattttgtgtcctgaaaataagcttgttagaccaaacgtgctctgtactctccaagatatattatgtccccacccataacctctgccattttttataggcaaagaagacttccttcccttagtggtcatttgcctgtgtaataaatgaggtgtatgatagatatctgccactataaaatgtcttttcaaatgtttcattgccagatgattatttgttgggagaaattgacaggcctaaaggcattcctttatttgactccggatcctgatatagcatttccattattgacattccttatttccaaagaccattctagtctcttctcaaatcaatcagtacctgctgacgctgttcagctggttttataaccatgtcaaggtcatatttttttcctttcttttgctgttttatgtcatttagctttgctactcagtttttagaagtcagtagtcatactgaaaaattctattcaaccaaaaataggaagcctaaagttaaagaagatatatcagctttggtgattcattgatttattggatgattgattaattaattattttactatgtatgaaatattcagttagtgtctgtcacaagtgttataaaagatagtcaccaagattattaaaaaataatgtctgtgccaaggggttcatggtttgttaattaggcaatatcttcaaatgagaaaactcaaatgttcattcaccatcaaaaatattgcttgccaaatcaatccctctttgaaatcttagtagtttagtttagtattggatgtttcaccctgtggtagttattactacttgacaagttttaaagaaggaaaaccaaactagtctttcccaattctgtgctgacagccatggtcctttcagaagactacacctgagacagtggatgctaagcatgatggaggagaaaggcaatgcattacacagaacaggaaactttagctcttacccaacatttttcttgctaaaaattgaaaaaaaaaaaaaaaggattatatatatgggataataaagctccaagagttcaacattgagaataattatctagagcttaaaagtgtgctgtaacttaatctttacctccctggggactggggtttccctgacatgagtatgtgttatatatggagctctgtacttttttgtagggaagtctcccttggcctttgaaagggtgaaatctaaaacatttggcctttgacccttgggggagtttttagccttggaattttcgtgtggattgaaattgcgttgtttcttgtaagagatcccttagttgctcttgctcttttatgaattttgaaactggaagaggtccctgaaatggaggtgttacagggaggaggggtttttcttctctcccccgtatgcttttggtttttggaatagtcaaccagcttgatttattggcctctgactttcatttatccccaactaaactccccgtgtttctggctgtttgataagacattatcattagatacgcaggcagttttaaaggaggatatttgtgatttacaacaaaagcatgcagcgataagacagatacttcacagtaacgggtaggcattcatttttatgccaaaagcttcccatgaaggtaagaaataaagggaacaagtgagataacaaatatcccatgtgatctctattaccttgctaaaaggatttttattttcttgatattggcatggaagaaaccttaaaggaagtttatgtttgaaatagagaaaacttaaagacttagatataatagcctattaatttaatggtttgaattaagtacactataatgaaaagagattagacaacagtttaaatgccttaaaagtaatagttagttgttagaaatgtcaggctaggtctctggaatatgctttactcccatgatgaactatacaaatatttttgatgaaattttattataattttggtcaattatattgatgaaatagagaatattttcaaatatgagatatctgatattttctcatttagcagagccacatgaaatggaactaaaacagaacattccgcaacctgattgagcaaaatggcaaattttccacggatcatcattatctttcaggcccataccatgtacttgtgtcagaatgcttgtccttgtttaccgtaggctgtgtggcagcattaagggacaagttacaggacaattgcttggctttcagtctcagcagaggtgatacatttataagaatgaaacaggtcacaggcctctagactattttactttagtaaaaatatgctctatgaaatgctttatagaatgcaaagctactttttgcttgttaaagataaccagaaactatttattgatatattgaacaagaaaagtcaaaataaagcatgtgctactacttttgcatatttcaaaaccaacctagaaggtctgatgatagttatttatctgttgttttcatttgtatggctggaatttctctctttttttcttcctttcatataaatagataattggctctgtaaccctccttccctacgccctcagaggaggaatgctactgtaccaaaagcaggattccaaaatcctaattctttatggcagagattcccaattctcacctcagggttgaatcacttggaatctgggatctatccccagagattttgatttttggctgttctggggttgggacccagctttggtgggcttgtttaaaagtaattctaatgtccagtcaaggtcaagagccactgctttagcatagagcagaagaacagagagggttggagtatggagagaatatcagagggaaatgggaagggatatgaattgcccactgtattttgtagatgagaaaaaagattccatagaactggtggtgagaaatgtggagttcaggaagtcatgaagcagggacttggatggttcctggaggaggggtcctgcttccaaagctgcactctgagatgtataagacgctggatagacaatgactgtgaggtatctctatagatggggcctcatgggaagatgttgaatctttaactgtgacattgctgctgcattgcctgaaagcgccctaaagacaaatggagcatatctatggtgactttgtgttccatgggctgaggattaggcagcttcttctgtgccaatgccttggttattgggggtcctctagagccatgatagagcctgatggaagtggggaacacttaaaatgactgagacatttcagtgaccccactatctcagaagaataggagctcacaaccattcaagttgaattgaagaaattatagaaactttcatcacttgcacaaacacttttgtgactggacttctctacctgtcacatacacaaaaaatgaagtcaataaaagaacgaaacagaaaaaaattaagaggtccctctaaagagggattatagtataaaaattcatcgaaagtttgtttttccagaccaattttagttttccatatgtagtactggaaaagccaaagaccacatatttatttcatttagtgatagtagtgttaaaataatgttagggtttattaaatccagcacatatatcttagggagactatcaaagctcatttaccttgaaatttcatgatgaaaataagtctgaaagacatgtctagtgtttgattgttttgttgggtttaagtgggagttcctttttattcctacatgtgttataaaggacctgaaccactttggctgttgcagaacaaccaggatcaatgatggagcttgcccctagggtgtttgtgaacaaacctattaagtactgtgttgcccttgacccaaattcatcataaaagccttgttaatatttctgtacactctattgttagatttgtgcattcagaatcacaataaggctttctcataaaggagtttcattaaggatgctttagcgcttacaaaattgttgaggctggtcttgcagctccactctatccacattcaggtcatacaatgaatggacatttctctttaacaaccagtgttttatcttatattctttatttctatcgtaaagacatggtacatgcatatctatctatctatctatttaatctatctgtctattgttatttctgtactttttagaagtatagtgaagtgccttaagattttttcttttgctaagataattgagaatatatactaactattctttggccaaaatgaaagctataaattctcatggttaaagtctagtgtataaattctactggttgcaagctttgattatgtcacttatttactctgtgaatcagaaagctatttaaattctctgcttcttcatcagtattcactgtacatcctcacagagttgttaaaggataaagtgacacagcgtacgtatatcagtttgagtgagtttagctgaaagaattaaaaaaaaacagaataacatcaaatgactcaactggcttaaatgacaaattctcacataaaacaatgactgtgcggacaggtttttcagaaatagttaattcagctgctccatgaaatcctcagtggaacagattctttctaactttttacttggttattttcagtatgatagttttggaacttgatctagctcccctcaagatctcaaaatggtgaagttactccaagcatcaaatcctgacttaaccatgtcccagagtcagaagggaaaagagatttcccttttcacagtccctttttaaaaataagagtaactttattaaaaacctcaacagatttattgtcatgtctcattaacaaaaatagtttgacctacctattcataaaatataccttagaaagataaatagaatcaagatttatcccctgaggcttgggcagatcccagcttcttttgtagtacttggataacttacatctaaacaaaatgtgggtttctttgtcaaggaagatgtgtgtgcctgcgtgtgtgtgtgtgtgtgtgtgtgtgtgtgtgtgcgtttccatgtatgtgtagatccacaattgttagagtatattaacagctttgaaaacatgtttcaagcttaggattaataaaaagaaatgcaaattaaaatgaaaattagatagcagttatactaaatttatgtgtgtgactatctgtgtgtagatatatggatacacatatatagatagacatatatgtcaatcactcttttctggagaaggttcaggaattcagcactttcatatatcactgatgagaatgtaaattgatacaacctttcttgaggctaacttgacggtttatagccaaaggcctagaaatgtttatttatagtaacttatcctaagaaaacaatcagtcacaattatttatgtaagaagactttcattgtggccatttattccatttattatttgtaagaaaaaaactggaagcagcgtaaatataaactcatggaaattcgattaaataaatgacaataaatccatatagtggaacataatgcatattaaaataatgtttaaaagaatattatgtgtcaatggaaaagtctcatcatctaacatgatttaagcaagtatgtattttatttttcacttcaaataataaaaaatatgtatgaatacatatgcacatacacatgcaagcacagacacatagaaacacagacaggaaatatcctcacactccttcccaaataaacagagaacagagggtatctctgagtgaatggttaaacatgatactttttctttatactctatatattttctaaattttctgtagaaagaaatataagacaatgaacctatatacatattattatgagaaaagtgttattaaaatattagaaagcagaaaatgctagacaaaggtgacattgagtttttttccccccgaagtctcctaaatgttacctcagtaaattaaaaaaatatatatttatgacctggtagggataatgtctttcatcttttatgacacagattatagttctgaactaaagtgattaaaagcaatggctttgcttcatgttcctggagaatctgcatggccaatatggcaactgaaggccacttgcaattatggtgctgtcttaattcaggcagctgtaatgaaatacctgacactgggtagcttataaacaataggaatttctttctcacagttctggaagctaagaatttcaagatcaaggtgcctgcagattaggtgtctggtgagggcctgttcctcacagatgattttttttttttttttgagacagatttcgctcttgatgcccaggctagagtgcaatggtgcgatctcggctcactgcaacctccaccttccgggttcaagcgattctcctgcctcagcctcccaagtagctgggattacaggcatgcaccaccacacccagctaattttgtatttttagtacagacagggtttctccatattggtcaggttggtcttgaactcccaacctcaggtgatctgcctgcctcagcctcccaaagtgctgggattacaggggtgagccactgtgcctggccagatgatgttttcttactgtgtgctcacatgatgaaaggggtgagaaatcttcctggggtctcctttataagggcactaataacctaatcactcccaaggccccacttcctaataccatcaccctaggggttaagattttaacatgagttttgggggaataaaaacattcagacatttcagatgctgtgttcttcctggcagctgatctgatagtggagtcctaccacactacctctcataagctttctatgaagggttttcagaaacaaggcagttggtccagatttttctggatcagggccaagacaaagagagatactaaggggagcctgaaaagacccagtatttccataggaaagcaaccactgaatgagaatcagggaacatacattccggtcttccccctaccaccagctcactgaaagttatcatgtcaacatttttcttggactttgaaagattaaggtttaactagctcaatggttttcagtcagaataacttggattctaaataatctttcttttgaaagagttcagcttcttaaaaaaaaaggattattttacaaactattacttttctaattctatgattctgtaagatatggtttctgacctctaggagattgtggtctctttgggagacataaaatttacatttaagtagaataattttatcaggcatataactgagttctaaattgtgagttacaggcattaaatgctatgggaaagagcattggtactgggagaaaggacatttattactaactggtggagaggaaatgttttctatccttccacgggtgtctgaaagggtttgaatttgatgttaggtgggagtgcattgagaagtaattgtgcctgttgcttgagaaatagatccatctccatttttattgatctacaatgtgaactggaggttacctgtgtagaaatggaaagaacacagggctctgaatcagccaggcctgggtttctgccccaagtagggtatttattcatagcaccaactcaaatcatcttcagagaaatgggcacatcttccttctagaatcttacaaggagtgaatgagagaatatttgtaaagtgcttggaagagagctcagcatagagtaaacgctcaataactgttagcaattactacctctacacatgaggaatctatgttaaggtgtgggaggttgaggaacttgtctacagctgtaggctagttggtggtgaggcagagataggaaagtcgacattgtaactccataggctcaaagataggataggatagcaggctgtgttaactccagaagctcaaatataacctccatcagagctcttttgaaaatgtctttaaaatgcgaatgcagacaagatcgggtgcattcagaccaaaatctcagaaatcaccactgaagaacctattcacgtaagcaagcacctactgttgtccaaaaacctattgagataataaataaataaataaataaaatgctaatgcgatgtgttcagcaagcaatagccattgttagaaagaaagaaatagcttgggcttgtgaccaagtgaacccatatttaacccgcagctctgcctcttacaagctttggagtcttgggcagattctttaagtgctccatgcctcagtttataacaccaagaaagacgattgggttttaaggtttgatcatgtgaaagaaagcccaacccaatgactgagtcctaggtggtactcaatattgaagccctaagacctgttcaccatatttcctttttctccctcaccttactaagtagctcttaaagcacttaaaagaataacagggcaccttaagatacatttggaaagccgcttgccttgagaagcccaggctgtgtagacagtgttcagactgggaagatgagcctagaatcagatgctttaggctcatgagttaacaaggagatgatgtagtgtaaagtggacttcaaaacagagtttataactaccaaggaatacattcctttaagtcaagagaaatatcaccttcctagagtcattagtttgtgagttgctgtagaacagagctttggaatgtgctctgttagctccctttaaaaatttaactttgttccctgagaagggaagcccattaaactgcaaacactttttggcatttatcagttctgctggctggcatctagttattccttaagggtggtcataggacaaattgttttcaagagaagactggtctaggttggacacaaggatggagtctttggcactcaggaaatttccttagagggaattcgcaacacacagagagacaggtaaagaaaatagcaagtttaatacaattataaaaagggtttttctagttataaaaatagtatattaatactatagtaacattaagaaatttagaagaataagaagaaaataggctatatatggtggctcacacccataatctcagcactttgggtggcctaagtgggagaatcattgaggctaggcattcaaaaccagcctggtcaacatagcagcaatctgtctctacaaaagaaaaaaatttaaaaaattagccaggtgtaattagccaggcattatgacatgggcctgtagtcccagctactcatgaagctgaggaagaggattgcttgagcctagtagttcaaggattcagtgagctatgatccgagaagaagaagaggaagaggaggaagaggaagaagaggaagaggaagaagaagaggaggaagaggaggagggggaggacagggaggaggaggaaaatgacgacaacctctattaacattttgcatttaggagtatttatcttatgtctgttttcaatgcctgcatttgtagtctacattgtggaaatcacactaatgatcaatattcaattttttctttttacttatttcataagcattgcccaaattataagattatttgaaagatatacttgtttatggttaaaaatattctctcatatggacatcttatcatagctgttactacattagagaagtattaacatccagttgcctctctgtcttcatttgtttttaacagatgcatgcattttttttctttctgtattatcatgatgatcattgtttttcctcagtttggacaaagagtgcgtcacagaacaaaaactcaaccagcccaacacagggactatgcatgcttacggactcctggaggggagcatcttagtttgtctgatgttttctatttagggacattttagggaaaaataggaggttaaagagctctgtaatcttaataaatatcgtgatgttttaaggaccccacataattattttacagaaaagcacgttgtaactagacagtggtgctctaaagtgagtctttgcctcatttatgagatgtggctttcatatttgtattttcttactgaattatttgtcctttaaaatttgaagagtattccctagatgaattagcatttttccccccttttggcgtttattttcccattctcgttgataagcagactatagggaaagtattaaagtattaggagtttcaaatagctgggatgttagagacatataaggcatcagaaatatcttcagattaaagccatttgattctgaattttgaggaagtgttgaagaaatgtgcctggagaaatcttacttgtgaatcatcaaaatctttagtattttttctcattaggagagctatgtcaccctcaagcagatcgtccatttaattggttataataaaaatgcggcattgattagaagaggcagaccttatcccttactatcagtgtgagagggggatgaaggaacaattattgtcccagccaggggagtgtggtagtaaatgactgttacatcacggccacccaggctgagtggtatacagtacaggggagggaatcaagtcaagatttaccctgtaatgcttttcttggcctcaagcaaactgtttattttttaggacaggttggaacagcttacagctttggagccaaacccaggagggataccagagactagtgccctctatctatttttaggatttagaaaactgacaagttacaaagtagcactcacatgttgtcatgcttagctctcaaaccagctggagttctgaatttattcaacctctacttggacaagatttattttattttgactattcttctagctcccttttcctcttgactctattctttggtggattattatagcttttctccttaaatcttgttttctttaccgtttacatttgtttcattattgtgtgtatgtgtgtgtgtgttgttatttatgggtgaatctaataatggtctaaatgagagacttaatgccatgaaacagaaaataacaggtattggtgaggatgtggaggaactggaaccctcgtgcactgttggcgagcacgtaaacatggtgtagccaccatggaaaatagtttggtggttcatcaaaaattaaaaatagaaaaaaatagaaaatagaattaaatgatctggcgattccacttatgggtatatacccaaaagaattgaaagtagggtcttgaagagatatttgcacactcatattcatggcagcattattgacaataaagtgtggaagtaactcaagtatccatcaatgaatgaatggatatgcaaaatgtgatacagacatataatggaatattattccgttttaaaaaggtaggaaattctgatacatgctataatgtggatgagactagagaacatcatcctaaggaagataagccagtcagaaatagacaaacactgcatgattccacttatatgaagtacctggagtaatcaaattcatagagacaaaatgtaaaatggtggttgccacaggctggagcaatgggggcatggaaagttattgttaatgggtatagggcattagttttacaagatgaaaagagttttggagatggatggtggtgatggctgtacaatataaatgtgcttaataccactgaattgtgcactgaaaaatggttaagagagtaaccattatgttatgtttatattatttatattttacttcaactaaaacattggggaaaaaatgccaccaggggaaagatctcttcccattagtaagttatgcaaatgcagtaggtctaatttctttactaccataggtatatgaaaggatcacagaggagagtttttcagataatgtcaggcatccacctttttattttaatttaattttttttaagtttatggaataaaatttcaaatagtcatctgctcgatgacttaggattaggtatggatgcttgttaaatcagtaaactccaatcagcccttctctatcctgtgagtatctctagtactgtcttgtggaatgaagtgcatgggttttacagcctcagagactcctttcacagattctgggtcatggctgtcttcctaagagatgaggacgatagaagtctggctatgggatctaataaggttttactaatttttttctataaatggaaagcaaggacttaatggtgattacctggacagtatcccttctagaagaggaacagagttttgggtggggcacttcacacacagcatttaggaaattcagtacccatgtcccatgtctgataacaaggcctccacatctaaatctacagggtaaacatggcaactctagagtcagggacagaaatatctctaagcaaccagggagttgaaagaggcttgctttttttctttcttgttacatctatggtattacattttccctgctgttgataaataattcagataagaaaagaatattagagccatgaccttttggaggacaaatacatttgcaattggtccccaaacacccacaggctcttgtgcgaaggtcagtattttgtatttgttagttggcagtatgttctttggggctttgaaatccatgggctttgtttctgtagctagaaggagagtgaggactgcatgtatgaaatgcacagacctaatggtgtcatcttgtcacggtccctaattgggctgctgagcaacaggtaatagactggtgggcattagtgggctgtgcagcttttttcagaagacgagattatctgaggatattttatgacatcatataattgattttcaacctaaatagatgtggactagactaccacactgagtatctggggacatgcatgctgatgtggtggggggagatgtcaggatgcctaatgctggaacttttgcctcttgcaactaggatgtgcatgcacacctaacaatgccacctacccgtttgttcacttctgaaaatcatctctaatatgaggataataataataatgatttaatttatattatctataacaataattaagaaggtagactctggatatagttgtttggattatttatgtttagaagcaatgttattatccacctattaagcaaatcatttgtgtcagcattcaccatgaatgctgaatatttggcaaggaaatgcggtagagaggaaagcatttggtattgggtattagagagactattttaatccagactaacatactacatagcctcaggcaagtcattttaactctttaggcctcagtcatcatctgcagcaggagatttttggattataaatggacttttagaagtaccattaagtgctgacgtctttgaagccaagattcatggcctttcatctcttcatccacagtgcttgctacaatgatatgtacttacttgttccttttttgtttttttgttttgggggagggaggcttaaatatacatctataatcatttggagcattgcaattttgtttgattcataaaactttattgtaagggtcccttttagttttacacttaaaacttttgaacagatgttttaaaagaatgtgtgaacatcattttgacatatttctttggtggtgtttgttttgctgaatattgcatgtaacttttgcatactgactcaggccataatgatgttttattaaccactattgacttgtgacttggaattgtcacacaagtgatcaaagaaccttcctttgcacatcaggagatttctgagggaaaactggagacacaggtacaggatggacagctggtctcccctttgaagttcttgtcatgctgagtttcatacacgcttttgaacacttgttggcaaatatcacccctctggcattgactatgctgtttgtttaaactggtgcccacagagccaaggcagtaacatagaggctcatggtgcaatgataacaggttccagttgtgcctttcctcaaggattagcctgtattttgtgtgtgtgtgtgtgtgtgtgcatgtctgtgtgtgtatttgtatatgcacgcgtgcacacacacagggcaatggggagggtaatgtgggattgtcacgggatccttggggtgttgcctcaccagctggaaacctctgtggctgacggagcctcccgtctaagtattgctcaggcccattgggctcgttccatcctcttggcccagcaggctgtgcttagcttatactactggcttggatcccacatctgtcaagggtgagccaggtacagagcggtgagggatgtgtgagcaagtgagcacacagtccaggcactgcacacagccaggcatgctggctgctttggtggggcaagcagctgctggcacaggtgctagctccgtgtgaggctgcggctggaccagatgtaccacaagtggcttccactgcaggcacctgaacaaggggaatacgttggtgcccaaaagcttggaaatgccaggaaccacagagccccaaagaagatgctacagccctggctcggggagcccctaaatctgggctccctgaagggtcgaagctcttctttccttcttgacatggtgagcagtggggtgggggaggggagtgttagagggggttcagtgcatgtttaaaccctgtttgcgttgctgctctttcagtcctgccatttgatgggtcccaatttcttgtcccgcatccaggatgaatgaagtatgcagaaaactggagggtgagcaaggtgaagaggagctttattgagtgacagaacagctctcaggagacccgaagtaggtagatcctttctgcaggcaggtcatcccaatgagtatctggccctcagtggagaggagacccatagtgcgggtcttagacggaagtgaggatagatggaagatgacctttccacagtcaggtcatcccaacaagtgtccagcttaagagaagacctgtggtgggtagcttctttcctcaggcaggtcatcttgatgaagagacccaaagtgagtagctccttcccacagctagtagtcctgacctctctctttgagtctggctgagtttgaatttttataggctccagaagggaggaagtacatgctgataggtccatggatgggccaagataaagcaccgaaagttttcattccagttggcagaactgacagcccagcccccaggcttcagactgtcctggtttgaaggtgaggcttcaccagggacccaccacttcccacccaggagcctgtctgcctcttgccaccatcaacctgctgtccctggcacccaggctgttcctgctgaggggtgcctgcaggcccccacccagccatcctcagcatccctctggcctccttcccatgctcatcagtgcccaaagtccagaaggggccccaaggtagcatgggactggtgtgtcagtgctgccctgagccctcgctcacctggtcaggatgcaaaagcacccaggtttggcctcaactttgctccaaaatcagagcaggactcgggagcaggggtggtgtggggcagttgttgggggatggggcttggtgggggggtgggggatgggctttgagagcaagcacttccaagccttcaggggtacaggggcttcctaggccctgagagcaaacggaggcccgggttcacaactgtggctgggtggctgcagctgcacctggagggtggggctcctaccccaccaactcagaagtgggcagggcttctgcctgttcccagctcttgcaggctccatggggcacgtagccccagccatgcctcctccactgcagctgatgtctttgcagcaaccactttcagacaggccgcagctgccatcaggatcatgaaaagagtgggaactaaatgccagaagacctgcattcaagtctccgctttgatatggcgagttttatgactttggggaagacactttacatgactattgtcattcttctttggcaaagtgagagtggagacttctgttttagtgcttctgaaagtctatgattctaagtggtgtgaatgaccaaggaggtcagaagaaaggcagcactcaggctaggatgaccaaagaaagcttctttgagttggtatctctggagctgtgaaatagggttttgtccttattgttgttgttgttgggactataaggataggagagtcttcctcagtggaaggacaggaaggagtcaaagcatagaggaagaaagatccaaggcctgtttaggcatcttctctttggtgtgatggcctttagccttcactggggatgagagctcttgaaaggatgacacactcttaaccaaactcgtctatgctcctttggcatctttgctttcaaattcctgattttaacagttctgataatcacttattccacagcaaatattttttaatttactgtgcttcagattctcttttgtgcactgagggtagatggaagagacagaatccctgtcctttgtgcttggttagaacatctgatctatgcagttggcatgggtagaggaagccttttggcacagttttaagtatcatttgagagaggcgtatatgcaacccacagtaatctattaaatagagcgtgctttgaaatgtaaagtccaaatgattgagtattggaggtatgactgaatagcatttcggagccagcagaaccatgtttactagcttaatgcacttgtatgaattacttaactttgctgaagtttaatctctcatttgtataatgtgcataatattagtatttataacatagggtggttttaagtattaaataatcagtgtaaaagaccgaatgcctagcatataataggtgtgcaaaacatgctagagtcactgttactattattataatttctgttatttttgtttttcacttaatgttgaacatggaatcacagtattgcttaaaagtggggaaaagcacgctatcacctttatcattgtgatatttactgctttctcttaaactcacagagttccttggttgttgggaacatgtagatcataagagcaatctatttatagcttttatgacagcatccatttgtggcttccttgcattttaggaaggaaaaaatatatatcctcttaggtatgatgatgattatatttcttaggtatagatagacatgtcctatggatgttaactcatgaagaactcaggcagagaagtgtgtaattgtctggtgcagtacagatacccagaaaactgaggaagatgattcaggaggcgttttgtttatatgaccagatttaccaactaaatggaggatgcaattcatgatgcacttgagcccaactttggaaccaaagagacctgaatttgtgtcttagttctacaactcatgtgacttacagcaagtcactttaacccatctgagcctgtttccttatttgaaaaacaggaatgataacaatagctgctcctttatcatgacataatatgagggatatgtgagctaagaaatataaaatgcttaatggaattatagcatatagaatcagcaactaaaacatataacaacattctatatatctagtaatacctacaacatagtagttgctcaataaatattagatcatttttctctctcatgtaactttatgtattttcatatggttatatagatttgaagtaaaatattaaaaatattcttttgagaatatttatcaatttttggtccctaaacttggtgtttcactttcatatctgaaactgtttctgtattctagcacgtgagcccccaggatttggtctctgccattgtggagtttatattctacatggggaaatagctatttaaaaatacttattatttcagttgttataagtgctgcgaagaaaaccaaaacagggtaaaggattaggaaattattggtgtgatccagagggctaaattacatagggccgtaggggaagatctagtgaggcagtagcctatttgagtgaaaatctgaataaggggatagtatgagccctgaaaagttctgtgagaacatttcattcagagggaataccaaatgctatgttgccaaagaaggactgagcttggtatgtgtgaggaaaagacagaaggcagccatgcctgttgtgaggggggtgggtaatgaggttggagtaataaggggagaccaggtcatgtagggccatgtgggccatggtaaggggtttagatataattatgaatgttttgagaagccattaaaagcttattcaactatagcagtggtaggatagtcactattggtgacatcagtagttcagtaatctatgtatttagtagcatttcctatatttccaatatagaaattgttgaggtagagtaagggtagttgggtattgttgagttcaaagaggtggcacaggaaatgactctgtccataaggtacttaatatttaagtgaggagacaaatctattacaaactgagtcatttgcaaataatttgctacactgtattactatctctaagtgcaaaagaagttaaaagtaggaacagtcccctgtggtttggagcaatttaaaaagactgtcattgttactgttatcatcttcatcatcatcatcatcatttgggttggtgtccacttttttttagagtacaagactattgtaaaaaatggtctgcagtaagcaatttagtcacaagtttaagtggatgttttcttcaccagtcaaatgaaattgtatggatttggaccaaaatacccagtctcaccagtaaagaagagaagagaaggtgagttggctaggcgtatccttaaaggcagtcattctacctgtattaatgtagaccaattactgttatggaatctaactcaatctgattggtatgcccaactcttacagaagagagaaggaggaggcatgtggtaaagaaagcagtggagattttctcttccttcctttaaattcatggtgaattcatcttataagtgaatggaaatactggactggattacatggaagagttagatatttgaaatagagatgtgaatcatcctgatacagataagtaaataaggatgaaaaagtgtttagagaaaagggtatacgaccagtgtcctggaggagaaccccatgtagagacctggaggtggaagaagcagtagtaaaagtggcaataaaattaagagattataaaatggaaataagaggcagaaagagttggtggttggcggtactgctagaggatcatacaggctcaggagggtgaaggcactgaaaattccattgtatttggcaagaagagagtcattggcagtattccaaagaggagaatcattgctgtctctaataacaggatttaaaaagagacattttgatagaaagttggatagcgggtagaatttggagggttttggcagtcaaaggattagaaagaattggagaaaaacctgatgaagacagcaaggtcaagtgaaagatattttgtcctcctcaggccaactgttaggatgaagaatacttgaaggctagatgggaaagcagaataaagatgcttaaggcatcatttcaggcaggcagcatacaggtggaggagctggctttgtggaagaagaggaaacattttcttcttaggctagaaggaagggttaaaaggtccaagccggaagagggggtctattgttaaagttaaatatacttggagagatccatgcctgtgaatgcactggctcgatcttttcattcagtacattttctgtaacataatgtctttctccatctttcagaaaccacgaaaaccagcgctaccctatgtaaatagaaacgtaaggtttctccctggagggacctttgaaatgtagtgtacactttattgctctctcacattctcagcactttgtttggcaaaggtgttttctgagggtggagagaacctgatggcattatttgtgcagctaaatctgggtttgagagctctgcaaaatggcatttaattcttattccctcggtgctcttggggaaatctcataattgctctctcagtctctccatctgcaaaactggtataaaatccctcttttccttcctagggcattgcggggattactaagttaatgttttataaatctctggaaagattctaaatgtgaagttccatcattacccacctactagatatgatgacactcataatgatatatttattacctcatgttcatttccacagcaatagcctgtgcatttgtagagatatgctttctgtgccagggcacaaactgagacaaaccatctatcactcagagacacgtcaacaagaaaataaaaagtgaacacatggtttgttttgacctaaatattgttttgggtgcagagcctgttgtgaatttttctcctgaaaacaaagtctgccccctaccttgctggaaaaatatttaaaaggagacctgaaggcttcttgggtcatgctgggtttgagatgtcaataaacaaagtatgaaatccaactgtgaataggtgtgatttatcagtgacagcaatttaaaaacatttttaatttttaaaattaaagttattttaatcaaataacttgattgttcaaataacaatcaagtcaggaatctctgaattttaattaggaagaatgatagtttctgtttgaaaccgtgactcatggaggggtccttcctctttgtgaagtgttagtgtaaggaatttctgtttgtctgctcttgtgccaaagctctggattacaatggatctagcatccagctcgtcatagtccataaaatatctgactctattttagttaattcaactaatgaagatggagtttgtcatgcaatgtcctcattggagtagttttgtaagaataatacaagtggaacgtattgagggctcatgcttctaacaaaagtttggtgtgtaataacctctaggtaatgcagagatggcttgtgaagaatcaaagagagcaggtccatcttacttctgccacccaaaataccatcttaaagtagggaagaggaccttctttggaaagtaagagtgtggtctttttcttttcctgcccattttctcacttgcctttgctgttttctaaatgtgctgccatgactggtgaagcctaaaatagtaccatcaattcagtctctagttatccatcctaactcagggacacttgcttttcccggtgcctggaaagcacttcccctcacatctgcatagctggctcccttacttccttcaggcctctggcaaaggtctccatttcagtggagcttccctggccatctttccaaatgttcagtccctactgtcacttgctttctcctctctctgttagttttcccttcttacaacttatcactatccaccacattacatactttactcatttaccttaatcatgatctgtctcttccactagaaaatttgtaagctctgtgagggcatgaatgtttgttgcttttcttcaatccatatcctagacactagaatggtgcctggtacatggtaggcacttgataaacatttgttcacattgtaggtgatcagtaaatatgaccagcaaatattcaatgtcctgggtactgtggtagatgctaaagatatattcagttgcaagtaaccaaaaatccagctcaaaataaacaataaggaagctttgttggcccatgtgcacataagtctggaggtcaggcagtttggggactgggttggcacagcaacacaaggatgtcatcaaggacctgagacctttcctttgttcccatttttttcctatgattcagctttatgctaagcctcctgggatctctctgtggatttgagatgagtgtcaagaacaacattatctttcatatctggggaaacagataatgatctctgagaaactctatcagaagtgctagaaagctcctttttcaggagctccccagcttgtatactcacttctgaactaaacaccgtgactggcagatacactgattcgctgaagcttaatcacatgctccatcccaagagcctgggttggacttgaaatatctcaaagcacctgggctatgtgtgtgggcaccctaatgaaaatcaggatatttataaaatgaaaaccaaatggataacagggagagaacaacaaaactcttttaaaccagtaagatcacatgttgtacaaagcctaatacctaccgagggaaattaattatgtatattacaatcatgtgctgtgtgctataggatgggaatacaaatgtgagagtttaatgagatcacatatgtaattgtattggaactgttagatgcactggagtttaataactgcttttaaaattgctcttattattacttcagtacacagaagctttggaagagtattctgaaggtcatctctcttgaccatcactagctttggatgaggctttggtcacagttctgaaagtctgcaatgaattaactctaaggcaatttgttttatcttctaaggtctgacatggtaaaatttatccaattatatattttttgtttaggtcatatcataaaaaagagaaatgggaattaaaattgtttagattctgatttttaatatattgctagctctttatagaaaacctttcttcaattggaggttttaaagttaggaaattaatcgtcatctagctgtcatccttattttaatgaataataaacaggcccatggggttaacttgctccaaggttatgaagttagtgacagtactgggaattaaaccctgatcatcagactctggttgagtttttttccaaattatgtgtcagaattatcttggttattgacattgtggaaaatacctgaatgattatttttatagaccctgcaaagtagtctgcctgtgtcccagtatagcaagaaatgaagtgctctggaagatttagtttttacagatgaaaaatggtcaattttatggttttgagaaattagagactcaattttattccagcttgtacccatatgcacatccattgcacacataatgtatttgcagaaagaaatcttgcttgattaaactaagtgatcttgacaatcaaatttgagatctcaagtgcaaaagaaatagaatattaaaagaaagaatctcactggaaaacttttagtctttgatattcagttaattgttccttcaggacacaatctgaagcaagccaccttccctcagctctgtaggttttctctaagcatctagagctggaagatttctttggcaatcacatacaatgaattggcgtttcctatttgttttttatccttctgtttcactgtgtgatcttgggtgagccagttaacctctgtgtgcctcacataataaaaaccagttcctccctaccctagtagtcccatctctactagagatgtggtcaagataaattatgcttcagtggattttaagtaagaaatctgaagataaattgatggtagtatatgagccttataaatccaagaggaatgataaaaggaggtgattaaggaaacagcagtagcttaaagcacagggcaaacttcaagcacttaggaacgcagagaacagtggtattaccattgtataccctcctcctctatcctttttatttatttatttatttatttatttatttatttatttatttgaggtggagttttgctcctgtcgcccaggctggattgcaatggcatgatctcggctcactgcaacctccacctcctgggttcaagcaattctccttcctaagcctccggagtagctgggattacaggtgcctgccaccatgctcagctaattttggtatttttagtacagatggtgttttgccatgttggccaggctggtctcgaactcctgacctcaggtgatccatctgcttcggcctcccaaagtgctgggattataggcatgagccaccacacctggcctctcctttttatttctgtatctctctcctatcaatcttgagtaaagtcatgactcaaaagtcatatgctctgaaaccaaatttcagacctgtctcttccatccctataaaattctaccagctgggggcgtctgctgatcaacagaaatttcctgttaggatgagcctttctgctcctctcaagaaacatgccttggtggtaatgaactatccacagcattatcctgggatggcaggcactgtggactggtccattcaatactgattccagtgcctgcaggcatgccttcctgttgttctacagagtctgggatgactagatccacatttctcaaattcccttgctatctgggtcccaagtatgacttagggtcttctaaatagataaattgttggtagctttgacaaggaactgagttatatataaaaataggatgggacagaggtttccattttgcgggcttaaatcacggcagaggcatggtgtcagcttcctgctttatttgcaggccttgtgacttgacaccttccagatcatggccgaggtagtgtggttctgaagtaatagaagctttgtgattctacagcctcctgatggtggcagaagctgagttttccttgttatcccaattctgtggtgtggtttgggggattgttcctgaaagttcaccctggagtctctttgtcatccttcctctgttgcctccgtcttctcatctgcaaaaggacacaatgatcaaagcccagcagccatcttgaatcatgagataactaaaaggatcactattttgtgttgctgaacctaatcctaatggatacataggccctatgaaacagacgcacggtatggcacaattaagactatttctaggcaggtggcaactgagtgtagctcctccttctatgtcccaacttatatgtaagtaaaatgaagtagaaatatatgctgatgaacaaatattctcaaaagggcaacccaagtgggatgtagggagaagtgcatctgggtaaggatttaaggagtgactgtatgcacgtgagtctccaggccaaactcccattttacacctttactagttgcctttttgtgtttgtgtttaccatgaaaggcaagaggcaaagactactttgctgtaactcactggaattcatgaacagttttggctaaactgtgtgcagcaggatgaactttttattatcataatagcttgcaggagaattcttcttaggaatttttgcttgggacaataataagccaaatgaatgaaattgagagaatcaaggtatagttagagtactctgtcatagaaataaataggagtttgtaggtgatggagaaggaggaaagaaaggggaaaggagagggtagtcaaggagatgatgtgaagctcgggcattatatggggtgaaatagctagcgaaaagtccttggtggagtagccaaaggacttgtaggaacaaggatgtcccatgttcaatttgttaagttggcatagtggggctgtaaggccctcttcttcaaacataaatatatcacttcattaaacagtagaactatccattggctgaatgaattcattcaaattatatacctgagccctaactcactggaatttatgtaaatcttacatggggcattgggtttctatggttgtgcagtagtaagtcaggaaatctcatggtgaccattggttatttttctttccaagaagctccctgtagacagattctccattataaagtcccggcaagatgaatacccatcaatgtttcaacttagagcagaagatgagacttgaaagataaaagacctgctttattaaccaggtaaaagaagtctgtgtcaagactaatgtaagaacaaggagctgggagatggaccatggggccaccagtaacaggaggtgaaggaagggaagcaaaaatgaggaacagaaccagaaaaacaggaatgggttaagtataaagtctgatttggaaggaaaaacacacataacatcccaaaatgatacctaaaaacaagtgagaaaaggaacgatggtggagcattagtttctggagagtttctggggagaaggtgttagtttagaaaatggggactgtgtaagggaaacagcaagtcaagtgcattgcaatgttattgtctgcaggaagcctcaggtgggccaagtgatgggctgaggggatgatgctatggaacaccttaggacaagctcctgctgagtggaagttagaagtaaaccactgtttttcttacacatttgtatctaaggacagttgcattctgattgagtcaactaatttgaggtatgtgaaatatgcatgcatgtttacatccctgcatctgtttttgtgttggaggctaaacctggatgaataagctcttacaaaacaatgcatataaagctttaggttttcaaatttgtccgtaatagagagagagaggaagagacaggagataaaggttttgttagcaggagcaccctatcttttatgtggcagtttttcctttctactctgtcactggggccttatccccagggaaatgttcctaggaatgaagacaagtagatatttttgcactagagtctgctgcttttagcgtgactgtctcaagagcgtgataggaaatgaaggtagtagttactgcaggtagaagacactgaataacaggcatgaatagaatgctaagcatgaacagtagtttgagtggcagggtatgctgtaattggagatccagggagagaaaggctgacagactctgaaacccagagatgaggtagggtttcccatgacaaggaagttctaaaatgctgtttcatggtgctctttatctcaggctctggaatcaggcagatctgatgggaatcatcacatattggcatgtaccttggggcaaatcattttaacctctttgcacctcagtttcctcagtcacaaaacttaaaaataacaatactaccacatagggttgttgtgatgattaaatgagttggcacatgtaaagcgcttggaaaaatgccaggtacatagtcagtgctatatagctatatgtgttgtttattattattactactattatcatttcttgtgtgccaagcacacaaggcagtgtttcgtatagaatatctaatttaattgtcataacaattcagtgagtaggtattattattcccattttacaaatggagaaattaagacttaggttaaataatttatccaacttataagtggtagaattggtttataaacctagacaggccacatctagagccccagttcttagcaatgtaaactgattaggtacctgacatttgctaatggcttggcaaataatagctactattataatcatttaaaatggaattggtatgtggtagaaggaaagagctgattcaaataattgagatagaaagatgtgggttggtattgtttaaattaaccagatatcagatgtagaaaggaaataccacaattaacctttggatttaggatacatagactgatggtgctgctgctgctatctcttgattatccaattgtatgatttacaatgaaagagtcaaataagcttgatctcttccacatgtcttagacatttttagtaagacatgcccaagaaaaagatgactgggttctgggggcccgtccttaacctttatagtgaaacctgccctctgttaacttagtcctcagaagcaaagtcagtatcagggtcgtgggccagaagtaccaggagtagcacgtgtgttaatttttgtattccaacattaaatgtcaagggtgaaggaattttctttcacaacctcaggggtctacttctgtttcttctctacttcttttatgtctttccctcattctatcttcagggtttagcccagggcctagaacaaagtaggtttgcaagacgtattggttgagagactgtgtgccctcagactgaatctgcttctgcctcccttggacaatataagtgaaggaagctatttcatgcctgtaagtttcatcctactcgttggtaaaatggtgataataatatttatcatcaaaggctgttgtgaggattaaattatgtaatgtgtataaaatcttctgtgtagtgtctggtgcacagaaagcactagtatcagtgccattctctgctctaccaatcagaatctgacagaagaaaaaaaacattttattcctgaatagttaaaaaaaaaaatgaccaatgataaagggccacttacagaggcataagtgggattaaggatataaaaaagaaggatgagataaacagtgctaatttcatcaggaagcctttcccatctttaggtctgaaaggatgaggggaagaaatagtggtgccagaggccagagagagccggggtcatggagctgaggaggcttggtgagagctgtcattatagtcgcctttatcacctcatagctgtggtcgtaagagtgacaccaaactaggagggaagaaactgggaagaattactcctacttctctctcctcctgccctttatctggaagccagccaacagggccctccagggatacagtgcaggacagaaaaggtagagtatagctatgagagtgaggtgggtggatggcaaataaatggagaaccaccagttcccataaccaaacagtaaacagaacgggaagaaaatgcaactcacttttatcatctagatgagtatcactttggccgggtgcggtgactcatgcctgtaatcccagcacttttgcaggccaaggtgggggggatcatctgaggtcaggagttcgagaccagcctgaccaatatagtgaaaccctgtctctgctaaaaatacaaaaattagctgtgtgcggtggcgtgtgactgtagtcccagccacttgggaggctgagacaggagaattgcttgaacccaggaggcagaggttgcagtgagccaagattgcaccactgcgctccagcgtgggtgacagagccagactccttctcaaaagaagagtaaagtatcacttctcacatcatggcactgagagattccgatgcattaggcttctaaaagtggtactgaagaaatttccttagaaccccttttagtgagagtgatagtagttccgtgggggatttaatagctgttatttgaaaaacagttctcatgcttaaattaatggggaaatgaggagctgaacaaaattaaacagatttatttgctgagagttttctcagagcctttgctagctaaggaacattttgaatctctctgtgggagatgtaatgtgccgcattccccaaatttgttttcttggagaattttacgaataaatacttctgggaatatactgaaggaattgtgtttaggggttatagcataggagaaatacacagctatcttagctctgcttcgaagacacaagctggggcccagatttcctgagccagaaccctctgctgtcataagtggctctgcatttagtggtaaatacctttgtatgagatataggctgggcatggtggctcccgcctgtaatcccagcattttgggaggccgaggtgggtggatcacctgaggtcaggagttcgagaccagcctgaccaatatggagaaaacccatccatctctactaaaaatacaaaattagccgggtgtggtggtgcatgcctgtaatcccagctactcaggaggctgaggcaggagaattgcttgaacccgggaggtggaggttgtggtgagctgagatggcaccattgcaccccagcctgggcaacaagagtgaaactccgtctcaaaaaaaaaaaaaaaaaaaaaaaaaaaaagaaaagaaaagatatctttttattttttagatatcttagaaaagtagttgctttggattagtttggcattagcagaggtaccctaatggaaagttaagctacgcaggcaatagtcttcaagttaaggcctctactgacaaggatttatccctcttgggcctccctggggcaggccagctatgttagcattcctagtaccgtttgacgagtatcttaagtgtgtgtgccacagaggaatacagaaagagcttgacagcatctctgttgtcaaagaacctgaaatactgttgtaaagggataaagatatgaacacataaaccattcagaaaaaataattccagatagctcttgatcaaatgccaaaacccattatagaaccaaggcatattcaatatttggttgtggttgtgcatatgaatgaagaaggcttctcagaaattgcacaacctcacctggccctgcagtgattttaatagatcatgagaggtcgccggggggagggtggatactgggagagactggtatttcagtcagaagaatgggaatagcagggttttatcaggaaaagcatgtgttccttcaggtgatagattcatggaaggaaaggacgagactgatggttttatttttgaagtcaagctgcctctgcttttggtggatatcacttaacagggtttatgagccttacttcaatcagttccttgagttgctgatgaacagcgtgggatcaacttctccctgtgggctattagtgtacttttcacccactgaaagttaattagaggaaacaacccccctgcacacctttcacactgattcatctgtaaggagccagtaaattggattggggaccagggagaattttacttgagatattttctttctgccgagaaattgccaaaatagaagaccttgagtttctgagttgtagcagaaaggttttctttttaaaatttgtatgcatgataggcccagtgataacataattcgttatattacattaccttaggggccacattgtggtcctggaacataaattctgcatatggaaaactaagggctcattgatactttgtttatctattgggttttgctagggttttttcttccctactctgtctctttctaacatcactcacagcctgcagaaaagagtatcagggaaaattataggttttttgttgcagttctggtctttaactttagttttatttatgaagggagaccgcaaaatataaccatattattgttaaaagcccaggctttgccatcccatggatgtgagtttgactctgctctgttgatggcctggctgctgaggagtcttaaatctatatcttagtattagatacatcccctctaactgtatcatgtaggtttataagtcctttattggatttcctaaaatctgaaggaatggtgtattagtctgggctcatgctgctaataaagacatacccaagactgggttatttataaaggaaagatgtttaattggctcacagttccatgtggctggggaggcctcacaatcatggtggaaggcaaaggaggagcaaagtcacattttacatggtagcaggcaagagagtgcttgtgaagggaaactcccatttatgaaaccatcagatgtcgtgagacttattcactaccatggaagagtatgggggaatcccctcccctgccccacatgattcatttatctccacctgaccccaccgttgacacatggggattattgtaattcaaggtgagatttggatggggacacagccaaaccatatcaaacagtcttcatttgttttttcatgtagtcaaacatttactgaatacgtgctgtataccaggtgctgtcactggcccaataggcgtaaataaatgggatgcacagaatttccgttctcatggagcttatattctaggtagtgaaaagagaaagtaaacaggttttcttgtttactgcacgtatggcaatttcaggtaggaataataaccataataatttaaaaagtaccagtgaatgacaaacactatgacggaaacaaaacagagtgaagctgtaaataactagggttagggagggaccatattagattagttgattagggaaggctctttgaaggcggtggcttttgagttgatatctggagaactggaaagaaacagccgtgcaaaaaccgaggaggagagtatttcaagcagagggaacaacaattgcaaaagtcctgtggcagtgggaatgagtttcactggagcatagtgaggcctaatggtggatgcttaggctacagagatgtcacaggagttccttgaactgaaaggaggaaagcttgtggtcagcacatgtgggtctgcacagtcaagatctggtcttgccttgctttcttctatctatggttgcacagttgtaaagcatccaccgtatattactcaaagtgctgctaagaaaagggcttcacagactggcaggggggcagaggggcttcaggctctgacctgttgactgtaatggattccttgtttgcttcagttttatggctttagctgtgcttggaggccaccatgcagagtgtcccttggccaagttctcattaatcctcttcaattgctaagagccataagaagggcatgagggactggtaatgtgaaggcagtgggggtgggtgagccctgactgttacttttgccgcactggttggttaatgccgttcatggcctgggcaataggacactgagataaaagtatgcctggaaagcagatggcattgttctcaatcttgtctgtacatttgaatcatctggggtgggcaattttttaattgctgagggacagcacactactctttcacccaaatattctaatttaatttgtctggagtgagacccagaattaggtattgtattagttcattctcacactgctataaagaactacctgatactgggtaatttatgaagaaaggaggtttaatcaactcacatttccacaggctgtacaggaagcatggtgggggagtcctcaggagacttataatcatggtggaagggcaaaggggaaataagcaccttcttcacatggtgaagctggagagagagagggcaaaggaggaagtgctacccacttttaaacaaccagatctcatgagaactcactcactatcatgaaatcagcaaggggaaatccacccctgtgatccagtcacctcccaaaaggccccttcttcaagactgaagatcataatttgatgtgagatttgggtagggacacagtgccaaaccatatcaggtatttttcccagagcacccaggttgaataccctgtggcctagctgtgtagctaggctctgtttcactggtctagaggaacatacattgctgcttcatttgttgtttgtttattttccctacatcatttctgcatgtctttggtttgaaaaccaggatcctttaccaaattacaaagacttacccttcataaagcagcatgaaggtggcatcccagggacttctgatcgcaacttacaaataggtgtgtgcatgtatgtatggagtgtgtgtggtatgaatgatgtgtgtatttgtgtgtgcatgctgcgtgttgatggtgcgcgtggtgacgtgtgtaaatttgaagtgtatcttgtggagtacttcagccattcatcctatgtaatgaccttggttaaattacttctcttctgtgagcctcagtttccacatctgaaatttggaatgccattagtgtttctgcctcatgtgtttgctttaaagattaaatgggataatgcatataaaatatcttagcacagttcctagcatagagtaagctctcaataaaagttattggttaaagatgaaatcttgatgaatttgcttaacctttctaagctgtgctttctgtatcagttgatttagaattaccattactattactaatgcacaatgttttggcaaaagtcaaatgaatagccccaagcattcactccatgttgaagtattacacaaagtaagatatgtctggaggtatcactttattgaaacatctatctccatccatttggcctgtctgatttctttgttccaaacagaggtcttttgcctcttcaaatcttgactgtaacactggctgacaatatagaggtaagtatggacactaatcctccctgaaggtgaagtactagatttaatagtcctggaatatcagagtgtttaggctactcctgaaggacatggacaaatcaacttctaatgtcctgctataccatgtcacagttcggtatgttttccagcaatggaatgcagggggtggaggggctgatggctttttgtttgtgcaaagcatttgttgtccaacaatggtagcatcagtgtgattgagtgtgaaaagtgtgtacttttaatctatttcctgatcccaattctctcctcgccaccttcatgtctgccaacctttcccagcgtagtattttgacaggtgatatgtttttgcttgacattgattaaagttccacctccattgcttaaaatgaggtgcatactaaatgttgaaccagcaaagacagcttcaattttgaccaaaagacatcatttcaagtatgtttttgaaaaattcagtctgcatttgttttcttgtcaaaaaggttttgcgggtattggggattgggcggaaggaaagggcaaagctgaggcctataataatgttgaccttgatgaatcctgataatacagcagactgttagatgtcaagttattagcattttcattttatcatactcagctcttgtctctgcaattgacaattgtagagatggtctttaaaatgagaattccctcatatgagtttctttttaattaaacaaaaatatacatatagaaaattatggattttttttctttctaagaatgaccatgaaaatgaaatatttcaggatggagatacttcatctttgtattcttttcttttgagctatttccagaggctttttcctaattatatcctgaatgatttcagaaatttgatctcaactgttttcctgtttttctgcatttacattgactttctcacagaagagtctgattttattctagatttgttttctataattttcatttacatcacctcttagcacctaagaataaccttttaaaattattcttctggaattcataagatgtttccttcctgtttatgcagatggcatatagctggttgggtctttttatgtccctcttaacgttcttagagtagatggattttagtctaggcatttaaaatgcaattgtgttttcatcaggcattttataaatcataaaattgctagtgtgttaaatagacatttttgatttaaccagatggaccattcattaagcctatctgaggtgggcagacaggctttcagaaatgagaagctcagtttggggccttgtgtctgagttagtggtgtgtatgtgcgtgcatgtgtgagtgtgtatttgtgtatgtgagatgacatcagtgtggctgggagtaaactaagatttcttttatgggggcgtgtagaacagagttgtaagaaaaatcatttatttcattaaataaattatttattaagcacttgctgtgtaacaggcactgtactaggcactggggatgcagcatgaataaagcagacacagaatgtttgccgtgatggagctcatcatcaagagggcgttggggaaatggaactaagggaaaggaagggcacttatagttcccagtactctgctaaataatttaatacattatatctctttatttatcacacttactatcactcttggccttttggctaagatcaagtgtatttatcacacttataagaagtcagtgaggtagatgttattctccttttaccagtgagggaaattgaagctcagaggttaatgtcagttaccaaagattatacactaataagaaggatatctaggattgtctgacttccaagtcatgccctttctaccacactgtgctagttatttctctttagaagtggagaacgtgttcttacccatgaggaatcctattcccaacccctggagacagccattgattaattgaggtttttaaaatccactaaaattaagaaccatacactgggcagcgttaaagagcccatgtgtggcaaaaactcatgttttatttctctcttcccatttaatggacaagatgaaaagagatgtgaaaatgggattagactacccaagaaacaggcctggtggctctgtggcttgtgctgaaaggtttgattgagctgagaccagttatggataaaatgttgatgttttgtgaagtttgtataatgaattgctacctctcttaatggtggcagtgggatagattattttcaagaccccatttatagatctactgaaatatatgatgatcaaaagtaaatacacacatctcagagaatattttcttaccctggaggatggtgatattaaatctgggctgaaaaatgattggtctgggacttgacatggcaggggaaatctatatatgcaactatctctgaaaagcaaaactgaactgtgaaatccaattccattcaatccattaaacatttattaattgattattatctgccagactttatgctaagttatgagactccagagatgaataaaccacagtctttttcccttaaggagcagaagtccaatgggtgatgtatacatgttaaattatagattctcttttaaggtgataaggacaaaaatataaaaatagacaagtttcttaaatagtcatgaaggaggagagattaatgtagaaaggaagaaggaacaaagcaagccttcctggaaggaggagatattaagctggattatgtaggatgacagcaaataaaccaggcaatcatgagatgggtatcccaagcagtgaaaatggaatttatcatgtgggcctttaaaaattaatttgggaaaaatatgtagaattctatgttgttagtacacaaaatgtgaaagaaggacgtgatgagcatagataatacgagttaacataggccatggcataaacaagcttgtattgtgtggtatacaatttataggactgggttgtaagcaagttggtctagggttttttgtgggtgaggttaggcgcagaaaactcacatgaaaggtgaatgcattacttctggtaagagacagtggtctgaagacagtgaagaaagagagggtagatttgatataaggtagaggatgcagttcctagagattgttggatttgggagcatatgtgtgaaaatcatcagaaaatcattttcaggctttgactcagggggctgggtggatgatggtattactaaccaagaggtttctaagcaaaggagaatctggtcatgggagtggtacaagtcatttgttcagtttggacagattgggtccaaactttagaaaccctaatggaaatgtctaaggattgggtaaatggatgtgtctgaaactctgaggcactgagtgtagagatgtatatttggatgttgtgaagataagagtgtcaattataaatttggaaatatatgaatttacctttgaagagaagagagaatagaactctaggtaaatcagtgtttaaggaaaagtatgtagccaaggaaactgagaagtagttaagaggtaggaaaaacaacagaaacattattttcttgaaatgaaggagacaagttttcagagacagggagagaacagaactgagagatcaagtaacagtgttgtaaaaccccccttggtttggtatttaggagtgcattgtgacccttgccaagaaaatgctggggagaggggacagaagtcagagggctttatattaaatggtgaatgagtgattaggaagtgaagatagcaagtgtaagtcaatttttcaaaatgcttgggtggaaggaaatgaggtaatagatggtagcaagggaaggatatggagttggggagagggaggagaggttgtgactgattggaaagggagagacttgagaatacctttaggtgaagacaagattttattaacagcgcagaggctgaagaccaaggaaagacttgaatagcatatagattacttagcccacatggcgagcacaggtcttgaataaaacaggactttttcaccctaggagtcataatgaagtaggagatgatgggtatcccaatgagatggaagtttgtagttgggacagggggcaggatgctgatggtgtttatgctactagccacttattaatgggtcccagtggaacctgagggcatctgttaaaaatgaaggaggatgaagatttaaagagagtgaacatgtgactgaagctgcagaaaacacagcatcctagaaggaaggaaatttttttttaaagattaatttgaagttttgaagatccagatggaattggaaatcatacgttttaagcaaaaccagtctgcctgaggaaatgattttgctccagcagggcacagttgcctctgccagagtagagaaggttaacaacagaactgggctttggctgggcaaagggaggtgtgtcggttagggagacaagagtttaagtgatggacagtggagctcatctaggctaaatagtcagaaacaaggaaaaaggagatgagagaggagtctgtagtttgaagagcaggtgtagtttgagtaagggaggtagacacctggaaggggagaaaattgtagtcagggaccagggtactggattgaagattcctgatgtggattacttcaaagagatggcagtacccagcaggtgattatgagaggatgacactgaagcagaaagaaggtgaagattgttatttttgtcgaggtcaaaactttgaaagtacattagtcagcaggtcattcatagggacattgaaatcgtttagtataatgctgagacttaagggtaaaatcattagagcagctattaatatataccaaattaggccagatgcggtggctcatgcctgtaaccccagcactttgagaggctgaggcaagtggatcacttgaggcaaggagtttgagactagcctggacaacatggtggaaccccgcctctactaaaaatacaaaaaaaaaaaaaattagccagatgtggtggcaggcacctgtaatctcagctacttgggaggctgaggcatgagaatcgctgtaacccaggaggcggaggctgcagtgagctgagattgtgccactgcaattttagcctgggcaacagagcgagagtctgactcaaaaatatgtgtatatatatacacgtacatatatatgaatgtgtatgtatatatatatatgtgtgtgtgtgtgtgtgtgtgtacatatatatatacacacaccaaattaaagaaatgaaacatccccatgtatttttaaatatttgccttagaatgatattatgcttgtccttgctgactcactcaatctgattatctctacagtatttcattttcttcctcacataaatagaacatgtagtattagatatatttatttgtaatggaaaattatacaagcatattacaacaagcattgtgtatgaaagcaagtattcaatatttgttgaatgaattaaaatgtgtaccatcagcttctatgcatttttgagaattacaccctgatgattgacatagtacacgcacttatctttataattcttggtatagcagttcttgctgagccatgagaaagcaaattgtctctgcctcaaatgaaaactgcagtcttaaattgattatatatgttagttgttcaattttgaattcctatttctggcatctcttcaataatattttttcttctttgagaagcaatatgacatagtagtttagaacataaactctggagtcaggctgccagggtatagatcttccatgcaacatcttgcctttggtgattagtttaacctctctatgcctcagttttcttatctgtaaaatgagtataacactagtctaaccatacagcatagttgtaaagattgcatatagcttatatgagttgtataatggttaatattaagtatcagcttcattggattgaaggatgcaaagtattgttcctgagtgtgtctgtgagggtgtttccaaaggaaattagcatttgagtcagtggactgggagatgcagacccatcttcagtctgggtgggcaccatctaatcatctgccagtgtggctaggataaaagcaggcagaggaacgtggaaggactagactcgctaagtcttctggcctccaactttctcccacactagatgcttccagcccttgaacatcagacttctagttcttcagccttggactcttggacttccactattgtttagccagggcctcttgggcctttggccagagactgaaggcttcacttccctacttttgagattttggggctcggactggcttccttgctcctcagcttgcagacggtctgttgtgggacttcgctttgtgatcatgtgagtcaatactcctcaataaactccctttcatatatacctctatcctattagtcctgtctctctagagaaccgtaatacaagttgtgaggcttaaatgagaggattaatttcgtacttaaaatggtaccttgctattgtatatgacagtgttatctattattgttttccaattttactttacataaatacataatcatttgaatgttagatgtgatctttccacttttacattctatatctttaccctttgattcttcatcttaccttgtgaagtcttagagtctccaacttgggaacacatcctactgtagcatagtttttgtctgtatttgggaaataatttttcagccttcatatcatatctacatttcattcaaaatttctctaagtatggacttcctttaagtaggactgagtgggcaagcagttttattttgttcagctgcctttattaaattcatatttggttatttattatagagtaataaaatcttacctttctgttattttttttctcttttcaagaagcttagttttttatatattatctcctttgttttctgaattcagacatattgtaggagtatttttgaggaattgagaggttgtttgacttgtctaaggtcacataatgattggcctgtttttctgctatttaatatagcatgcataatgctgccgatctgcttttgatctcgtgtttcagttctaatgactttcttattattgagaccaagatcctaactcaatcttagctctgttgggtccttgcttctctgccagagtgtccatatcgataacttatcaattattccatgttctctagaactgaactccagcctttttctaaccagtcaatcataggacttagatcttagacttggacctaggtcttggatccgtgagcttgttgaccagattctgtgaagctgcctacttggatctttaaatcatacatcctcctcagttctccagtggggttagcttaatatgcctgatcatgataaatttaagcagaaaatagaagtattggaggatattgatataggtatgataggaggtatgcaacaaggaaataaatgcacatctaagatcctgccttaggaatgatcttattaggatgctgctgctgcacttgaatacttgccactgtgcatctgattttgccaactctgggaaatcagcatctgtcaccaaagttgcaaatacaaatgtctattgcagcggataatgtctgattgaccaatgccttcataccacttcccaagagctaaagatcctggcagaaggcatctgattttgtgtgctgaagtcacatatccatgttctagctatctgggtgtagggagaggaaatatttgttctctttggaatctacactgcaaagtggggctatactgctaacaaatcttgagataaatgtcaaaaagtgagaatgtgtagtggctgaccggttgaaacacaaaagtcaaacacaccacccactatctgttctccccttgcttgtaatagggtccatatccctcttagctgagccacctactatgttcagttttaggattcagaccttcttcatctgttctatttagctgtgaccaactctcaggaccagatgtgtcccaagacctaacaaccagaatgtccgttcgtgattcttaaaggttttaacagtttccccaggcgcctcttgtcccaatagctaatctgcatgtaactcaaagagcaaccacatttcttttctgtttttagagaaaaccacatttggattttattaaggataagcacatttatctactcaaagaatacaaagagagcatatgtaggtctgcctctgtgcctttgtaaaattgaggacaagtgaaagcttcagggggtaatttaaagtatcaaaaactgcagcgttgtgccatgtgggaaacaccgaggtgtcctcctctgggaactattttctattcatcatttgaagacatttttcttagctaatatttttttttagaacctgtcaaaatgcctgggtattgtttgaaatgtctactatttgtaaagataccatccgacatggtgttctctaggttaattattcagaatagaaaggagtttttattttaaatccctgttcagtgtggggtatgttttaatttcattgtgtgcccttttgttcctgcataatagtaaaaaggagacaagattttcctagctatgttagactctggaatccattagcattttgtatttttctgatattctacaactggcgcttatatctgcatgtgtgtaatcataacatttgaaatttccttttgtttaaaggaaacaaatggagctttcataaaaaataatttatttttgaatattttagcaagttttgagcaatggatattctatttcaaggcaaaagaacctaggctaataatgtgtttcatggaaacaaaggaaacttatacattactatttccacagtattcgttacctaattcacattctgttttagctcagctacaaatggtaaggtcacctttttttactccctgcatgtaatactgcaatctctttaagatataggtctttttagtcctaacattctgattttaaataacttacttaatttaaacatgtagagttcttatggacttgttaccttaactatggttttaacctcttgctagcctttatacacacacacacacacacacacacacacacacacacacacacatttattagtattagtaacattttaaaaattcatttagaaatatttaagataaactaaaaagtatcaggaacaataccacgaagagctcatctcaaagcaccttccactctgctttctgaccctctgtgatcaaagaatctcttcccttgcatctgggctattatttatttcttttggtcatcatttctctgtcatttagaactgccatcatcagctgggcatggtggctcatgtccataataccagcaccttgggaggctgagacaggcagatcatttgaggccaggagttcaagactagcctggccaacatagcaaaacctgtctctactaaaaatacaaaacttagctgggtgtagtggcgcacgccggtaatcccagctactcgggaggctgagtcaggagaactgcttgagcctgggaggaggaggtttcagtgagccgagatcatgccactgcattccagcctgggtgacagaatgagattctgtctcaaaaaataaataaaaaaatagaactgctgccatctcttctttcctctgtcccatcaggttctgtaagacaggactgaccaaatataattatatgtgtgtgtataatttaaaaattttattaaccaaattttttaaagtaagaaaaggtaaaattaattttaatagtacattttatttaatctactatatcctaaatatcatttcaactttttattaatatagaattattgagatattatataattttttcaccaagtctgaaagctggtatgtattttatacttatagcacatcttaaatttggattaaccccatttcacatgactaatttcacatgtggctaatggctgccatattggatagtacagtaaaagttccctctccaatcttttctctgggaacataatcttttttttttttttttttttttttgagacagagtcttgctctgttgcccaggctggagtgcagtggtgcaatctcagctcacttcaccctccacctcccaggttcaagtgattttcctgcctcagcctcctgagtagctagaactataggcatgagccaccaggcccagctaagttttgtatgtttagtagagacgggatttcaccatgttgaccaggatggtctcaatcccctgacctcatgatctgccctccttggcctctcaaagtgctgggattacaggcgtgagccactgcgcccggcctgggaacataatctttatgttgacatttaactcagcatttttctttgttttgttgttgtttgactttactgtaatgtaagttgggtggagagaggatgcagctaagtggagcaaggattgggattgagtgcctctcagtataagtgggagaaacaagaggtcaggaaatctactgtattagttaactagattaacgtatttgaagatacatccctgcaaaatggattttactggtcagtttgtttgtcttagagtggtatagtgtatgtgttcatttatcttgttccagatatgaccaggttttaagattctgaatagttcctatgtcatagaagaaaaggatgaagctatgcccccaagaatgcatagggcttggaattagtttctaaatgaaattggtagagtgtgaccttcaagatcttcaacctgttagatattactcacagaattattggcggtgatggggctgggtggtgtctcatacagagaataaacagagccggagactgtttatgtatttgccaccttttgcatactatggacaacaatcactagtttatgaatttgttcggtatacactctttgtgtaattatatgttttaaataattcaatacaacaatttaattgaaacatgaaatgcagaaagacttaaatcacagctggtatatacccaagatgtttatagttaggaagggagacatgtaatactgtgaaagtataataataaaaattggtataattttaaatgattgcactgagaaaggagggattaaacctgtctatgagactgtgagactttactaagttaatgacaccgatgcctgagttttgaacaaagagcaggtgcttgagaaatttggaaacactggtcattcaaacacaagttcacatggggaatgttagggtaatttcaagtaaattggtgtcagaggagtatgagctgtcaaaagggagtggcaggaaatgaagatgggaagacaggcagactcaggtcataatggggtttaccactgtgctaggatctcatccttcagaatttagtttaaaacacaatgcttttacagtcttgttgagaatgggtggagcatggcgggaagatgatctagagacagattgttttaaaaagcttttagaatagtctggaggaaggatgatgatagtcagaagtaaatcaatggtagttaagatgggtttggcagctacgcttttggtggctatagtgggtggaattgtgttaccctaaagccatagtttgaatccctaatccccaatgtaactatatttggagatacagtatttagggaggtacttaaggttaaatgaagttgtattcatcatcttgggctgtcataataaaatactgtatactgggtgacttaacacaaatttatttctcatagttctgggggtcaggaagtccatgataaagctgccagcagatttggtttctgatgagggttctcttcttggcctgcctttttctgtgtcctcagatgttagaagttctggtgtctctttctcttcttataagggcattaatttcatcatgaaagtttcagcttctcgacctcatctaaacctagttgtctcccaaaggccctgctaccaaataccatcacattgggggttaaggcttcaatatatgaattttgaggggggtgggtaaagatgcagtctctaacattcataagggtgaggccctaatgcaataagattggtgtgtttataagaaaaggaagatacaccaggactgtatgcccatagagaaaaaagtcatataagaacagagagaaggcagcagtgtgcgagtcaaggagagaagcctcagaaaccaaacctgtgcgcaccttgatcttaaatgtctagcctccagaactgtgggaatataagtttctgttgtttaagtctgtggtgtttggtttggcagctctggcagactattacagtagctgatttcaaatagatgtaaactgtgcattgtttttatatatgggttttttcattgttttctctgcaccctcttgacttggtaggaagcttgagaaacaaagttctttaattaccttgtgaaatttaagaggataagatggctaagttagaagaagttagtggaataccaggacaactgtgtgagtctcaattctgtacaaacatttctattcaccctcaacaagctaatcttagactttaaatgtccacttaaggtacctagataactgtggggtgtttgttcctttattgacctaattagccaaagtgacatttattggctaagtcctgttttctcctgcctttagtgttatacacactagatactacatttttaatctattatggaaagagtttcacttgtcccacttctgaaagaaatcatagtgttataaaatgcattagttgttttggcttttaaaaatagagtaaggtcaaggaaagtacaattcttcttgagagcacccagagtcttctcctgtgttacattcttgtcaagaagattgaaggagaacaaaaatcctctgatttgtgcctcattttaaagactttgactctgtttcctttatgaagccacttcatgggagatgtagtaattaaatgtaaatacctacatttaattgcctgctttttctctagatgataacatttttaataaatattcttcaccagtatcttctttattttctttttatttcctttcaattcaattactttctcactgacattccttctcatagagacttgattatttattttaaatgatttaccatcaatttgttttgattgacagcattttgtagataaaacacgtctaattattcatgttgagttattgttattaatcttgaaaggttgaatccagaaagttttacagtatttcccagctcatgacctcatggtgccattcgcagaggaagctgacacttctctatagtgatcttcactttgactgcctatggtatgtcctatggttttctgttcttccttagaaactgctgaggtctatggcctggaatttgtccattccttggattaatagtagaaacgtctataccctagtcatctcaggtaggcccaaattttaaatactctacatgctgatgacttcagaatttttgtatctagtcttcaactcccccttaggatccaaccttctgaatctaagaggcaacttgacaattctgcctgaatatcaaatgagcattccggagttaccttttcaataaatgaactcttgacttgccctcaaatctctctgttctcagtttggaggttcctcaaaaaaactaaaaacagagttactatatgattctgcaatcccacccctaggtgtatacctgaaagaaaggaagtcgctgtattgaagcgatatcttcactctcatgtttattgctacactattcacaatagccaagatttggaagatacctaagtgtctgtcaacaaacaaatggataaagaaaatgtggaacaaatacactctggagtactctttagccataaaaaacaatgagatcttttttttttttttttttttttgagattgagtctcactctgtcacccaggctggaatgcaatggcatgatcttgggtcactgcaacctctgcctcctgggttcaagcaattctcctgcctcagcctcccgagtagctgggtgcccactacaacacccggctgatttttgtaattttagtagagacggggtttcaccatattggtcaggctagtgttgaattcctgacctcaagtaagccacctgccttgacctcccaaagtgctgggattacaggggtaagccaccgtgcctggcccaagatcttgttatttgcaacaacatggatggagctggaggtcattatgttaagtgaaataagtcaggcacagaaagacaaacatgacatattctcactaatttgtggaagctaaacattaaaacaagtgaacccatgaagatagggagtagaaggatggataccaggggctgggaagggtagttggaggagtgggggtgagaaaaggggatggttatattaatgggtacaaaaaagtagttggaaagaataaataagatgtagtatttgcttacacaacagagtgactacagtaaaaaataatttacatttacatttaaaaatcacttttaaaaattaatcacatttacaaattaatttaaaatgactaaattttaaaagttaaaaatgactaaaacagcgtaattggattgtttgaaacacaaagaataaatgcttgtcatgatggataccctatttaccctgatgtgattagtactcattgcttgtctatgccaaaattatctcatgtaacccataaatatatacacctacaatgtacccacaaaaataaaaaataaaataataaaaaagagacttagaagcgcacaaaaaatctgtcttttctctagtatttcctatttctataaatagtaccataatccatgtagaggctaaggccgaaacttttgatcaaatgaaagaaaatgaaaggaaaaaagagcatgtgacaatctaaaacaaataataaatgtacagatgaagaaacaaataaaatgctagttgaccactcactaaatgtaaaaacatggccttttgttattaaaagacaatgacatttagagtaattcaaaaaacaaaaatgccaatgagataacttcttcccaagcttaaaagtccttactagctttctttgttcgtaggataaagttgaaacaccctacactgtatatttattagggttctttatatactgagtaacaggaaagaactcaagttccttaaacaatggaggaaaaacattgactcaagcaactgaaaagtccagacataatatacatacataaggttcattttcagagcggattgacctagtgaatcaatattatcaggaccagcattatttttctacatgtattggctttcattatatagtgttgccccagtctcaagcataacctccatttgtggtctgagaatgtctgtgagaagccacatacttttcagttttaggtcctaagagacaagagagactcttctcctggaacaattcaaaccacagtgccaggattgtgttcttggcctatatagacctgacttgggtactgttttttttggcaataactttagacaatgggatggaacattgtggttggcttgagccctggttggcttaagcagttaaggctcactctgatggagattaggtcagttcttcccaaatatcaaggatgaaaaatttgagatatgttaagaaatagggaacttttcctgccttactttagatactgcagttctcttaatcctcctaatcatgaggatcagtcatgaggttggcaattgacgaataccttattatagttgcactcaagaataccaggtgtctcttcctgccaccgaccttctggagtatgagtctcctcccttgttcagtattctccagttatgttggtcttcttttcattccttggacacactgagctctttcttgattcaggccacatttgcacaagctattccctctgcttggaagtctctttccccattgtttcacatggctagctctttctttttctttagatcacagcttaaaatcaccattttaatgtgctcttcttttgaccacttacctacagaaaaccaaatatgcctccatgcaccctttttctcaccttaggtacttttcattgttctatttatttcctttagagtactcaccagaatctgtaatagtttgctcattgacttgcacatttatttattattttctcaaggattttaagctttatgaatggtggggggagatcatgtcaatcttattccatactcgattctcactatataagaaaatatctagaacacaattggtgtttaagtatttgtaaagtaataagtgaatggtctcctaaagccataaaaatcactgtgttggaaggaaattaaaaggtcatctctgataaatgggcatccaatttctgccttaacaacccaggtgacatggaatttactatctcctccaggcattccattccacctttgggtatccgtgactattagaatgctcttcctttttttttattgagttaaaaaatatcatctcactgtaattcagatatgctgatgctaggtgtattccttggaatccaatttatgtataatattctttcaagttgttgaagtcagctatcacatcctcctccctttctgtgtcacctcttctctttacctttccctaacttcttcatctattttttatctaacaagattttatctaatacttcctcaccatcctagtgactcatccattaacatggtccagtttgtctgttttcagttgtgttcagtgatacacacaatatcattcactgttcattgggcgagaccttccctgccttattttagagattgcaattttcttaatcctcctaaaatctctgagttactgattcagattaaacctatggccagttaaagctcataagttttttttcccccaggtgctgttgttaagctgcatggccatcaacttgtaaaattatgcatattttcaatgcctcatctttctctgttgtaacaggcacagaattgtttctctgaagaagattttgtgagatcaggtggccatttaggtatttgcattggttaaacttcttcagtcctacgagaggactttattgctaccttcttcctaattatttgtcagtgcatatgactcaattctgtattggtgatgcagtgtatctgctgtctgaaccctaaggagagataaaagcttgatgctactattgcataattcttatcagaaacccgggattgcctgaaggatattcagtctacccatcattccaaatactgtaaattataccttttaatcttgccagataactggagtaatgtttatagggatcatggtgaccaacacggagggatgtaagagggaacaaccaagtgaaatttgtttgtaggtatatgtttaaggatggatgttgtttagggttccacacagggtactctcctgttttattctaaagacctaagggagaagtatttcccatgtttcagtataaaataaagaaaagctggaacttgctagaaagaacagcatgttcttattttataatgttgtgtatctggtaaccatgtttctcattttcatttgactcttaggaagcttagatctatttttttgttcacatgtaatacctatgcagaactccagggtatacatttctgttgctgatgttactgttggcttgactattctcctacccatattttcctttcaacattaaaatataagatttgatttgtgattttctattctatgatgagctatgctaattggagctttattttgcatgcattctttcccatattctttctcttagtatgtttaggcaaaccccttccttactccatatgtacctaatgggactgtaaatcataattccttggtcatcttttggcacagaagtagtcatgtgaccagtctgactcctaggcattgaggtggcggtggagtccctcctgccgggcacccggagagtgggacagaatcagcctgctgagcccgatgcaagtgcttgcaccccagagtccccccaggaagagttgccatgtcacccagcactggcagatgtccccaggtcgtccaccgatgccttttatggcaggaggaagtgcggctggaccaagagccctctctttgtaggggacagggacagtgcaatgcgggctcctcaggcttttgagcactcagatgtggacagggttgtcatcagcacagaccacatccctgagcctgaacccagcctcttggagtccaagttctttgaacaaaaggatgtggaggcaaaaccacccttcaggtccactttgttccatgactccttcaatacatgactgggatgtgatctaagcaggtgaattagaataatcccaaaactcatctgtcgaacgtgttgggaaaatttcttgtcctcttggttcataactacaagggtatgggccttggactgcatattttctttcatgtagctctctcttatattgcttgtctatgaggctgtgatgagagaatttggctgatgtacaactagaagcagtggcaagtagagacaagacagagatacagggacacacacatcttgaagacataatttaaaatccaaccaggagtaaaggctgatccactttatgtatcccagttttataccacaatatattgctatttttcctccaaaaaaatttaagcatgttttctgtcacatttacctaatatataatattgccttttaaaaaactatatgcacttttgtaagcttccttacaaatactttgttgaatgagtgtcagtagctgtctatccatccatgtaaacatacaaatgtgtctttccagtatatatatatactgtattatatatatactgtagtttatatatatactgtattatatatatatatatctgtcactctatataaagtatatgtacaattgtttttataaaacaagtgaaaaaatttacatttatctatatatgactgcatttcatggcacttgactccattttcttggcttgctataatccttcttgatttatgttctattaacttaccctttttctttttactaacatgttatctatcatttgtagatctgatcattataaaataggtatcttcatataaattattgattctgtgataaacatggcaagctttgggcacataactgtttttagagaccatcctacatgcaggtacagcctattaatgaagatttaggttaggttgtttttcatcagtgaatacgtacatatccagcctttgccttacggctgtcctctagatgttttcctaatattctgaaacatcatgttttctacattttctcatctgctgacataatgatttcactaaactttgatatcagttcctgtagaactcctaacaaagggtacccattttagccccattgttttagatattttttcttatctcaaaaaatgagtttactgtggaacttgtgtactatatataattatacacacacacatacacacacaaagaagaagaagagagcaaaattcatctgtaatctcacgacaagaaataataattgttaacattttggtacatatacttttatccttgtctatgcacaaaataaacatgtctgtatattttttaacgaaactgtgatagacccttttgtaaattgctgtttcacttaacaaactgcgagtgtttctatgttattagcattttaataccatatggattttctctattttcggatatttatataagctgcttacaactctcagacaactagttttcttattctaacttttgtcttataatctaaagccactgaagcttgggctcctttgcatttctgaattaggatatagatgctgttgtactttgtcctcaagaaacctactttattactgtaagatatttcttagggtccagaatggaaattccctatattaaattcaatactacagtgctcttctggggctgcagggtgtgaatttgggtttctaatgcttctcccttagtctcttctcccatttttgaaccaaattaaatcagttgcccttaattctttgttattatttcatttgcactgatcttttcttagtaagatgtttttattgtaatgaaaataaagtattcttcttatgacttttgcaattgaaattacattttcatgtttctgaactttctttgaacctgatgaaatgtacttatgattatctggttttcaaaggcccaaacaattgtgtttcaaatttgtctctaacatttagctactgtgaaaatccaagaagggcgttttaaaaactgcaccgcaaagggtattttttggatctacctattgaacgccacagggtcattaacatctcatctggcctatatgtctcctcagctccttccaaatctaaaattctagtctccttctttagattctaactactagtaattctgcaggacaaaaccacatcagtagaccaaggaattgctacgttttagctcaagcttgttagcacagagtggttttctctatgatttctggcttcgtgtatcagcctgtgggttggttgggtttaaacccacatttaaccagccaggcccaaggtctagtgaaatgtgactttgcagggctgaatttccgttgatagcatgctccttctccgtgatcatgcagttgatcccagctttaaatcagtctctattcccctttgctgactttgagaaaatagccattattccaggtattatccccaaaatagttttgtttacatatctagtcctgagtgtataccactaccttctccgagggattaatcccatgggctatttttaattatttttttttctctagtctctgtattcaacaatgatacttctacaaataagaccatttatggagtatttaccgtatgccacacactatgccaaatactctatctgcattttcaggaatgagacattttgcacacattttcagatgtaactcttatataattcctttttaaatgcagtttagcttaacctagatattttgggtaaagaagtggaggaaaatgggtattttttaaatgtaggcctttcatggatcttgtaagacttcactctttggcaggtgtgtgtctgtctgtgtgtgtgtgtgtgtgtatgtgtgtgatgctactttgatttatagaactttatctctgaaaacctaggtttagaaacaataggaataaaagagtttgagttgctctattaatatattgaattcactttacaatagatctcactatgggatatccctaaatagctagctctccctatgcatttcaatttcaactggacttgcaaaaatttgatttacctacaacttctcagaaatatatgtacagaacaggtctttggtatgagacacacactgctccaggcatcctcatttaaaagagttacgtgacggtaggaggcaaagggggtaaatttcaagcttgactgtagaggccagtgagggaagaggcaaattatagactctggcacattttctggcaatatcaatctaactcctagttctctgctttgcttataattaggaatgcacagggctatcagatttaccaagcactttcacattctttttttctaatttaacagcttatgtactttgccacagggagaatgatactttttctttcctatcagaacactcttaaactttaatacccacctttttcatgaagactttcctcactactccagggaaaggcagtgatagccttctttcttgccttcagtttagttcaacagttatttgagagcaaactaggtactgaatgaaatgataggacacaatctctgtcttcaagaagaggcaagcacatgaacagatggggacagtgcttggcattgtgcctgacatatggtgggtggcatttcataagtatgaattgacttgattattgcttgatatgtagaggtatgtgtgtgtgtgtgtctgtgtgtctgtgtgtgtctgtgactgtctgtgtgttgctacaggaattcagtggaagacctgacctagtgtggaggtctttgtttgggttgaggacagatttcaggagttttcttagattagatgatacctaatctctgtcctaaatgataataataattatggcagtggctatatgctaggtacttttctaaatgctttatatgcattaatttatttaatccttacaaacaattccagtagcaactaaatgctattgttctccctgctttgcagacaaggaaactgaaggtttgagaggttaaggaacatgtccagggttatctggccaagaggaactggagccaatattttaatccaagagatgtaaccttcaccactgtgtagagtggtcatatatttttcatccaaactgagtcactgctgaaagtgagagatactgctattagataactaatatacaagtaactgattctgtcccaggcaaactgggatgtatggcaacattaccaaactctccctgcttactaaattctatatttcccacaaaatatatgtggtagcttacaaaaaactatgtcttctaacattttaagctttttcccccattctccatagcacctagtagcacttatagtggtgagtgtgtacatagtcaataactaaaaaggagctattgaccttgatatataaaattgaaataatcagatggtctagcccactatttttcatttcaaatgataaggtagttggttaaatatatcctctatcttgaacagtagaagtgagggacagacaatgaggatggtggaaaaaagaaaaactgctacagttatggaaggacatgtgggagtatgggacattgtgaaggagggaaggaggaggaagaagtgataattcatcctggtttgagactgctttagacccactattcttagtcatttttgtgtcataattcacatgatgcattaattccctgggaatgctcagattagctataatatggctgcagaagagataagaaaggcagcaggttttgtgtaattaattcctataatctaactccacttctgtcattccctctccataactgaaatatgagcaaatgagagggactttatgattgggataaccttgagttcattcttattgacattcaataagtaaagcactctaaatttctgtaccttaattatgagtagtcgtgaatcacatgttgctcatctcccatacaaacagggcaggccaggacaaacatgacctaaaacaatgttgaaaactggctccagtagaaataattctactccaggctaaaatatgagacttaaatttactgaattgctgtctaaaattagtagcagcgtaattctgaccttctttcatttccaaaagaaatatcctattttcttagctgtttcccgtcaattctgcattctgagtgggtttgtgagccagtaaccgcattaacaccaatagatgggatcttcttgtttgtttggtgtctgggcctttctgcatggctgaattttcaattctaaccattcttcaatttcatgtttgctctctctctttttttctaactcgagagtcaatgttagagcttgattttattgtgaatgcacatatgttatatcttgatactaagtaatatgagaagggatttctggcaaagcatacttaatcactgtaaatatttcctgttgttattcaaattcatgatgaattttaatcaggtagaaaatatccttaattggtccaatttagaacttaatagtaatccactggaataatgtgtgacagtgttgggtttaaatctatgaatttctcatctttaaggtacaaatgggttgctacataggtatcagtctttctgtttcacgactctacaaacagaatgattaaatgttaattggcagctccgatgctacagtatagaagaagcttcagatcatcatgacaatgcgactgtcactttttatcaaaacaacgatgttttgtctttgtgcacatttaaattttggagcctaattttaaaatacctcctatctgagatgagtgctgtcatagtcaatgaaaaagttgaggctttgtgccgtccaattttgccttacaatgtgggcatttaggatctttagttgaccaatccttcttgcttatctaacctagatgtctgtgttttccttcatggcaaacaatctttaccttgtctgccatgtttactccaggttcaggggcttttctgctaaaagtccttcttttcccctattagaataccctactatttccttcctgcaaactctgggcctaaatatttagagagtagactctggatttcttcatcttcttcatgcgttgctgtgaggattaaataagctaatgcatataaaacagtgcaatacctggtatgtagaaagtgcttcctaagtggagatgtcatgaatgtttctgtcgccatcaactttctgaaccatcctgctcaaaataccaagaacctcactttgttttgaattccaccttagtgaagtaaaatttgtctctccaatgaagagagctgaaattgttcccaaggtagtgagattgtaatgattgaggagacatttatttccagagccctcttgtcttactcgcatgggattattggaaagtgatggcagttatatttctacatcatgggcagggggagtacagaaagctgcctatgagcccagtctggcccacctgaggtttattgtgtgacagtttcctactaaggccatactggcaggcttgaaccaattagtgattgctattgaatagtcactatagcatttttaggccttaaaatttgattccattgaaattatctcacaaaattaagggaaaaactgaaggattctttacacaagagaaggaggtgagccaggtgtccttatgcactttgcctacgtttgcgtcacatccaatagatgtagagtgagcatgggtcctctcttctctatgttgtcatcaatcaaagtttaggtggtgacagaaatgtgaatttctgataatatgggttcttgatgaaacttcatatctattatttaagccattcagtctgtggtattttgtattttgttattgcaccccaaactgatgttaagggatgttaatgcactcctgatttaaggagtgataacatgttatttggtcaagtcgagttcttcagtttttttaatttttatttttaatttacaaaaaataattgtgtatatttgtggattacaatgatgtctcaatacatgtatacattatgggatgatcaaatcaggctaattaacatatctatcatctcgcatacgtatcccttctttgtggtgagaacaaaatggtagagaaaatctactattttgaggaatttagaaatacacattattatgaactatagtcgccatgctatgcaatagatgaccagaactgatttttttgtctaactgaagctttgtacattttgaccaatatctcccctttttctatctaccccctgccatctttcagcccctggtaaccaccgttttactccctacatctatgagtttgacttttttagattccacatagatgtgagatcatgcagtatttgcctttaggtgcctggcttatttcacttagcataatgtcatctagcttcatccatgttgtcacaaatgacaacatttcttacttgtttaaggccgaagagtattctattgtgtatatgtaccacattttctttatctagtcgtctgttgatgggcaccctggttgtttccatagcttggaaataataaacagtgaataatactgaaatgcacatgcaagtgtagacatgtctttgacataatgatttcaattcctttgggtatatgctcagtagtgagattgctgaatcacatggtaattttattcttagtttttggagggacctccatactgtctttttataatggctgtactaatttacattcctaccaacagtgtgcacccattcccttttcttcacatcctcaccaatacatgttacctttcattttttttataatcgttctaacaggtgtgaggtaatgtctcattgtgattttaatttgtatttctctggtgattcatgatgttgaacttttaaaaatgtatctcttggccatttgtgtgtcttttttgaaacacttctatgcaggtgctttgctcattttaaaaatcaggttatttgttttctttttatggagtactttgagtttcttatatactttgaatattactctcatatctgatgtacaatttgtacatatttttctccagatctgtcggttgtctcttcactctgttaattgttttctttgctttgcaaagttatttctttcttagacactaatatgaattacctaaaattagtgatctagtaaaagaagtactactagatttttatggccctgtttttctaatagggatttctttgctttttccacaatgtttctgttttcttggcctcacctgaggctgctaatcactaaatatttaatgagacttgatcctcatcttcaaggaatttgtaatctaattgaacagatgaaattaactgtagaatatcccagaacactcttcccttccccaaaaagtgcaggtagtgtgctggattatcttaaggacactttgctaggggtttatttaatagttttacaacagtcataatgagaaatttatttctttttcaattataaaattctttgggtgggaatcgtagctcacacctgtaatctcagcgctttgggaggctgatgctggaggactgcttgagcctaggagtttgagaccagcccaggcaatatagtgaaacctcatctctacaaaaattttaaaaattagctaggtatgacttctgcctggagccccagctactcaggaggcggagatgagaggatggcctgagcccaagagatcaaggttgcagtgagccgagaccacactactgcactccagccttggggacagagtgagaacttgtcttaaaaaaaaaaaaaagtttttctgttaggtgcatttagttaaataaaattttaaaaaagattcaacttaaaggatatttttgagtaaatgaaaatggaggtttttatgattagacaaaaactggaaggtaacccatgtggttctcagagatgggaaagaatggctttgatattatgcatggctgaggtttgtgaaagctgagaatctgtaatctgactgaacaggggataggaaaggggcatagtattactggcacttaaaaaactttttcgaatgacctcggttcttccaaactggcaactactgatttatagaacaattaatttattgtccatgggttctaaccttcaagaaatataggagttcagtaacagtcttgctcattatcagataaacagctgacagcttctccatggaaaagttgggctggagctagattctgaaaacataaaatattttgaatagaaagtagtgaagagagaatattttaggcaagtggtctagcagaaatttcgtgtagaggaaataatatatttggaaggttttgaaacacaatgagagagtggtttgattatgtactagttagttattgccacaatagtcatatgtaataaatcatctcaaaactcaatggcttaaaaaaactcatttattctcaaggatttgcaggttggcagaggtggctgtgcttcatgatgtgagttggctagtgtattctcatccaacttgtgatagcaggtgagcacaggcatgtttttagtatggcaaaggaaagtgcaagacaagcgccaaaatatataaaaacacattttaagtctttgcttatgtcaaatctattaacatctattggctaaatcaagtcacttggctaagaacaaaatcaaagagcaagaaaaatatactccatccaaatttctagacaccacgtgacaatactgagacttgacataaagagaatactcagtgaatagtcttttatttgcttcctggagctacattttgcacatagtttgagttaggagtggtcttacctgatttatgtttttaaccaaaatatagggaagtatttgtgcaaaggtttaggacagaaatcaacacactttttttttttttttttttttttttgtaaaggtctagcaagtaaatattttaggtttcataggtcatactgtctgggtagcaactactcaagtgtgttagcagcaggaaggcagccacagaatatatgtaaacaaatgggtctggctgtaattcaataaaactttacttacacaaagagctggctagaggactgaatttagttgggggcagggtgggcggggggctctggatttgccccccatgccatagtttgcagacaaattatttaggagacaacctagtataaatatacattaggcaatgtcattttgctgttcttatataattaaattaacctgtattacataatcttttatttatatcttatcgtctggaagaagaacaaactctgcggttgctttcaaagctgagattacagttgatgcttccttttggtgtgcaaatcagcgggtgttaattggaaaacaaattttttacatgactgaaatatgttctgatgtggaattactaatttgtgcctgattctgtttggcatgctgctgctcatgatttttatcagataatttacacagagattctcttttggcctgtgacatgaattctgaacaatcagaaaatgctttaagatcaagagtagacaatttttctttctgtgaaagagaaatgagttggcaaataaagtagaaataaatcatctatttctatttatttacagctggaagccatttagggttcaatttgaagggagatttttgttcttcctttagctgagcagcaaacacattggcctcgtactttctctacattttatcatagaagttccttagctatgtattctgtactgccttcttgtttctggtgagtttccctgttcctttactggggcaaggtttaggggctctctggcttggtcaggtcatgtagaagcagcccagcaaactttttgtctgaacatccaactcttttaaagaaatctttctccatggatttccttaatatcttgtttcaaaaaaaaaaatgttctctgcctagaaaactacgtttttctaggtgaatcctgaatcctatttctatttttccccatctcaccattgatatactaggcaaagtaaacaccatgtcaaagaattttttttctaaaaatgaggatgctcgaagtgcctatacttccccattaaagttcacatttctttggtgaactggatactcttgctctctccctgcaaggtaacatagcaggagctagaacaatttttagacctttgaaacctaatttatttgtcatcattgagattttgctggctttcatttggctgacatgtgaagatgagtaatacatttatattgtatttatgggggaaaagcagatgaaatattcaggtttaggttgatgcaaaagtaattgcagtttttgccactactcatggtgaaaaccgctactcatggtgaaaatcgctattacttttgcaccaacctataatacaaagtgatactaggcaagtggatttactcaggggatatttattgaaaggagaaaaaaaagctgctgtttattgaatgcctacttcataacagctatatggctttaaagagttagtaatttgccacagtctcagaggtggggcatggcagaaatgagattggaatcccatttcaactgcaaagctcctcttttccttacatcactatttcacattagcaatatgtactgatttaaggaaacagctgggaaattatgcctcttgtttgctgtctctgaactatacattcagtaagaagtttgaatttttatgatattagagatgggaaatgttcacacttaattttgttaacatttcttttctctctattatcgcaggctaaatttttccactttcttaaatggactgcagaaaaattgcagaaaccttaaatcttcatttaattaatagaaaatacaacaccttaattgtcattattattattttttctactagtgtactgaagaagacatgctggcttctgagtatatgtggttcactctgtgagaacagtagctgaatttttaatagtgtttctgtagatttggcattattctaagactttacatatattgacttatttaattctcacaactatctaatgaagtaaatactgttattatcccaatgtaatagataagaatacagagacacagagaggtgagctaacttcccttttaactttatcacagctaccagatggtggagctgagattcaaattctagcagacgccagccagagcctgtgctcttaagaaaatgagctccagctgggcacggtggctcctgcctgtaatcccagcactttgggaggccaaggcaggtggatcacttgaggtcatgagttcgagagcagcctggccaacatagcgaaaccccgtctctactaaaaatacaaaaattagccggatgtggtgtcaggtgtctgtaatctcagctactcagagaggctgaggcaggagaatcacttgatcctgggaggtggaggttgcagtgaaccgagatcacgccactgcactgcagcctgggtgacagagtgagactccgtctcaaaaagaaaaaaaaaaaaaaagaaagaaaatgggctccattgaactttgtaatcagtcatggttcagtcaggagacagtaaccacacaaattattttataagagagaatttaatataactacatattaaagaacttataatacgaaaagagcataaagttatcacagaagtagacttttcaggtatcacagaaatagccttttcaggaagcagctacctagggctagggaaacaggaggaagaggttggaattattaatatttagaggaaaagaggcttcccaggtgctagagtctctgagcatagaaaaatggtataataggatgggggctaccagaggaaggtaaagagaggctggccagctgatattgttatctgagggtgccataaacattgctcttcaaatgttgggaaaacggcaaatgggaaccaagtactgctactggaaagaaaattgttgctgttggactgaagaatcattgctaggatgatacttacaagaagaagctaaaagggaacaaacaagaaggatgaagtcctgtcttcattctgaagctttgcagttctcctctttcacccatatgggcagagcctgagagggaacggctggcaaaataaagatgtggtgtttacagttccagtcccagcaccacaaagctgggattgaccttaaaccaaatttccaaatagaaaagtatgttcaagatttatgaaaaaataatgtgctattggagaattttattacctcagtataatataatcttatacgttttttatgaacatgatctgtctctcccaacaaattatggactctctcaaaccagttctgacttaagcctttttcaagggccagcttagtgcaaggcacataggaggtgcataataaatgattgttgctgaagtgatattagaaacatttaaatgtagattttcttttaaaattacttttacaggtttcagaacatctattcatagggtcagctgaacaaataaagcttgcgaatgagaatattattcaggagaagggcttgctctatccctgtgaatgctcaagagagctccagtgtttgcagaaaagttttacaaagattaaaacaatatctactccccctcccctggtgagattatcattaattaaggaaatgcaggcatcgatctgtttgatagcattccatcagcagagctctggcctataaaacgcaggttgagattttcactcgtatttcaaggatgtttcccagttggatggcagcattttgatcccccgtgttacctgtcaaaggataatgaatataactagtgggaaccatgccgacccaacagatattactttattttaataatgtgattggaatcaggtgattggaatgtagtgttgagttgaacagggttagaaaatgagtcacatctctgaacaagtgagattgagggagggtaaagggaaatagcttcactagtctgaaacaaaaggaaaaaaatctgcgtttccgttactatgatcatttttgggggctcataggtggaaagaataaatttgcctgttttcttacatgttggcccatagtatgttttctaggtgtagtgaagggcaatgcgatatagaggcagtagcaccattcctaaaccaggaacgtgtgactgggaaccccaagttggctagcaactggtgtgtgagcttggagaagtcacttaacttcattggccttcagtttcctcttttgtaaaatgaagtgattggttataatcaatatcccacattccctcctaccccattctatgtcctcctcttttttcttagttcattggcatgcaaattgtttgtttattgtttgttttgttttgttttgtttttgagatggagtcttgctttttcacccaggctggagtgcagtggcaccatctcagctcactgcaacctccgcctcctgggttcaagcgattctcctccctcaacctcctgagtagctgagattacaggaaggtgcccaccatgaccggctaaattctgtatttttagtagagatggggtttcgcaatgttggccaggctggtctcaaacttctgaccccaagtgatccacctgccttggcctcccaaagtgctgggattacaggcatgagccatcacacccagccaggcatgctaaattgtgtttcaaatgtgtcagtcgaaaacagactcatttttcaagatgtaagtcaatgtctctgaagaaaagcccatactataaaagaatactagttttcctacaaaagcatttaatttatgatatgttttaccataataaaatgaatgtcctctgtttttaacgaggagttttgattgaagtgaaatcgtgttttctagaaaatgtagatttttgccttaagttctaattattgaaatggaaagtttgaagccatcaaatagtgaatcaacttgtgaatttcctcatccttctaaatataatattaaaaaaattgatatgcaatgtaaatatgtgttacattttcaaacggcaacttcagatacagtattttgttgttagcaccgataattactgatgctttaacagccaatcgcataagaattgcccttccttgagcttaaccaattgtctgtcatcttttagtgtgttttcctcccatctcttcacttgtccatcttcccatccatccatccatctatacttccatccttccattaacctatccatccatccttagggctgacaggataattcaaacatattgtaaaagaatgttttctctcttgatgtctgctactaatgttataaataaacagcccaaatcacatttgtttctattttgaattctttataatttgactaggaacatacttgtatttaattccagtatctttttttttttttttttttgaggtgaaatttcgctcttgttgcccaggctggagcatagtggtgcatctcagctcactgcaacctctgcctcccaggttgaagcgattctcctgcctcagcctctcgaatagctgggattacaggtgcccgccaccacacccggctaatttttgtatatttagtagagacggagttccaccatgttgaccaggctggtcttacacttctgacctcaggtgatccacccgcctcggcctcccaaagtgctgggattacaggcgtgagccactgcacctggccctatcgtttttttactacttaccatgggcaagctagttaaccttcctaagcctcggttttagttttcaaaattgagatcctgcttcccagctcacagggttgttgtgactaaatgtgataatgggtataaagctcttagtgcagtgtctgtcatacataaattctctctcctctagcttttaacctgcaccttgcttactaagttctagtaaaatggattgacttttagcaccttatctggcctttgatgagtatttcttatctattaggaaagaggcatctgcaaatgactctaatttaaacaaaaaggggcttattgcaaggctatcaggagctcacagaacttattggtaggatgatgaaacttgtgtagaaagggactgaaaccaaggaggctcctaagggccaggatgcagaaaggaaggaaagatctcatagaaggaatggttagctggatacatctaaccaccatatcctctggcttcttatttctctgtctctcaagagtcaaaattgaatgaaaggaaaagtctgattcactgagcttaggtcacatgatggctgatcttaggtcatgtgacttctccattattttactggacatgttaaaagaagggccccattcactgagaccctgtagtaggagggagtttctggattccaccacagtatatacaccagtgaagcatatgcagttccctgtaagggaccttgacacctgttagaagaggaaatggatgctggatggccaaaaaatggcaaatgtcagtgacagtgagtatatgtgtgttcatattctctctatctacttgtttttacccagactcagaatccattagttctcagtctttatattggtaaacttataggtcttgactgattttagtttgttcgtctaagacatctctttccatctcttaggatattttaattgctcatctctggaccctctccaaggcttgttaagcctttattgagctgtggtaaccagagctgcacagttttgtgtcttgacatagtgcagttggtttcaaggaaaggctaatatgtttggtcttatgtccaatattcttgatcaacattaatgttatttactggaggaaaatcagtctcatttttatatcactggaacatccagcaatgcaagccttgctggcactggggaggtctaaaattttctaaatagagggaaatgaataagtagtggattgtttgataccatgtaggagaaagggaaaaataaacaaaaagctgcatttctacaaaccctcaatctgttctgagtacagaaagtcatttgtttggaatttagatccaggttgatttggttgtcaattctagttttccaaatgtgtgactttggacaagtcactttaatattgctgactgtcatttctgtcattggtgaaatagaaataataatattccgcttgacaggattaagtgtgactcacgtgatttcacttattaaggctttggcggaatatttagcacatgacagaaatataatttaaaagtcttttttttgtccatttgcactaaagagataagagaagtttgaaataattaaaagtcactggatcctattggggttagtcaagggaagacttgacagaagcgagccagaagctggtctttgacagagaaaagtgacatgactttatggaaagaagacaggagaacatgaacagaagagagacaagatgtctgaaagtttgaagttagatagattaactagttttccttttggtaattagaatagctggctagaaaagggtggaagatggtgctaaggtaattgctaagaagatgagatttgatttgaggtttctgaactcaggaggcataaaatcaaagtaacacttaaaatgataaattcatccttaatgacatggccattctcaaagaccacattgactggtctattaagcaattaatacctccctttcaaatttttgcctatttatttttaaatttcatgcagtgtctctgggcaagggtgctgactctattacttgtctattattgtcactctatgatttgtctcaggctctcttctgacctcttctgtccaagttgtctatgtgaatagacatcctgtgtctgcccttacagggtcactttattcagagaatcatagaatgttcaagataggctattctaatctacccaattttcagattaaaaagctgaggacctgaaagaggacatgaattgacacagattatagacttttagagcagcatgtagttaacaaaaataaacaaataaggattttaggtagatatcatgcactttagtagatgtataaacttggaaatcttatctgacttttagaacctcaatttcttttctgtataataggcaggtaattgatgatacctgtttcaaagggtgtctatgaaactgaaacaaggaaatacctcttgaacatctgaaaggagagctcaatatgtgttagtttccttccctttacttttagaactgatttgggttctggactataaaaaaagaattgcatcatccctttggggaagatgaaggggaaaggtaaaaatcactgaagaaatctaatggtaaatgaatacattttttgcttctgttcttttcctacagtcagtatcatcttggggaagcaggtgaactagctttttctcctcagtcactgtgcctggggctgggacagttctcatgattctggttggaatttaggctgacatttgaggggtgagacagatggccatcatctccattaagaataactgcaccccagccctttatccacaactctgcaaatgtgtttggctcccatagcaggtttatgtgttggcaatatcagtgaaatgattccttccagcttggacatgtaaagactttcagggccctatggcttttttctctcacttttctttactcattctcacagtcttgaaatttacaacccttaagtccacaaggctgttatttagaagtgaaggaattgttgtactgacatttttctaattaaataaaaaaaatttatttaaaaagaaccaaaaatagaagcaatgcaaaatatacagtgaggcacagtggataaagaacagatgtgcaaattagagaaacttggttttagcatcagagtttccatttacctgctctgaagtgtctggctgtgtaacctaggacacttcattttgaatatttttagaattctttccagtataaatctttgtgacactataagcattttccttttaataatattcacaaacttacaaacatataggaaaatttaaagtataatgtgaccatattggacccatcattgaatcctatcaaatcttaacatgttgtcatatataccgtcttcctttctttgcatttgatacttatcattttcacgcatgttttatgctgctactctatgtccctatatttaaaaccaatttgtatagtattgtttgaaatgcttttaactttatacaattatatcataatgtatatattcaactgccacttgcatttgtcactcaatgtcattgagatttatccctgctcacatatgtagctcttcattttaattatgatacagtaatccattgtatgaatagttcacaatttacttatcctttttcctgatgactagtttttacaattacaaagaatgttggaattaatgtactggcataagtctccttctgttatgtgcatctttaatttgccttgatattgtcaaattgcttctaaagtttggaacattattgttcaaattgtttattcctaggtttatttattttataattacctagtagctctagaaactattaagactcctacatttacatatctttgttcatttaagacacattgcacacagtctttcacaatgcactgtactaaatataaaaatcaaaaagacatggcaacctgctctcaaggttacctatactttagacaaggcatgtgcatgtataattatttttatatattatagagagaatatctactcagtttgttgagcaagagtaatttacttgtatcacctttcttaagattagtgggtgccagttaccctgaaatattttagttgtctgttgtttcttccttttttttttttttttatttaatgtactctggtactataagaattaaatattacttgggatacagaaatattttagtttttataagtttgcctcagttaaggtctaagtcctttggttttattattgatctacaaaggatgttgtaactattgaaatgtaagaaaaaagatattttgttgctgagtttaatacagatgtttgcttatcacatttagcagtattgaaactggagccctaagaatggcttttctgtggattgtggaaagacattcagtcattggatgaacaagacaacaaacaggtcttggtttctagtttgttttgtcaattcaattcacaagacacaagtttcacccagagagtttatttagatttaagaaaagatgcaggcagggtgcggtggctcatgcctgtaatcccagcactttgggaggccgaggtgggtggatcacctgaggtcaggagtttgagaccagcctgaccaacatggcgaaatcctgtctcgtctaaaatacaaaaattagctgggcatgctggtggatgcctgtaatcccagctactctggaggctgaagcaggagaattgcttgaatccaggaggtggaggtaatagtgagcagagatcgcaccactgcactccagcctgggcgatagagtgagactctgtctccaaaacaaaaaacaaacaagcaaacagaaagaatgtaaaatgggaatactggaattcacaactaggagcatcataaggccttagtcatccagacactggtgtcccctcatagtctggtatttgttttagttccaagggataggaactgaccctagattgggtcacatcagcccaaggaagctgcagtgtctatgctccttcatcttaaaatccttgagaatttcctagcatgttgcaggagagtatgctcagttcccattcttaagtgtcgctgcaggcataagtgatcagatattctgacaactaaatacaggatgctcagggacagccctggaaatgtaatcagtatatgacaaccctaataagaccctcatttatctctaaagattatattttctcacttgatattgcaaaaagtgcaactgggtgtcaaattttcctcaagcattcccagaagctggagaaagagattatagcccaatcattaactcttatctattatgttgcctcagtttattcagccttgccaattcaagtagacaatgagagaggtcatagagttctgagatggtgctttctgcctccctagcagggaagattttgtatgtaatgttgggcatattgcaaggtggcagtgtaatagggtggtttgagagcatgggtgggctttggaatcagacaaggccatgttcaagtcttagctgtgctgctttctagctatgtgttactgtggtaggcaaaataattcctcctttccatatatgaatccctaaaacctgttaatatattaggttgaaaaggagaattaaagtttcagatggaattaaggttgctaatcagctgaccctgagatagttatattgtcctggatttctgggtgggatcaatttagtcacaggagtccttacaagtgaaagaggaaagcaagaaagagagaaccacgcatatagcagcatgagaaggacgtggctcaatgttgctggctttgaaaaggcagacattaagtcacaagccaaagaatgcaggcagcctctagaagctggagaagtcaaaaaacaaaacaaaagagatattccctagaagtccgccaaaagaaaacaacactgccagtacctttttagcccagtgagacccattttggacttcagacctccaaaagtggaagacaatgaattcatgttgctataaggcactatttttggtaatttgttacagcagcaataggaaactaaaatagcgatatttatgtcttgatgcttcagttttctcattttgtaaaataaggattataacagcactttcctcctatggagattgttttaagatatccatttttgtgcagagcatttggcctactcttggtaagactcaatctttggacgagacatttaggtatttgaacaagaagttaggaaacttggattatggtttcagacaaaatgaggacacgagtaacttcctgcctttcttataaagttgatgtgaaaagcaaatgaaattatgttttaacttttatattttaactaaagcattattcaaatataacttcttgttataatttagcttacacattccaaatggacttattagataatatgtgaaagatataaaaattcaacacttgagtcatcagctgattgtagaaaaatagtgttggggtaatagataatattaattccaatgactggtactgagtagtaagttctttcttttaagatattctatttttatagcacttatatttcctacttatgtggtaataattatggttctttatttcatatggcagggatgtgtgttatcttttaattgcagcctttgcttataatgtctgaatgtaagcacaataatatttatttaattgaactaaagataaagtggaagaatcacatatttggccaggatataattatcagagctcctctaaaacacattttgaatattttaaacggtgtattaatttttagtaagtgagatggcgaagttcttattgttctgtatgctaatgattaagcatttcaaatatttatcattaattttgattgattatgcatttaaataagtaaattcaggcagataaaattaagatttatttgtctcactgtttgaagtattcctttactgaggtcagtaagtgtatgtgtatgcaatgaaaagtgagcattaggctattactgtaattgcttatcactattttcattttcataaacatatggcaatatgcactgttatattaacagatatattgttttcatcatcttatttttcagttgactcttgggcacagtcaaagggcatgttttgtagtgacagatttttcaaattcatgcttcctatggaaattttaagaagtagaggtttgtttaaattctataccagggcatagaagaaacttaaacagaatgctaaaggaaggaatgtggccacttttttctgggcatacaattagtctagtcaatagaggtcacactggaccaagcatttgagatgtttcaactccccactggggcaaacttaccacaaaatgtgctcatccattttccagtgtcgagagaaagaggaaggcggacatcgtggagtctttaatgactggggtttttgtagagcttttaatgattgttttaaagccatttatcactaagaagtgaaaaccatttacaaaatgtagtggttaaaatgactgtgactctaatccataacttgacagtttactttttgttatttctcctattcttttaaacgtgaggtattgcaggataggtgaggggggaaatctggttatttgactactaatatgcgaaaatccaaaaatttagattgagtaggtaaatggggtaatttttaatgttgcaaatagttgatctgttttgcccaagaatgcggttcctgtcgaagaggttggaataggacagaaaactttacatttgtaatgttcagcagttttgatactcttaggtcaatcagaaataaagcacgcaagaacctcctgagatgatacagcaaatgtgtggaaactgggtaatttttcaagaactggagaaggactgtgtctgaatgcagaccatgcagagataacagcatatatataaggcattttgtcactggcatcttgaaaaataaaatcaataaatatttaaaatttatttgcattttagaaccagtcagcatcttcacatagccatcaggcaataaagaagctttgaaaaagaggataaaatgtatttatagaggaaaaaaataattttataagtacatttaaagtggaaatgcttagggaagtttgtgactaggagatgctgggaagttttgatttgtgattctgcaaagttaccaaacaccaaaaaatttcacagataagtcatttcatttgatgttcttgatttttccttttgagtgacagggataaaaagaaagttttagagattgtctgctggtttcattgttggcactgcaaagggagaagtcagtatctgatttttagattcctagggtttgtctcactttgatggagaaaatatttcacaatgtttacacttgaaattcttatctttgtagatttcagaggattcgatgctagttgcaatgggtttcatctttgaggagtctcacagatgtggatcatccttattccatcaaattttatttctgttgagccagataatgattataatgttagtgtccttcacattggaagattttccagctatgaaggaaatgacagtgatggaactcatattgacctttagtcgctgttaaaatatctctaaaggacagactcatggattctcataatatcagttaccagatggcatttctagggactctgtctctgccttctggaggcctaccctgtagcctccagactctctagcacccatgctgacatctacctcttcacctccgggttctaacacagccctaaagttggtgcttatccacaatgaatcaatcaaggcttggcttctgactggaatgggcttggttgttttttcccaattttatcttttggaacagctagaaaggaggaccgggttgctcagtggtcctcaaccttcatttctttctggaagagatttttaaaatgcatatgtctggacccccccatagagattctgatttagttgatctggtctggtctagggctgggcattggttcattttaaaaaattccccagatgatttaatatgtggccaagaagactggggtgctagtccacactctggattctcaaagtgtggctcctagatcagcaatatcagcatcacttgggaacttattagaaatccaaatcctcaggccctaagcaagacctaccgaatcagcaactttttaggggtaaggcccagaaatctgcattttaataagccttccatatgatgctcatgcatatgaaagtttgagaaccactgatttgatcaactttctaagatggggtaaactgttgaggatgcactccatggatacaactgtatcatatgcaaaaggtgcttagcacagacccgagtctagaactagggcatacaccaaccactggggagtaagcagattacaggggtccatgctagcaatgagcatcccagccaacaatttttgttatcaagaggtaatgcctgttcatagcaggttaggactagagtgtgagcgtcggggagatgttatgctgggtttaattcttggacttttctttattaatttaggaaactaatgtctctgagcttcatttttcactgggaaaaaaattattacctttcaaggttgttgtgaaaaataaaattgtctatgggaaaggtccagcaagaataaatgttcagcacatgcccagtaaaaaatacatgcttaagaaattattgctattattattattcccatatgagaataagcaatacattgtacgaaggctgtcatggttgcctctggtgtccaatgtcaaaccttataaattataatcataaaggagtctcttcagtgaacctgagtttggtctcaagtcctttctaatacagtaggctggggcaaccactatcagaaaatcggatctgactttcaagataaaccccattttccacctctaattaagattgcaaaaatcttagagatattcctattctttcattttcttccttcccacatttacttcacacctgctctgcagagtccaatagatacataatgcaagatacagatataattttctgttagccacattaagaaaagtaaaaaaaaaaaaaaaaaaaaagggcagttaaattttaaagtatttttaacctaatgtaatatatccaaatattatttcaatatgtagtcagtataaatattattaatgagatattttacattcttctttttggaactaagtctttgaaattcagtgtatatcttatacccatagcacatctcaatccatgcaagccatatttgaagggctcaatggccacatgaggctagtggctgccatactggacaatacagctctaggtcctggggccgagcaccgaagcaagggctggtaattgcctcaacaagctcacagtttattcagtggctcagccataggcaagtaatactatttttcagcatgaagtgttattacctcccaccttggattttcctgaagaacgaagtcatgtagtctgagtcaaagcagaatacttgacatttctttagggttatttggttttattgtttctacatcttgtgtgtatgatctgaattgtcagccctgcttgtagcctgcaagttgtacactctgaccttaacatttgctacataagtggaggttggacttagtgttgctggtgaagaatgtgtttctgctgtcctgttttggccctagtccataataatgtgacagcccagccacttgctgagcatgtgctgtgatatgccaggcacagtgctaagcaattcttacagaggttgacggaaagtccaccagtggcttcctaccgtacttagaatataatccagatggcttaaaaggacctacctgatttcacctatggccaccttggagataccatttcctaccttaatcccattttctcactccacttctgcttcccaggccttcttgctcttctttttcccaccttaagcctttgtcttggcattcctctggctagaatgctagagggttgctagaattatcctgggaacaccccaggataatcgtatggtttatttctgcatttcatctaagtcttcatttatgtgtcctcagaaaaccttccccaggcctctctatctattttagtaacctcatcactctccatcccctttctctgctttatttttccatattactgatcactacccttaattacatattacatgttactttacatatttatttattgtttgtctctcctgctagaatgtgagctgtattacagcaggagatttgtttcatttgttcaccattttgttttctggacttagaatagcacaggcacttaagaggtacatcacaaatatttgaataacttcaaatacccatggtgttatttaattctttttctttcttttcttttcttttttttttttttttctcactctgttgcccaagctggagtgtagtggtgccatcttggctcactgcaacatccacctcccaggttcaagcaattctcctgcctcagcctcccaagtagctgggactacaggcacctgccaccatgcccggctaatttttgtatttttattagagatggggtttcaccatacaccatattggctagggtggtctcaaactcctgaccttgtgatccgcctgcctcagcctcccaaagtgctgggattacaggcgtcagccacctcacccaaccggtcttatttaattcttaagccagtctttttttttttttaactaaaggagaaacagtatgacagataacacataaaaacatgagtaagttcacagtcattaagtagcagagctgagattttaactcaggattatatgtccagagctcagatttgtaatcactgtactttctctagggagaacaaaatcttgtttcctatgcttctgggttcctgtagattctccagaaagaaacaaacaaccaaaaaaaaaaaaaaaaaactgtagctttcttggtatgattttctacttcctctgttgttaataggctgttagacagcctcagccagaggaactggatgtagaatttggtgacagcttttgacagtgctatcaacagatgcattgaagttcccagggcaattactgagttgatgttgatgaaaatatattttgaatactgcaaaattgccccttcttgggatttattttagggtctatattaagtgataactgaagactactgagtaaaggcagtgtgaggcaactgataaatagtgaggcatcctttaatacacctcactttaacgatgggagactgtctcagaggaacaaacagagagtctttctaggtgctttaactttcatttcaacccagtttcacaagatctcactgaacttctgtttcatatcataccctgagcttggagctagggatatcatcctgattgtatcagttgcatctattgctatgtaatgactacctcaaacttattggtatcaaacaaccgccattttactgtgctcataaattctgtgggtcaataattcagatagagccccgcagggatggcttgtatctctttgatatccggacctcagtggggaaaacttcaagtgctgagggcacttttaaagctgggaaatggaatcaactgaaggtttctttccacatatgtcaggctcctgggttgatattcctccaaggctggactcagctggggctatcaactagagcactccatgtgcctctccacatgttcttggctttttacagtgtggaagctgggttctgagaagcagtggcccgagctgaagcatccagacaatgagtgttcagaagctgccagacttctcacctagccttagaagtaacacagccacattctgtcggttacaaacacatttctaaggccagtccagattcaaacggagggcaattagatttgaccccttgatgaaggagggcaaggttacactgaaaaacagcatagggactgggagatattatgatgtccatttttggaaaatctgccacagacacagtgaagaaaatgatatttgttactacctgtgaacatcacgagctcaatcactggtagagagagacaggtgcgtcagactgctgtcaggaagcttaattttcctttgaaaagcaacattggcccatagtgtacacattttgtttataaacggggttatttgctctgtcctgcatttccatcccatgtttcactggagcaatgttcatagatttatcaccttagtgcagtgactcactgtgtgagatctggtgttgctttggcatttggaaatcagcatttattttcaaagtctatcctctgcctcattttgcttggctaactcctatacaatcctttcatgaagggtcacttcctccagaaagtcccttctgacccttcacctggattatgttcttctgctttgaattattatggcaccatgcaccatgcctacctcttgtcctagcatttgttatctgggattagaatggcctatttttgtctctagattgtaggatctagcaaggcagggccagtgtctgtcttcaccattgtatttcttgtactagtacatggttaaagtcagttttgtatctattctttttacatctggtctgggaaaaaaataggcaaactcaagggcagagagagggccatacaattatcatgatatatttatcttgttcttcttactacccctcttcttattctttcttttattcttcctcttcatttatggaaggaatcaatcatggacatctcctagcacacttaccttaaatccattgggctcctagccaactctgtaggtagactctgttagcaacaaagaggaaaaagggcaacaacaacttttgggtagtcaaccaagacagagtaccctccaggacatgtggctgggaaaacctaataacttcctaagctccaggggctttatttttaatacacattcccaggaaaactcatcagatgtttgaggcagcaaaaacagattcttttaagactcttgcaatctcagtaagtacatagttttatatttccagggtggcattccctttggtagttggcttgtcatatcttttctagttttctatcttttgtagtttgagtctggctagttagaaaaaagctatcaattatgaagaatctgtgatatattggttactgtgcaaaacttgaaaaccatatttttcttttttttaattatacttcaagtgttggggtacatgtgcagaacgtgcaggtttgttacataggtatacatgtgccatggtggtttgctgcacccatcaacctgtcatctacattaggtatttctcctaatgctatccctccccagccccccaccccccaataggccctgttgtgtgatgttcccttccccgtgtccatgtgttctcattgttcaactcccgcttatgagtgagaacatgcggtgtttggttttctgttcttgtgttagtttgctgagaatgacggtttacagcttcatccatgtccctgcaaatgacgtgaacccatccgttttatggccgcatagtattccatggtgtatatgtgtcacattttctttatccagtctatcattgatgggcatttgggttggttccaagtctttgttattgtgaacagtgctgcaatgaacatacatgtgcatgtatctttatagtagaatgatttacagtcctttgggtatatacccagtaatgggattgctggatcaaatggtatttctagttctagatccttgaggaatcgccacactgtcttccacaatggttgaactaatttatactcccatcaacagtgtaaaagcattcctatttctccacatcctctccagcatctgttgtttcctgactttttaatgattgtcattctaactggaatgagatggtatctcattgtggttttgatttgcatttctctaatgacgagtgatgatgagctttttttcatgtttgttggccacataaatgtcttcttttgagaagtgtctgttcatatccttcgctcactttttgattttttttcttgtaaatttgttgaagttctttatagattctagatattagcccctcatcaaatgggtagattgcaaaaattttctcccattctgtaggttgcctgttcaccctgatgatagtttcttttgctgtgcagaagcaatttagtttaattagatcccatttgtcaactttggcttttgttgccattgcttttggtgttttagtcacgaagtctttgcccatgcctgtgtcttgaatggtattgcctaggttttcttctagggtttttatggttttaggtcttaagtttaagtctttaatccatcttgagttaatgtttgtataaggtgtaaggaagggggtccagttttagttttctacatacggctagccagtttacccaacaccatttattaaatagagtattctttccccattgcttttgtcaggtttatcaaagatcagatggttgtagatgtgtggcattatttctgaggcctctgttctgttccattggtctatatatctgttttggtaccagtaccatgctgttttggttactgtagccttgtagtatagtttgaggtcaggtagcgtgatgcttccagctttgttctttttgcttaggattgtcttgtccatgcgggctgttttttggttccatatgaaatttaaagtagttttttctaattctgtgaagaaagtcaatgatagcttgatggggatagcactgaatctataaattactatgggcagtgtggccattttcacaatattgagttttcccattcatgaccatgaaatgttttccattagtttatgtcctctcgtatttccttgagtagcggtttgtagttctccttgaagaggtccttcacatctcttgtaagttgtattcctaggtattttattctctttctagcaattgtgaatggtagttcactcatgatttggctctctgtctattattggcgtatagtaatgcttgtgatttttgcacattgattttatattctgagactttgcagaagttgtttatcagcttaaggaggttttgggcagagatgttggggttttctaaatatacagtcatgtcatctgtaaaccgagactatttgacttcctctcttcctatttgaataccttttatttctttctcttgcctgattgccctggccagaacttccaatactatgtcgaataggagtggtcagagagggcatccctgtcttgtgccagttttcaaagggaatgcttccagcttttgcccattcagtatgatgttggctgtaggtttgtcataaatagctcttattattttgagatacagtctgtcaatacctagtttattgagagtttttagcatgaaggggtattgaattttgtcgaaggccttttctgaatctattgagataatcacgtggtttttgtcattggttctctttatgtgatggattacgtttattgatttgtgtatgttgaaccagccttgtatcccaggggtgaagccgacttgatcgtcgtggataagctttttgatgtgctgccggattcggtttgccagtattttcttgaggcttttctcattgatgttcgtcagagatattggcctgaaattttctttttttgttgtatctctgccaggtttggtgtcaggaggacattggcctcataaaatgagttagagaggattccctctttttctgttgtttggaatagttccagaaggaatggtaccagctcctctttgtacctctggtagaatttggctgtgaatccgtctggtcctggactttttttggttggtaggctattaattactgcttcaatttcagaacttgttattggtttattcagggattaaacttcttcctgatttagacttaggaggtatatatgtccaggaatttatctatttcttctagattttctagtttatttgcatagaggtgtttatagtattctctgatggtagactgtatttctgtgggatcagtggtgatatcccctttatcatttcttattgcatctatttaattcttctctcatttcttctttattagtctggctagtggtatatctattttgttgatcttttcaaaaaaccacctcctggattcattgattttctgaagagtttttcctgtctctaactccttcagttctgctctgatcttagttatttctcatcttctgctagcttttggatttgtttgctcttgcttctctagttcatttaattgtgatgctagggtgtcattttagatctttcctgctttaccttgtgggcatttagtggtataaatttccctctaaacactgctttagctgtgtcccagagattctggtatgttgtgtctttgttcttattggtttcaaagaacttatttatttctgccttaatttcattatttacccagtagtcattcggtagcaggttgttcagtctccatgtagtcgtgcagttttgagtgagtttcttattcctgagttctagtttgattgcacagtggtctgagagactgttacgacttccgttcttttgcatttgctgaggagtgttttacttccagttatgtggtcaattttagaataaatgtgatgtggtgctgagaaaaatgtatattctgttgatctgaggtggagagttctgtagatgtcttttaggtccccttggtccagagctgagttcaagtcctgaatatccttgttaattttctgtctcattgatctgtctaatatggacagtgaggtgttaaagtctcccactattattgggtgggagtctaagtctctttgtaggtctcagagaacttgctttttgaatctgggtgctcctgtattgagtgcatatatatttaggaaagttagctcttcttgttgcattgatcccattaccattatgtaatgcccttctgtgtctcttttgatctttgttatccgtctagaattgcaacccttgctttttttttttttttttttggctttcaatttgcgtggtaaatattcctccatccttttattttgagcctatgtgtgtctttgcacatgtgatgggtctcctgaatacagcacactgatgggtcttgactttatccaatttgccagtctgtgtcttttaattggggcatttagcccatttacatttaaggataatactgttatgtgtgaatttgatcctgttgttatgatgctagatgggtatttttcctgttagatgatgtagtttcttcatagtgttgatggcctttacaatttgatatgtttttgcagtggctgctactggttccttttcatgtttagtgcttccttcaggaactcttgtaaggccggtctggtggtgacaaaatctgtcagcatttgcctgtctgtaaagtattttatttctcctttgcttatgaagcttagtttggctggagatgatcttctgggttgaaaatttgtttctctaagaatgttgaatattggcccccactctcttctagcttgtagggtttctttagagagatccacagttagtctgatgggcttccctttgtgggtaacccgaccttactctctggctgcccttaacattttttccttcatttcatccttggtgaatctgacaattatgtgtcttggggttgctcttctcgaagagtatttttgtggtggtctctgtatttcctgaatttgaatgttggtctgtcttgctaggttggggaagttctcctggataatatcctgcagagtgttttccaacttggttccattcccctgtcactttcaggtacaccaatcaaatgtagatttagttttttcacacagtcccgtatttcttggaggctttattcgttccttttcattcttttttctctaatcttgtcttcacgctttatttcattaagttgatcttcaatctctgatatcctttcttctgcttgatctattcagctattgataccaatgtatgcttcaggatgttctcatgctgtgtttttcagctccatcaggtcatttatgttcttctctaaattggttattctagttagcaattcctctaaccttttttcaagattcttagcttccttgcattggggtagaacatgctcctttagctcggaggagtttgttattatccaccttctgaagcctacttctctgaatttgtcaaactcattctctgtccagttttgttcccttgctggtgaggagttgtgatcctttggagaagaagaggagttctttttttctggaattttcagtctttttacgctggtttctcccccatctttgtgtatttatctacctttgttctttgatgttggagacctttggatggggtttctgagcgacgtcatttttgttgatttggtgctaatcctttctgtttgttaattttccttctaacaggcccctctgctgcaggtttgctagagtttgctggaggtccactccagaccctgtttgcctgggtatcaccagcagacgctgcagaacagcaaagattgctgcgtgttccttcctctggaagcttcgtcccagaggggtacccaacatatgccagccagagatctcctgtatgaggtgtctttcagcccctgctgggatgtgtctcccagtcaggagacatgggggtcagggacccacttgaggaggcagtctgacccttagcagagctcgaacgctgtgctgggagatttgctgctctcttcagcagccatcaggcaggcacattgaagtctgttgaagatgcgcccacagccaccccttctcccaggggctctgtcccagggagatgggggttttatctttaagcccacgactggggctgctgcctttttttcagagatgccctgcctagagaggaggaatctaaagaggcagtctggctacagtggctttgctgagctgcagagggctccacccagttggaacttccctgcggctttgtttacaccgtgagggtaaaacctaaaaccacctaccaaagcctcagtaatggcagacggcattccccccaccaagcttgagcatcccaggtggacttcagaccgccgtgctggcagcgagaatttcaacccagttgcccttagcttgctgggctctgtgagggtgggatccactgagcacttggctccctggcttcagccccctttctagtggagtcaacagttctgtcttgccggtgttccaggtgccactgggatatgaaaaaagaaactcctgcagcaagctcgctgtctgcccaaatagccgtccagtttatatttttcttaataccattcctcaacaaagtagatggttgtctctgtgctttaaatatggggaaatgggggctcagatgtgagaaatgtactgatattttactgctgtctcatgttggagctctgatttaaatgcagtgtgtctgtctctaaaacccttattcttccccttacctgccaaagatagttaaataatttcattatggacatatatgcccaggcctcttccctctatcttttagggtatcttttttagaaaacagtaaaggtcattaggacttgggccctcactgtcctctcggtactttatggtgtgaaaaattatacaaaaatttgattataatattttcctagggcttctataacaaattgtcatacactccatggcttaaaacaacagaatctttttctctgacaattttggagatcagaatcaaaaattaaggggtcaacaggtcatactctctccaaaggctctcagggagaatacttccttgcctcttccaccttctggtggctcctggtatgccttgacttgtggtagcatcggtccaatctctgcctatgtcctgacatggcctgatccactctgtgtatcacagtgtgccttctgctcttataaagacaccagtcattggatttagggcccatactaatcccatatgacctcattttaacaaattatatctggtgagactttattcacaaataatgtcacattcagaggttcttggtgtatacaaatttgggggtggtactgttcaaccaaatatgggtgggaatgaataattcaataggaatatgaagatacattgaaaagcaggataatagggatagcacattttcagagttctgtgtttctctttgattctacctacccctccccactgccttttctttggaatctcatagttgactgagcctcaaagcatctggacagggagccacaaccactgatgaagggggaggaaaagagatttttcccctttgtcagtctttctctcaagttccttttgctttttttgtccctcatcttatttcagaaagggaaagaacaacatgttcatactgagactccctgaaggagagggcaaacttctgtgataaagaaaaagattaacccagcattatttttcctaccatgtttcatctttagacacttgtcttcagaactcctctaggtatctgtgaaaccaaaagaatcacaagccactctcttcacagtagagagacaaagggcctcagcaaaaaggacactgtggggatgcctacgtgaccattacataaaacccaagttaaaacaaacagcttcacttctttcttttattctagttgtgggtattcctattggactaggtgacttaaaagaaaccttgaaacattggaccacagttaagctcttcattaattttgtagtttaataatgcatttctaaatgatctctctggaacaaaactaagattcactgaatctgtattacttgcctggtgtgctactggacacttttttgcgtagtctcttttgctaatcttcccagcagctctgtgtggtggatcttattgctcacattttcaggtgacaactcagaggctcagagacatcaagtatgctttctaaggtcacaaagtgagcaggtgacaaagctggatttgaactgaggttctttctctttgcaggatgccatgaactctatattcctaaggcacatagaggagagtaatgaatctaataaaatcttcctggaagttttagggaaggcttcattagaaacagacccacatcacactgtgatgatgttgatgatggtaatagtgtcagtgggatagtctctgccatttttggagttcctactactttatgtacaaataatgaaactagatgctctacaaagtttcttcctatgaacactcattatatcaatggtcttgagaatctcctctttagcagaatctgttcagatctgaggaacaaaagactaagccaactatgccaagtttttactctttagtcatggtatcattgtctgtattttactcacacacaccaactggaccacaaagagtttgccaaacctctcctaagtgacagtgctgggatttgtatctaggtctatctgctgccaaagctttgtcttttccattcagtcttagatacatctggaatccattttctttctttttttaaaaataaattttgttgtgtataagttatacaacatgatgttatgggatacacatagatcataaaaaggttacaatagtgaagcatttaacatgtccatcatctcatatacttacccattcttttttttgttttgtttttgtggcaagaagagctaaaatctatttatttagcaggaatctcaaatacagtacaattttatttgattacctatagtccccctcatgttgtacattagatctctagacttgttcatcttacatatttgttactttgtatcctctgacctacatctacccttttattttcttttttcttaaaacaaaacacaataaaaaccgtctattctttagtaataaaagatacgtattataaaacattcaaaagtgcaaaatgagtaaaatacatagtatgcataactcccgtttatcttctcttcaacactagtgtaaattactgtcaatattttaacatgcattttatagactttttctatttatgcacaattatatataaatgatggatatatattatatataatatgtcatatttaatacataatttatatatccaaatagaaaagcacttgattgaattactactttgtgttttatttattgctactgtagagttactagaaaggaggaagctatttcccctctacccctcctccccactttcctctctgcacctctatcctttcttcccatatccttatttagggttttgagtcaagagcagcttccagtcctggaaaatcaagccctctgttactggggcagagttaatacacactttccaagagactgaatcatctagagggagttaggattacagaggttgatgtctggggatgtaaaagtggtccaagctgaagtagttatagcccgaagaaagatttaagaatctataagctcttaaagtggtttacagccagagtgggggtagttccaccaagggtaatagaattttctgtatacccaaagactcagatctccaatactaaagtttctgcccttggcaaagatctcagcacctgagcttagcagagaatcagcagggcttttgacctccaataactttttgggctagatagtaaccattgtgaagaccagatagccctccccaaaacttttgtctaatacccccagaactgtagtgggatcctactgggcacaaaggagtccaataatgaatgagatttagttatcgattctggcacataacgggtttagatttatatttattttgacttagaaaaatgctgtttgaactcaagaactgtgttgtattataaataacatgtctttcagcctaaagcacagattttcagattttacattctaggaaccatcttgttcctagatatgtgttatacataattacttcttaaccccacattaactataaaataaatggtacatatgtatatattatatatatatatatataaaatacataattacttcttacccccatattactatcaaataaatggtttttttcaattaaggaaatatggcatatacctgggatttttatcaaaataactaccatttctaactcccattcttggaagaatattttgtctaagtataacttttgatgagtttttacatccccttcttaacatatggacagagaacaaatgtgttaacttatttcagaactttctccttaataatttttaacagtttgttaagatataatttacatagtataagttttaccccattaaagtatagaatttgattatcttaagtgtattttcagagttgcacagcaattatcataatctggttttagaacatttcttaactgtggtccaatgtttcaaggtttcttttaagtcacctagtccgataggaatatccacaactagaataaaaaaaagaagcgaagctatttgttttaactttggttttatgcaatggtcatgtagaatgtttctatcacctcaaagaaactgatactccttaataatcattacccattctgctgagcttaacccttgataactactaatttacattctgcttctatacatatgcttattctggacattttatataaataggattatataattatatcttttttgactggtttcttttgtttagcatagtgattttgaggttcgtctatgaaacctgttgaagcatctgtcagtattttgttttattggtgaatagtattcaattgcatggatatgctgcattttcttcatgcattgattagttcatggacatttaggttgttttaatcttttggatattatgaataatactgctatgagtatctgtgtacaggtctttgtgtggatttatgttttcacttctcttgagtgtatacctacaagtggaattgctggatgatgtggtaaccctgtgtttgtttgaggaactgccaaactaatttccatagagacagaaatattttacacttccacgagcaatatccaagggctccaattcctccatttcttgccaacttattgttatctatcctttttattttaggcattctagtgggtgtgaagtggtatctcattgtggctttgcattagatttccctaattgttaatgatgttgagaatcttttcatgtgcctcttagccatttctgtatcttctttggggaaaaagactgtttaaatacttttccccctttctaattgggttatattttaattattgcttgctaaaagttctttatatattctagattcaagtcccttttaagatacatgatttgcaaatgttttctcttactgtgtgtcttcaacaattttttgcaaaagaaatgccttgcttcaaagaaagcctctgaagcctcggtattattttctccacccacaaaatcactgtgataaataaatggggatatcaacatgtctttacctggttgtatttcatttttaagctcttctctttagagttccttccagatccccaattcagttacctttctggggggtcttagttcttcttgacctgtctacagcttctgataccaaagctttttatctctgtcctaccttcttttctgccttccatcatttcttccttctttcctttctttcttttataaaggggtatttgtattaggcacttactaaattttagaagcccagctatgggctggagataaagaaaagaaatatgtggtttctattaagagatttgtgctctagtgagaagaaagactttcataatacactaataaatgtaaattataaatgtgattagtcctatgaaggaaatatattggatattatataagaatgttacaggggaaattgcctcactcaaggaaattaaaagttctttctctgagaaggtgaagacatacttgagatctcaaggataagcggatattacgtaggatgaagagggaagagcatatgaaaatgcttatgatgagaggtaaaaaggaacttttgaggcaggagacaaagccattgtgcttgcagcttagcagacaagaaggggaatggagcaaaatcatgctgggcacgtaggtaaaggcaagagcatactgggctgagagtaatgttaataatgtttgtctgcattttaagaccaatgggaagtatctgaagagctttggccaggtgtggcaaaatgataagacttgaattcctaaaagattgctgtaagtgcagtatgaaaaataaattgcaggtgggcaatggggaatgtgaggagatgcattgggaagctatagcaatagcccaagtgagagatgttgataacttggataagcggaatggcaatggaagtggaaatgtgcaaatgagtttgagagatacttaggaagaaaaattagcaagacttggtgatggattgattacaagagattaagggagaaggaggtatcaagaatgaataataactgcacggttctgctgcttctattttttttgtttgtttggtttttttgtttttgagatggagtctctctctgtcgcctaggctggagtgtagtggtgtgatcccagctcactacaacctctgcctcctgggttcaaatgattctcgtgcctcagcttcctgagtagctgagattacaagagtatgccaccacacctggctaatttttgtatttttagtagagatggggtttcaccatgttggccaggctggtctcaaactcctgacctcaagttatccacccaccttggcctcccaaagtgttgggattacaggtgtgaaccatggttctgcttcttctgacatagtttgatagtggctaccctggtttgaatctaccatcatattaatataatattaggccatatacaacctccctgtccccatttattcatttagaaaatagggatgacaataatacttaattgatatggatgatataatgcacttcaacagtatctggctcatatagtatgagcataataaatgttactcatgaaaaattcaaattattattgctgtttagaaaagaagcaaaggagaaaagtgactaatttctgaaaaattaaatacactagagtcttttggttccaactcagttagagcagtcccagtccttctaggttcttcctcttacaactaaaaatcgcctggacataaccctactccaatcctgtggcaataaaaaactgcttagtagaagcagttggtgctgagattcctctactgaagtaaagtcactggagttcagcagggagctgagccaccacttccatgcagaaacatggagactcaataaggcagtgcaaggcagggctatttggccctcactttctcccaaatccattgttagtgcagcccatcagggaactggagctctacctccacccagcattgacaaggtggtataaggtggggctaacattatacttcgtggtgaaagactgaatgcttttctcctaaatttggcaacaaagcagtgatgtctgcacttaccactcttgggcaacatagcactggaagttttagccaaaacaataaggcagcaaaaagaaataagcttgcagattggaaaagaacaaatcaagctgtatctatttacagaaggcataattttctatgtagaaaatgtcaagaaattataaaaatgttgtagaactaataaatgagttcatcaaagtctcaagttacaagatcaatacagaaaattaattttattcctatatactagtaactgatgtgtagaaactagaattaagcacctactatcatatataattgctccaaagtaaaatgaaatgcctaagaaaatgaaatatctagttaaaagtctaacaaaacatttataggatctgtatgcttaacatttaaaaaaacactaatggaaggaataaaatattatataagtaaatggagaggcatactgtatccatggattagatgactcaatatagtaaagatgtcaattctccataagttgatctgtaaagtttaacataattcctaaaaaaattccaacaagcttaatctgaaatttgggtagaagtgcaaaagaactagaatagctaaaataattttgaattgaataattttgaattgaatattaaggatttttttatagatactgtaatcaattgaatcaattgaattgaatcgactgaatcaattgaattgaattgaattgaattgaatcaattgaatcaattgaattgaattttgaattgaaatttgaattgaataattttgaattgaatattaaggatttctttatagatactatattcaagacagcgtagtattggcaggggaatagacacaaagatcaatagaacagaatagagaccccagaaacagacaaatacaaatataacaaattggttttgacaaagttattaacacaattcaatggagaaacagccttttgaacacatggcactggagtcactgggtgtgcataggcaaaaaaattaatcccaacctaaaccttataccttatcaaaaattaactcaaatgtatcatgggtttaaatgtaaaaatataaaactattggaaaaattaggagaatatctttggaacctaaggttagagaagagttcttggacattacattaaaagcactatatataaactaagaaatgattaattcattgtcatgaaaattaaaacttttgcattgtgaaagactgtgatagaatgaaaatacaaactgcaggctgtgagaaaatattggcaaatcccatatccaataaaggccttatacagggtgagtatcttttatctgaaatttctggaccagaagagtttcagatttcagactttttcagaatttggaatattttcattatccttatctgttgaacatcctaaatccaaaaatttgaaatccgaaatgctccagggagcatactttgacaatcgtgtcagcactcaaaatgttttgaattttggagcaattcagattttcgatttccagatttaaaatgctcaacctatatgtaaatatgaagaattctcaaaacttaacagtaaaaaatcaatccagttataaaatgggcaaaagacatgaacaaatattttattaaagtgtagatacagatggcgagtgaagatatactcaacaccattggcagttagcacaatataaattaaaaacataatgcattatttctatacacccatcagaatagctaaaacaaaaaatagtgacaacatcaggtgtcagttagggtatggagaaacgatcattcagacattgctgatgagaatgtaaaattacagccattctagaaaatcatttggtagttttcttggaaactaaacatgttcttaccagatgaccctgcaatcacactttcggatatttatcctagaaatgtaaaaatgtatgttcacaaaatacttgtacattctttaaatgagaaactatagatatggagaacaggttagtggttgacagtattagggcgggtgggtgggaaaggttgagtgggtgcaaataaaaagagattgtgttggtggttttgtgaattttacatgagataatattgcatagaactatacacatacataatacatacatgcataaatgaatataaattaaaatggtataaactaaattatatttgtagactagttaacagtaacatgctaatgtcaatcttctgattttgatattgtactataggtatataggatgctgatatggtttggctgtgtccccacccaaatctcatcttgaattgtcattcccataatctccacatgtcgtgggagggacccagtgtaaggtaattgaatcatgagggtggttatctctatgctgttctcatgatagtgagtgcattctcatgagatctgatggttttataaagggctatttccccacccttttctctcacttctccttgtggccaccatgtaaagaaggacatgtttgcttcttcttctgccatgattataagtttcctgaggccttctcagccatactgaactgtgagtaaattaaacttctttcctttataaattacctagtcccagctagttctttattagcagtgtgagactgaactaatccagtaaattggtgtagagagtgaggtgctggtataaggatacccaaaaatgtggaagtgactttggaactgggtaacaggcagagattggaacagtttagagggcttagaagaagattggaaactatgggaaagtttggaacttcctagagacttgttgaatgactttgaccaaatgctgatagtgatatagaaaatgaagtccaggttgaggtggtctcagatggaaattaggaactggttggcagctggagtaaaggtgattcttgtaatgcttcagcaaagagactggcagcattttgcctctgccctagagatctttggaactttgaacttgagagagatgatttagggtgatttgtggaaggaatttctaagtagcaaagcattcaagagaaagcagagcatgaaagtttggataatttgcagcctgacaatgtaatagaaaagaaaactgactttctggggagaaattcaagcccactgcagaaatttgcataagtaataaggggctgagtgttaatcaccaaggcaatgggaaaaatgtctccagggcatgtcagagactttcattgcaacccctcctatcacagagccagaggcctaggagggaaaaatggtttcctgggccaggtccagggcctcccctctgtgtacagcctcaggactttgttcctgatgctccaactatggctaaaagaggccagggtacagcttttcccattacttctgagggtgcaagcccctaaatttgacagcttccatgtagtgttaagcctgtaggtgcacagaagtcaagaattgaggtttgggaacctccacctagatttcagaggatatatggaaatgcttggttgtccaggcagaagtctgctgcagaggcagaggcctcatggagaatctctgctagggaagtgcagaagggaaatgtggggttggagcccccacacggagtcctcactggggtactgcttagtggagctatgagaagtgggccaccatccttcagatcccagaatggtagatccactgacagcttgcactgtgtgcctggaaaagttgcagacacccaaaaccagctcatgaaagcagctgggagagggtgctgtaccttgcaaagccacagggctggagctgctcaacaccatggcagcccacctcttgcatcagcatgccctggatgtgagacatggagtcaagggacatcattttggaacttaaaggttttaatgactgccctattggattttggacttgcatggaaactgtggcccctttgttttggccaatttctttcatttggagcacgtatatttgcccaatgcctgtacccccattgtatctaagaaataaataacttgcttttgattttgcaggcttataggcagaagggacttgccttgtctcagatgataccttggactttgggttttgggttagtgctagaatgagttaggactttgggggactgttggcaaggcatgattgtattttgaaatgagaaggcatgagatttgggagaagtcaggagcagaatgatatggtttggctgttttcccacccaaatctcaccctgaattgtagttcccataatgcctatgtgttgtaggagggacccagtgggaagtaatttagtcatgagggtagttacctccatgctgctcttgtgatagtgagtgagttcccacgagatctgatggtttcataaggggctattcccccctccttcaccctgtacttcttacaaccaccatataaagaaggacatgtttgcttccccttctccatgactgtaagtttcctgaggcctcctgagccacgtttaactgtgagtcaataaaactactttactttatcaattatgcagtctgagatatgtctttatcagcagtgtgagaacgagataatacattggggaaaggtaggcaaagggtacattgggggaagctaggggaaaggtacattgtgggaagctgagtgaaaggtacattgggggaagctgggtgaagggtacataggagtcttctttcttcttttgcaacttcctgtgaatctgtaatttttttaagtaaaaaattacctacactgtggccaacattgtagcaattcttttggatgacatagtaaagtggacttttagaaagactgtaggagatggaatgaggagagggtagtttgagtttcagaagtacaacctattattgatatttatgtgcttataggaaaagtgccttacatgcttcaactcctaatttcttcatctataaaatgttactgatagataaaatctgcttgtcatgtcctagtccagtcattgttacaattttttaagatatgtaaaaggttactttgaacaaaataaagccacaagccagcagacccccaaacgtggggcatttgtagccacagtagaaatgtttgtcaggtagtcgtttgggtcctgattggtttactaaggacagcaatgtgtcaattgatcatggctactgacgccagagtcactgttacagggttggatttattagagccttcctgagactttccatggacaggaaatgagaaggaagaagaaaggaactatgtgataatgactgtttaattagtgcttgaatattagttaaagtattgttatgatcattattattataatcagtgaagaaatagcttggtgtgacaatcatcattttttgtcctgataagttggatatttcaaatatactatagccaaacttaggttatacatccatcctaaatgtgtatttttcacctttctaatccatagtcttatttcctggggactataattgattctaagcaaatatttctttggacctgcaaagaggcattctaatttaatttgcttcaaatgcctatctgttcacaaccattctgcctgaactattagctgtaaaagaaagagaaagatttctcgatcaatttttaaatttttttaaaaattgacatgtagtaagtgtacatatttataagatacagaatgacatttaaatacatgaatacaatgagtaatgatcaaatcagagtaattagcttacccatcacctcaaatatttatcatttctttgtgttaggaaaattcaaaattctattttccagtatttaaaaatatgcaataagttaccccaggggtaaccataattaccctacagtgttatagaacactacaacttattctttagctataattttctgtctcctaatcaacctctctgtatcctcctctatctactatcttttccagcttctcataaccacaagtctacactatacttttgtgaactcaaatttttaaagtcccaagtatgagtgagaatacatggtattcatctttctgtgcatgacttattttatgtaacataatgtcttcaaagctcatcgatgttgccactaatggcaggattttattctttttattactttgtagtattccattgtgtatacatgacacattttgaatccattcttgtattgatggacacttaggttgattccgtatgttggctattgtgaataatgctgcagtaaatatgggggtgcaaatatctcttcaatatatagatttttattcctttagataaacacagtagtgagattgctggatcacacagtggttctatttttagtttaagaaacacccatactgtttttgataagggttgtactaatttatattccaccaacattgtatgagttctcttttctctccgtccgcactggcatctgttagtgcctatcttttcgatataggccattttaactggggtgagataatatctcactgtacttttgattttcatttccttgatgattaatgatgttgagcattttaaaaatatctttgttgtccatattgctgcctgcttttaaaaagtgagtgttcagattatttgccaatttttattttgggttatttgcttttgtgctgttaaattatttgagttccttgtatattctggatattaatcccttgtcacatgatagcttgaaaacctattgccccatttcgtaggttgtctctatactctgttgtttctttccctgtgcagaagcactttagtttaatataattccactcacctatttttagttttgttgcctgtacttttgaagtcttaccctaaaatctctgcccatatcaatgtcctaaagcattttccctatgttttcttctagtagttttattaatttaggtctcacatttaaatatttaatctactttgagttgatttttgtatatagtgagaaataggggtctaatttcatttttctgcattatgaatatccagttttcccagcatcatttaaggaagaggttgtcctttctccaatgtaagttgctggcacttttgtcaaaaatcagttggctgttttattagtctgctctcacattgctattaagaactacctgagactggtaatttataaagaaaagaggtttcattgactctcagttctgcaggctgtacaggaagcatggcttcagaaaccttaggaaacttatggtcatagtggaaggtgaagagatggaggcacaacttgcaagacaggaacaggaggaagagagcaaagaggaggtgctacacacttttaaacaaccagatgtcatgagaactcactatcatgagaacagcaattgggaaatctgtccccatgattgagtcacctcccaccaggttctgcctccaacactgaggtttacaattcgacatgaggtttgggcagggacacaaatccaagccatatcagctgtaaatacatgaatttattattgggttctctattatgttcaatcggcctgggtatctgtttttatgccagtatcatgctgttttggttaccatagctttgtagtatattttgaagtcaggtagtgtgatgtcttcagctttatcatttttgctcagttctgctttttggctatttgggatcttttatggttcctcaagttttaggctttttttctatttctgtgaagaatttcattgatattgatatcaacatgtcattaatagctattgcattgaatctgtagatcactttgaagagtatggtttgtttaacaatattaattctttcaattcatgaacatggaatagttttacatttttgtgtgtcctctttagtttcttttatcaatgttttgtagtctttattatagagatctctcacctccttggttaaatttattcctaggtgttttttttgtagctattgtaaatgcatttgcattcttgatttctttttcagctagtttgttgctgatgtatagaaatgtacccatttttatgtgttaattttgtatcctgcaactttactgaatttgtttattagttctgagatttctttttggtggagcttttgggtttttcaatatataatattatatcgtctgcaaagagggcaatttgacttccttttttcctatgtggattccctttatttatttcccttgtctaattgctctggccagaactttgagtactatgttgactagcagtgctaaaagttgttatctttgtcttgttctagttcttagggaaaatatattttggctttttctgattcagtatgatgtcagctatgggcttgcctatatggtctttattgtgtctgggtatgctgattctatgcctaattcattgagagtttttatcatgaagtgatgttgaattttaccaaatgctttctctgcatctattgagatgataatatggtttttgtccattctgttgattggacaatgttgtgatttatgtctcacatttattgatttgagtatgttgaagcatccttgcatctccaaggtaattactacttgatcatggtgtataatctttgtgttgtactgttgtattcagtttgctagtatttggtcgaggatttttgcatctgtattaatcagggatattggcctttaatttgctttctttgtaatgtttttgtctgattttagtatcagggtaatactggacttgtacaataagttaggaagaattaccacctcttcagtttttgtaataatttagaagaattggtagttaattattttctaaaagtttgatagaattcatcagtgaaggcatccattcccagggttttctttgctgggagatttttttgttactgtttcaatctctttacttgttattggtctgtccagttttcctatttctttctgctttaaaattgataggttacctgtgtccagaaattcatctatttgctctaggttttccagtttgttggcatatagctatcataatagtgtctaatgatttttttgttgttgttcaggcaaggtctcactctgttgcccagggtggagtgaagtggcatgatcagggctcactgcagccttgacctcccaggctcaagaaatcctcccacctcagcctcccgagtagttggaactgctggtgtgggccaccatacctggataatttttgtagtttttatagaggtggtatttcaccatgtttctcaggctggtctctaactcctgggctcaagcaatctgcctgcctcagaactcccaaagtgctgggattacagacatcaaccactgtatccggcctagttgaatgattctttatatttctgtagtattagttgtaatgtctctcattttcagtttcttgattttatttacctaggtcttttcttatttttccttagtctagcgaaaggtttgttgattttgtttatcttttcaaaaaacaagctttttgtttctttgatcttttgtattttgtttgtttgttttgtttttgtttgttttttgagagagtcttgctctgtcgccgaggctggatggcagtggtgcgatcttggctcactgcaagctctgcctcccaggttcacaccattctcctgcctcagcctcccgagtagctgggactacaggcacctgccaccacacctggctaattttttgtatttttttgtattttttttttttagtagagacggggtttcaccatgttagccaggatggtctcgatctcctgacctcatgatctgcctgcctcggcctcccaaagtgctgggattacaggcgtgagccaccacacctggctgatcttttgtattgtttaagtctccattcagtttagttctgctctgatctttattatttctttccttctactaattttgggtttggttggctcttgcttttgaaatcacttgaggtgcatcattagattgcttatttgaaatctttctattatttttatgtcagcttttattgctataaacttgccttttaatactggttttactttgccccagaggttttggtatattgtgtttctgttttcctttgtttcaagaatttttatgatttccatcttaatttcttcattgacccagtggtcattcaggaaccactgggttcctgaaacttgtttatattccatgtttttatataattttcaaagttcctcttggtattgatttctagttttgttccattgtggtctgtgaagaaacttgatatgattttaatttttggaaatttgtttagactcttgtgatctaacatatgttctatcctagagaatgttctatgtgctgatgagaagaatgtatgctttgtcgttggatatattgttctggaaatgtcttttatgtctatttggcctaaagtccagttcaaatccaatctttttttgttgatgttctgtctagatgatctatctaatgctgagagtgggttgttcaagccccctatcattattgtattggaatctcttctctctctctctctctttctctttctctcttcagatgtagtaacatttgctttatgaatttgggtcctccagtgctggatgcatgtgtatttacaattgttatatatacttgctgaattgattcccttatcattatataatgagattctttgtctttcttttttcttttttttacttaatatctatttcttctgatataaacatagctacttctgctcacttttgatatctatttgtgtggaatatattttttatccctttacttttagatggtgtgtgtttttacaggcaatattagtttcttatgaacttcaggtagttgggtcttacaaaaaatccattcagcccgtccatatattttaactgggaaatcaaaaccattaatatttgaggtttatattgatagatgagtacttactcctcttattttgttaattgttttctggttgttttttataccctttgctcctttcttcttctcttattgtttatttttgtggtttggtggttttctgtaatagtaatgtgtgatcccattctctttgtatttgtttatctgctctaccagtgagttatacatgagtactactttcatgaaagtatatgactcaaaaaatatatattgccctacacttcctgatgtaggactttgttaagcttttctcgtagatcaggtctactggtgatgaatttcttcagtttttgcttgtctgagatagactttgtttctccatcatttctgaaggttagtttttctgtgtataggtttctttggtggcatttgttttttctttcatcactttaaatgtatcataccattctttcctggcctgcaggtttctgctggaaaatctgctgttagtctgatggcatatccttatatgtgatttgatgttttcctctcagtttttagcattccgtctttatctttgccttttgaaagtttgactataatgtgccttggcaaggaccttcttgggttacatttatttgggggcttttagctttctaaatctggatggtcatatctctcctaagtattgggaagtttttagctaatatttttattttattattattattttttgaggcaaggtctctgtctatcgcccaagctggagtgcagtggcatgaacatggttccctgcaaccttgacctcctgggctcaagtgatcctcctgtgaagttatgaccacagttgtatgccaccatacccagattttttttttttttggtagatatggcacatcaccatcttcctcactctggtctcaaactccaagctatcctcctgtctcagcctcccaaagtgctgggattataggtatgtgccaccatgcccagcctatggctattttttaaaaataggttttctatgccatttcccatcttttcttcttagaacttccaaaattcacatatttgtttacttaatggtggcccatatgtccttttaggcttaatttattcttttaaaatgtcttcttatttttgtctgactgagtttcttcaaaagagctgtcttcaagtttagaaattattctgcttgaactagcctattattgacattctcaattaaagttttatttcattcattgaattgttctctttcaagatttcttttgaagcaaggttttattttgcaatatctatctctttgttgaatttctcattcagatcaggcactgtttttctgattttgttgaaatgtctgtgttctcttgtttcttgctgaatctccttaagatcattattttgaattcattttcagtcatttcatagacttcatttgcttttgtgtgttggctccctctgtcctggggtaagcctctttgctgtgctgaattgcctgtcccatgggatatagggtgctacacaggctcagatgctatggtaatggtatcatttctgtgtccatctcatgtcacgatgctgcaaccttctgggtgtatgtggtgggatggcagcaggaccccaggaatatggacatgcagggactactggatcctatgaatggatacattctggtggcagctctgctcttaaaatggtattgtgcttcagcatcctggatccaggggagtgcaaaggactcagtgtgttttccctctcaggaaatatgaagttgcttggactccaaatgctccctatgctgggatcagggcctgtaagggctgtgaggctcttctgtacctagaattgttggtgtccatggtgagaatatggctgctggcaatctcccactttcttttttcccacaatgggagttcctcttggcttgaaacaaattgataccgggtgctttgcttttctctctgtaatgcctttttaagtttctgtaccctaaaaggtcttcataacttctctactgaatcccagtattcttccttaaatactctgtttgatttgtggttatctactggttgttgtggtcctttgtcagggaggtgagtgctggacacctctatttaatcatcttgataacatctgtctcaattcagttgtaaccaccatcctatgattaagtctgcccacaagtaattgtcgcagcaatattagtagaattagtagtagtagtagtaatagtagcagcagcagcaatgacaatcaaatacctaacacttgtggagcacttaccagctgtaacatgctgtcataaattttctacctatattaattaatttaattctcaaaacaatcccaagtgataggttctatcattgtccacattttacaatgaggaatctaagacagagaggttgggtaacttacttaagtagacataccttgcaattggcaaaccaggatcttctaaactaggccggtgactttggagttcatactcttaacctctatgccagtccgtctttcgcaatcacttgtcatatcttttgcagcatccttggcaactggaaaggaatgtgatatttatagaagaaaatggtattttctttggctgtctctattaaacacagttttgaaggtgctggtcattttgaaaacttgggcatgactaaagaaaatgaaatgtggaagttctatggcctttgttctttgggaataggtcatctattctcagtaagtatgtaggagatcccagtaggaattgggggcaaaaatacaggaagacagttcgttgttggcattatgatatcatttccacatttcatggtttagtttcagccacatccaaattaacttgcaactgctcagtagtgacatgtttgttcatctaatgtctacattcacaatctgagtttctctacttaccagttctatgatcttaggaaagttatataaagtactgttgtctaagtttcttcattgtaaaatgagcaaacttacttcatttaattgctgggagaattaaatggtataatatgcctaaaatattgacttcagtgcttggcattctctaggttcaataacattatggaagatattaatagataaagtgaaggttgtggaaaatatgctacaattcctctcctcaaagtcaattatggcattaatgacaaaatttgcaaatatcatcacaatatattatgatatcattgcctccaaagaggtaaagatattaaattttataaaagttctaagatagatgaaattcatggtctagagaaaaagtgtgtaagccttcatgaacatggtaagagtatgggtttgaagtggtgtctgaagccaggcaaaggcagataaaccaactacattgtgagagagtattgtgggtcaacgaaacaacatgaaaaactagagaggtagaaacaaactcgtacatttgtaggacagcaaagatgccacctcattagagaaaaagatttacttcaagaatattggaagataagacctggtagggaaggatagaccaggcttttggaatgctgcacagaaccatacctttctccatacttaagtctgcgtgagcaactctaattgagaaaccttgatcatttgtgaaagattatttaaaatattaccttttgcaagaggacttttctcttctctccattagaaggaatttcttccctccaatgaactctcagtctagcttatctttattcctcttatctagcatgaccacacatgctagtttgcctgggtcattctgagttatgcttgttatcccagtgtaattattagtagagcaccctttcattctaaaatatgttccttttgtatgataaaataaaaggtcaactacttataactcttatcacttatcttctgtgttccggttagttacccctattaaaacgttcaggctagcaaagaccattatctactcatctttgtattcccagtacagaacataataattatttattaaatgaatttaaagaaggaggctgaaaactcttggagtataagtctgaatccttagacttttttatgtttctaaccttgtctgctattgcacctgcaaatactaggtacttgataggtttgtaaattcgagtggacatgcacaagggtatactgtttctggagtgtgccggagatgacttaagcacagacttgaagtgtgtcctcagaaatcttatcttcttttctcaccgtttgctaacctgtgcacatttcttgctgacagtttgggttggtcttaaggcctaaataaaaattttatttggaaaattcaactattaaatcaacaatcagatgcatgtgtgtgccctacctctgttgtgtgtgtgtgatgaaaacagtcctattttgtaggatttaacctttctcattactgggtccccattaggaaatttaaaataaaaataaatgaagattgatggtttttcaaatgattggtacattggttgaataattcacttaacaaactatattgaattttttgttttgttccaattagtgttatttccttgaggtttctaactggaatttctattcttgttttataactatttatgatttgaatggccctactggatttttcttcttaaaatttgtgagaagttatgctagcagatgttaaaaaggaataaaggatataaactttgccatattgtttagttatagaggagtcatttgggtaactccgttaacttgctgagtgtgagaggaaattatagttatctatgaaaccttagtttctaacttggaatcttttcatctgttttctagggttagatcggtttccctccatgtcctgtgggtcaaggatgccacagctatctgaatatatataacccatatcactacatggcaggcagatacgcagaggttagattctgaaccctatgaaagtgggctatatggaaaattaaactgctgaaggcccttaaacagaggcctcagagtaaatccttttcctactctcagcacaatcctgtgctcgccagccttccctgtgaccagtggtactccttcaaaaatttttttgggaaattctcctttgctaggctatattcaccagcctttctctgcagttttatcctctttgttctaaagaagccatgcaatctctcatataggtttgtttcttttcccctctcccctcccctcccctctccttccctcccctcccacccctccttccctcccctccctcccctcccctgccctcccctcctttcctctcctcttttttgtaacctgaggggaaggtttccaattgtggatgtttttcagcattgtggacattttaggctggctagttctttgttgttttgagctcttctgcacattgtacaatgcttagcagcattcctggcctttattccctagatttcagtatcacttcctgttcccaatcatggcaaccaaaaacaccctctgacatatcaaatgtttgcaggatgaggcagtgcaaaattccccctactaagaaccattaccttggaatctctgtgaaaacctttttagaaggtggaagaaacaacggccttagtgcagcacttaccaattgtgtgacggacaggagttgtttgacttctctgatactgtttctttacctgcaaagtagggataataacatctttctttcagagtttagatttcaacaggaacttttaggcgcatagtaaggtactgacaagtggtagtcactgtcattcttatttggtgaattccagctacatttcccaataccagtaattccaacttaagaaaaagtatttctctttttctctcaccctggaaacagaacacgatgaatgtggcagcggccagcacaactgtgatgagaatgccatctgcaccaacactgtccagggacacagctgcacctgcaaaccgggctacgtggggaacgggaccatctgcagaggtaggcttgccgccttagtgttgagttgtgagcagccattctgcctgggctcttggcacttgtgcgtcggaccttcttggtaactcttggtggaacacagccagggttcctgctcctggtttatcaactggcaagggtactgtgcgtcagggaaaaagaaaaatgcttcaggtttagctttggagttgaaagaaaaaggtataggtatgggtcagggacacagttacataacttgatggctctgttcagctttgcctgttggcatgagtttgtgagggaagcttggattgcggatattggcttttctttcctgtgagattttccccaagggcaagtggacactgtttctgtccacacttgaggtatctgcttgggtaggaaacttacagttttagccttgctcagcgtctgggagcagtttatcaattcagaggccagcgccctggcttcccttagcatttagaataaaaataaaattcctccttctggcttatgagggcattcagcatctggtccctggctcctcacagctgacacctctctttcctctcaccctgaatccctttacctcagcctactgggtccctgttattccttcagcattgttgttgcctcagccacaatgctcatttctttcatgtctctactcaaatgtctcctcatcacagaaatgttctttgaccaccctatctaaaatagtacgcttagtacttcttagcccacaccaggcttgatttttttcttcacaaacaacctgacagaacatcacaggtttatgtgtttgcttatctctgtgttatctgcctccccactaggatgtaagctccatgacagtgaacacttggtcttgtccccccactgtccctggtgtttagatattatctgcctccccactagaatgtaagctccatgacagtgaacacttgatcttctccccccattgtccctggcatttagagtgtgacttgcacacggtaggtgcttgttcactatgtgttaattcaccaaatcaccaaagaggaaaggcacaatcataacgaaaaaataggcaacatgaacaagaaaacaaaagacatcctatgaggtaggtattattatccttattttagaagtgataagattgagacacagagaggttaaataacttgcccaaagatacatagtaaacacattgtcagtattcctctgcagggatgaaatgctggtaatgagtgaaaaataatttacaacgactaagtcactatatttatggattggattggggaagaattttaaaagatcaattttattctgtgttggttaaggtgaggtaagcagaaagcctaatacatgactatgagtgtaaattggtaaaactcatttttttttaacagcaatttgacaaaatttatcaacattcaaagtacgtattctactgattccatcaattttacctcttgaaatttattctaaaaaagcacaggttcatgaagagggggaaatgtgcatagaattttttttgcagcactgtttatattcactgaaaactggaaacaaccaaaatatccatcagtcttggaatgattaaatttatcttggcatatgaattttatagagcagaatgctatggtttaaaactctaaacatttgtatgtacacgcacgcacacacaaacacatacatacatgtacacatcacattgaaagataccctacatatttttgagaaaaaataaaataaattcaagttcagaacaatatagtatcatcaaatatctaagttaatatttataaatatctatatacatatttatgtaaatacataaagactggaaacatgcaaactagtcaccttattgcccatgtgtgtgtgaaaaaagaaaattcacttattgctatgaactccatgttatttgcacttcttccagtggtcttttatatgtgaatatttgtgcgtattttttctaaagtaccctgaagcaaataaactagtgctcagcttttttaaaaggctaaggaaatttccaaagcaaaacaaggaaacaaaaacgttaatgtaattccagggattatcaagcccactgctggtacctgcatgctagtgctataaatctgaggagcaacatagggattttaatgcactttttttcagaattatgttacctcataaaataatattaattgcccttgtccagtgagtttgtatttgccgagtcctctcttgccattgtgataagtggtggtttcaccttcgtagaattttgtaagtccagctgtgaaaaaatatgagtttaaataatgttcctgatgtccgcagactgtgaggggaaacatatcttcccttgaaagttatgaattagggaaaataattttcttaaagtgattgtcataatcaattgtgttgacctcagtaaggaaaagtcttgtgttttataaatgctgcatgggaaagcaatgtggtatagttgaacaattggataaagagcttgtactcttcacaccttctttcactactggttctttacactggctttcattactggtgaattgtaacttctatatttttacatattaaaatttggttaaggccaggcgcagtggatcacacctgatcccagcactttgggaggctgcggcgggtggatcacctgagggtcaggagttctagaccagcctggccaacatgacaaaactccatctctactaaaaaaaaataaaaaaaaaaaaatatatatatatatatataaattagctgggcgtggtggtgtccacctgtaatcccagctactcgggaggctgaggcaggcgaattgctcgaacctgggaggcagaggttgcagtgagccgagatcatgctactgcactccagcctgggggacagagcaacactccatctcaaaaaaaaaaaaaaaaattgattagtattactttccctatttatctaacagtattattgcatagaatcactaacggaatttatatttggtgttttaaactgtaaaatgctatacaaactaaagactagtattagccttataataaagaagaagaaagaggaggaggaggttggcagtttatggccttctgcctgaaataaccaaatttgtgtctcaatttcagggcatatattttatagttaactttgccaccttgtaactgaaacatttacagtgggagttggacaagaataaccagacaacttgaactaagtcttttttattttcactttttatttttttgagacagggtcttgctctgtcacccagactggagtgcagtggcttgatctcagctcattgtaacctctgcctcccggcttcaagcgattatcctgcctcagctactgagaagctggggttgcagatgtgccccaccatgcccagctaatttttgtatttttaatagagatggggtttcaccacgttggccaggctggtttccaactcctgacctcaagtgatttgcctgcttcagcctcccaaacggctgggattccaggcatgaggcactgctctcagcagaactaagtctttttaagtgttaaatatagaaaagcttttctaggcagacatggtattgttcatagacttgactaaatctggttagaagtaaatagttaacatgcctttttataagcattacataagacatcagtttctgaaacaatactaattggtgtgaattctctcagatgggtttccgtggtggtcgatgcccatgtaaggcgtcttttcttcttttggatggaaaatacttgttcagctacaaaaactctcattaagtatgtgcaagacaccttgatgtgtgtattcatatatatgttatctcatttagttcccaccataatcttgagaagttgatgccattattctatttcacaagtaaattttaagtaagacgtagttgaatctgatttaactcaactagtggaactgcttttagttttttccctccctttcctccttttctttgtcctcctccttttccttctctttttatttcctcctcctctcttggctgtttatcatttaactctctccctcacacattgtattctaactagaaactaaagagaaaatagaaagggaagagagcatacaatgataacctagaatttttttaaaaattgctcacatatttaataaatagactaaagtcattctgaaactatacaatatgttttgcttaatagtttggcatttgagtttaaatggacaaaatgcttgcaaacagtttcaagtcagatttgcattacctgacatgaaggttaggcttatcagcagcagagtgtttatctgctttcccagtcctgcattaatgccaaaacagaaagtgagctttcactaggcagttgtcaatatgcagctgatagactatgtcttctctcttatctgtcattagctctggataggatgtggtgatctttgaaagcattcttgtcttaatgactgataatattaacatttatttataaaacatacagtgagtgtgaattctgtgtctgggcaccaaaagagcaaaaataaataagacaagtccccagggatttcaccatttagtgttggggaaagattttaacaaattcttccaacccaacggaacatttacaaaatggtattatctcgcgtgaaagaggcttgaaaagaattacccaaaatacagagctatgtgtaaagcatatgcattagttaggattcctttggttgcaagtaatagaaatccactggcaaactggctatgtaacttgcagaacccagagaaaaatgcaagcatgggctcctagttcgaaaagcaggaaaaacttgcaaattaaagatactgaaatacaaagctttgaaattttcccatgatctctctcttctcctgtcgtggagttttgtagttgctatttaatgttgcttctttaggcttggggatatttttggggtgaatgttaaccctgtaggagcttcaggcccatcttgccacttggtatattcatgtggcccaccaactttggggtttctcactccctgaccagtgcaccatgattgggcgtgggacagggaagttgaatcaagtatctccccttctctcaagatatcttcaaaccaactttaacgttgactgcctttcaaagaaaatcactacagtaaaattcaggtcactgtagaaactccaggaacataggtgaaatctttattttaaggctctccagaatcctgtagtgctctgaaaccattcattatgagtatgtttgcattgagtgcatgtgcagacaagctgcttcctggaagtttctgtttgatgagttgctggataaactgtgtacaaggaaaacacagaaagccagaagcagaaggccagaggtttgatatagacagaaagagtaatgtgacagatcatgctaaagatgtaaacaatcctgaattaaataagtcaaatagacatctcacatgtacaaagttgtttttcagaggctcacaggcaatatgagagaaagggagagggagagggagaatagaaaggtaagttattatagtaaggtatcaccaaggataataaactttataaactactgggctgtgaatcggagaagatgaaatttggggagtttgaagaagcaagtggaataggaagcctttggcaaaagtacttacagcactctagacatagttttgaaacatggttaatgtaatgaggaagaattcaggaaggtgccaatctaaaagtctgcccttaggtgcctttatttagacaaaatattggaaagaatgatgaggggcaagactgtctgatatcaggggatggtttggctcaattagggccaggtccatctgtaaaaacacattcatattgaaaaacgggaggattgtaagcatatttctaagagtgctcctctggttatagagcaatttcataacagtttaagaaaggatttgagactgtaccccacataggattgatttataaagtcagaaaacaggtagattagaggtggcttagggtcggactcaatcaatcagaagaatctttgcagcaagtgtggactatgctcattataattagagccagttaaaatttcccacctatagagactgatggagcggggaggtatatctttggtagtgtttaagcttctcttaagggtcatattgaaataactggaccaggtgatgttactatataagaaatttgactttcgaatttctttagaactattagatgatttgaccataaatcataagcgtaaagacaagattgatgtgaacatggatgacaaaaatcccttttaattaagtttaaggagttatcacaaagtgctcttaacacagggatacaaatttttaacatacaatggtaagaattagtttgtcaagagtatgcagagccttaatgtcatgcttaaatggacatagactgaaggagtgggctacagaataatggaaaaacatacaattttttttctcttaatctattttcttttgaatgaagtctaaacttattagcaaggcactcaaggccctgtgacatgtagtcccatatgaatagtttgaacctcatctcttatgatatcatctttccccattaccttgccagtcacacctgagagttaactaatcattctcccaacagaccaggccagatggatgatttcatgggccctttccctctccttgggatcatttattatactggagtgcttaattctatcctctcttcttccaactgaaatcctattcatccctcacagtccagctcaaatcccatttttccttgatcttctgagtcagaataaattgtttgtcctctgaattttgcttgtagtattcaatgtattatgtcttgttaaacttagctgtttatatttcagcctttaccacacaaaaccttgtgcataatggatgctcagtaaatacatagatgcaaaatgagaattgaccagttgatttaatgcaaatcaacctgctcttgtagcttggtgtattaattactgcagaatctacaccattattctgaaaaatcaaagacaaattaaaattgtgaagcaaatttttatgtattacatattttaatgttttggaaaatcatcagtggacctgctatttaagttcaaagacattgtctgttgcatacagaaaatttattctattttatgtttaatgcctatagatgctgaaagtcctatagacactaaatatagttataccagaaatgataaaatcctttggcctaatttgagaggcaataattaggctaagtctagcttcctttttgcataatgtctgtttgaaaatcttctttattgaccctttttagactcattcagttattctgcaattataatatgagctaggtttagagctgggaggcactgaacatgctggacggtcaagacaacatgggggacatgacaagttactaaacacacgttaagaaataaaagaaggcctgccagccacctggaagaaacatacttttgcctatagtttgccatttgaagaaaggctaatgtaaacaaagttttactacatgacttagggactgcagattggccatttcacatccttcaaatctgtaaaacatctacaggctgatctttactgatatattggccaaatattttattatagctttttaccccttttcctgagatctgttatgatacagccttcagctattaatgtatttcttgtccatgggaacctggaattagttcccaggagggcaaggcacaggactatggctgagccaccccactcattctccagaacattcaaattgggcaactacctgtaccttgagactgtaggatctgcaataatgttatcaaggtagaaagaaacaacatacattttctgtaattcttcttgttacttagttctgtatagtaccccgggcatttaattttctgattaagtctctttgggatgatcaacattccaagatattcaaggctctttacaaaaggactctaaaacatggttctagatttattttcaagtatcccttttccacaaaactgaatgagtctttctttcttacatgtgcctcttctctttagttttataattcgatctttttttctcttgttagaatgcccacgtgtaatatcattaaatattttttacttgccggaatgaatttataaatcaaggcagtcatcatagaagttattgaacaaatattgattgtgtacttatgatgggccaggcactatgctaggctctggttatctaactggaaaaagacaaaggtagtccaatgatcagactatagtctgaatggaactaaacctctctgaagcatttaaaatcatcaatctttcctttgttctgtaaacattttatttcagagatccttatattctcctgggtttccttctgtctcaggtacctcctctgattatttgatggattcttctttatagtcagtaaatgctgtactggctcaacattttctctctctttttctttgcctaggtaattgtgtccaaatataacagctttaaataccatctatatgctaatgactactaaatttatatcttcagtcccaacctcttccctgatttctccagagttatgtaatcaatcacgtacttgaaatgtccacttggatcccttacaggtatctcaaacctagcacaaccaaacaggatccttgattccttcttcacatagtagacttctcatttctacttcttgcccatcttaaacaatgggattaccattgaccaggttgctcagataaaacaatcttaagtattttctttgatttctctctctcagatttgtcatcaacacatcaacaagtctatcatgtttcccttcagaatatcacaaatacaactatttcttttcatttccataactttgctttagtttaacccatgatcatctctccatggaatattgccctaaaaaaaagtagatgtagaattttggaggctgtggatttgatggtgcaaagatgagatattataatatgataacttctattttctcaataaaatattaaatgcagtcatatattgaagaatgatgttaggactgatgctgaaatcactgagaaggatgaccagagaagagacactttaataaatgagaggtcgtagtggagaggcacaggttgggggatgtggcaaaatgagcttcaaaggagaaaggggctttgctggaggaaagggaagtagtcttgaaatgaaaatgggaaacaaaaagtattcaccctctttttctgaggttcaaagaattataaagaaaaatatggcctctgctgagtgggtggcagaagacccaattcttaactaagatggaaaactgaagaggctgttgtaagagttgttgctgatagagaattctattataaccattaggtgcatgggctttggaggaagacacattgggttcaaattttgatatttctgtttactagctatgtgacttcagcaagtgactaaattgttgaaaaattcaattttcttcacctgtgaaaggtgattgtaaaagaacatacctcaacacataagcttatttctctaaaccttagtttctttatctttaaaggagaaccataagggtagttacttcacgtgactgtaaaaattaaatgagataatacacttatgatacttaggttagtgtttggaacacagtagttgctcagtagacattagcaattgtcaatattattattagcacgatgaaaaatccactgaaatttttctccttaccatcttccctgatatcattacatctctcttagaacctatggtgtttcttgctctgtggtacttcataaacattatgtatataatacacacctatttatgcatatgatagtcattttgtgtccttatttaatgcactcattgcctttttaacatatgttgtatacattactatatttcccatcatacctataacagggatggatcgtctcactatttgttggaaaaaataaaaatcaataattcaaactttatgatccaagatactgccatatacatctacccacccaagtgtggcatgtgctcttgagtagacattgtcttttcatatgtgtgctggcctagttgtgaccagtgggaaacattcgtgagactcagatcagtattctaatatgtagcctgaagcagcatggaatacatttctctgtaggccatttaagttttagccataaataaactcaggatcactttgttccagaaaaatggaatagtaccctaccactgcttgttggaggtatgaggtatcattacttttttctccacttctacacatttgactcagtaggggatagatatgggacagtgtgggaatcacagtcccacatctatctttgttctcttgaatcaagtgaaccaagatagatggttcttggctctctgggaccatcagaccccactgcagggctggcatcttctcacttctcagttgtaggagaaggtggaacaggtgatgcagagacctattgagatatttgctctgctgataatgtagaaatgggaagttttggggatcacatatgagtgtgggaggtccaagaaaaggaatggcttgtgccttgctggagccatggtctctggcaaacatgaaccaatcttcatcatgcttgccacatagacattcctcctcataagggcaaaagctattacttgggtacaaaagcaaagaaattcagagcaatcattcctctaccattccctcctgaagtctggagaagataaatgataaggactttctcccatcctcactattccacccccagaaatgctacgtattttagatgaactgttcatattgtttgtaaaagtagattggcagtactgttaacatgattattaactgcagtgttaggcaatgttaaaataacttcaaattgttttgcaaaatctctgtcataaaaatgcttaccaacaaatactgatactaaatttagatgtgggggtattagttataatcctgaagtgggagggggaacttcttaattccaatttagttctaagagaaggaagagtatttaggcccagagaaggttacgcttaaaggtctgatagtgttttctttgaaaaatatgtctcaaactagagaataaaactaattatctcatctaagttacctagagacatttatgctcatcagtttgataaaggactgcaagtagacacagaagctgtattttcagtcttgaacccagcaatagtacattaacaagattggggcaaggcaaagggacttttgtggcacaagatacaatatatggattgcgttcttttggcttaacaaggtgcaccttgacgtagtcttgtcctagcctttaatattcctttccttcaagtgcctttctagtggggggggggaggggggagtctattggatgcgcttaaaacactttccatcactttccaaagtcagcgcttaccttttaaagtttgcagcccagtagacagtaactacatccctagaggcttaagggaaacatgttaaatcagatcagcttgtatctcagagggagtggaaatctgacacttagacaagtgctgattcttttgagtgcatttccaggttgcactttgctgagttacatagatgtttgttaaccataattgtcacatctgaaatgacccataagattagcaaagccgtatacatatatcagtcagttttattttaaaacaggctaccaaacattgactttctctcaagcaatcagaataagattgttttcctttccttagtaacaattctcaatggaccaggagactttaggaaacattactgaaatatttcattgtcaatatgtaggctatctactggattatgatctgttttgggtagcagttatttgcaaaatattcacagtattcaacagctggtactattatagaatggcagccagctctagttgatatgtccacatcagctcaggttatgggcagagtatttgccttaaatagagccaaagaactgtctcacctggttgggtgccatattgtaaggcaaggttagcttaaatagatctgttaccttttaatggctgttatgttatgtaaactagcttaggcttacgccaagtactgttactgggtctgcttggtccagatgcttcaagaggcttctcttgactcaggtcttttttaaggcaacaaaggataaatttaaaaatatttacaaataatgtacaagtgtcagcataatttgggggtagtgctaactgtagtctttctgccatcagatattggtggaatgtttaactaggactgaccagtagaatgtgtgtggttctcacttgcctgttttcacatttctacttatttctaccccaaacagaattatgtgtttgtttttttcatttcagccctatgcatgccactctgtttgctttctgcaataaagttagatatgcttatagtagagttcattcagctgtgtttcatctttaaaacacagccatcttctggttcgactgaattcgatgtctgtttctatttttttttttttttttgcctaattgtgtcatttacagctagacgtttacttccaaggacatgtgtgttacaccttgtcctgtgagaataaaccagtcaaatgacctattgtttcacatttccttgtctgtgaatagatatgatggcattttcaaatttttttctcactctcagctcctaagtgagaaaatgtttacggtaaaatgatgaacacatgagaaactgcttgttaaagataagtaaatgatggtagatgctgtaacagataaactccaaaacttcagtgggtccaacacaatattatttatttctcattaacagctaatggtgagagtggttgtgtgtcacagtgattcaggaatacagtcactttctatcttgtgtctctaacctcttggttttcagaatccttaccactccgtcagaagatgggaaaagaataaaaggtcaaacacgagaggtttttagggaccattatgaaagcagcacctatcacttttgtcttgcattgaattggccagaactcagtccatggccacaccgaacaataaaacagaagctatgtgtgcccaggaagcaggggagaacacagatattgtttggttccagcagcctctgctacactgctgttgtaaataaaatgctacatgaataaaattagctgcattattgtttgtagaaaataaacctcatgtatttctgaaatggattctgcctgatacactgtaaagatctcttgtaggcctacacgtaaaaattactgtgaatatccagagtttaaataactctctgtttgagtaaactcatcccttccaaccgtgtcatcaccacttttctctggcttcaatcaaattaaagacagttgctttttatctaagcctctgatgctgccagttttaaggaaaattgagaaactgctttatgggtcacttgaagtagtacaaggaactcaatcattaaatatcttttgagtgaaacttctagtgacataatagaataacactccacctgagctctggacctttcataatcctattacttacataactgattcccacttgtccatatgacagttcccttcctgttgttagtgatcatttttcccccaacttgggaatttgtcctttttaaacttgcaacagagaatgatatgtgaattccctcaggctgtgtttttctatcaccctactcatttgaggatgatgccatttttaatgtggtatattctgaaagatactaggcagggatatggcaaaaaatcaagtattcatatctattaacagtttataatttattttagatttttattaggaataatgaacgaatctaaggtatacttcttgtaggtagaatattaaaattccataaaatgaatactttgcttaaataagtgcatgtgtagatgaggaatttttcatatctttctgaagcataggccgtttttgcacatgtaactagatgaggtagaaaatgattttgactcagcctcctagactgcttaaagctaggaaacaatctttggggtctagtgggcaaactctgttttacagataagaaaactgagtcttggtatcttcacttaagttacctctttgaagactgtatttgtagaaggaaagcaaattgtaatgaatttcttggaagaggactcgctgtatctttaccaaaacaaagcaaaatgcgcacatgcacataacacgtgaatgctatgagattagtagaagacgtaaaggctctagaacagtactgttcaactgaaagataatgtgaaccacatatgtgatttaaaattttttagaagctgccataagaaagatactagacacaggttagacacatctcagttcagactagcgacatttcaagtgctcagcagccacctgtggttagtggctaccatagccattgtaaaactttcagtgtaggtttaaattaattaaaaaaaaaggcacactctttaatctgcacccttaagcacacaaaggggtgatctctggagaggcagcagggcacccttaaaatgaaatggtactttccattattttttttgttatgttgagcagcccaagtctggcttttggtgggatgcaacattgtagcatttattaagcagacaggtagctggaatccatataccagaggttgagaatacctcattccttctacagcataacatttcctgtctctggatggaacttcaccataaagtcagatattgaatagaaatgagtaacattcattaaacttcaaattttactaagataagagagtaggagaaaaaagaacacaacaaatctatagcatttactttcgttgcattttaagatcaatttcatattaaaaacagttcatgagagagcagacataatgattttcataatgatctgctcactgtgctgatgcttattaactttaaatagtgacatgctctgcaggctctcttacagccattagacagagaagagcccatgcattcttgaggatagggaaacatggcaatttgtggataattttctgacatgcttaagcacagcacttagtgggatcatacttgaatgctgaatgtacagagaataaaatctcaatgtagaccaagataatttagaatttggaataattttatagaaattgaattagcagtacacatccccaaacattataaatttaaggacttttgaatatgacactcttggactcaaatcccaactctggcacatgtctgatctggggcaaagtctcctcacttctctgagtttgctctcttgcctgaagaatattgtcttcccatgttgcctgtctcttccaggatagatactctcaaattcatctagcacataggtggagccagagagattgtccgtgttctacctgcaagcaaggtgactgagtggtgaaggtcacggtttctggagctagactgcttggttggaagtttggctcttctacttagctagtgtgccatcttgggctagtcacttaacttctctgtgcctcacttttacaactggggataataattgtgtctatctccatggattgtttttaagattaaatggagtgtactgcttagggcacatcctggcatataaattgttgccattaggtatctatctatctaccttatgactccatgcttaagatcctgccatgcatccttcttacatgttacattgaggatggaattagcacttcttagtgggatacacaggccattcctaatttagttctcacctgcctctgtagcctcatttccttttcccccacacaaaacctgtattttagtcaaactaaaactactcatagttttccaagtcttcccttcttccctgctgtgaaatagctcagtggttaaatgcatgaggctttggagtcagttgcctgtattcaaagctgggctctagctcttggcaatttctgtggccttggaagttacacaagcttctgtgaacctgcttcctcaggttataagaatgagatgagaaataaataaagtgcttggcacagtgcttgtacacagtaaattcttagctgttgtgtcctcagttggaaggaaatatcttttctctcatttttatttggcttttccttgtcgttcaaaatgaagttcaggttttacctccttaaggcagtttgttttcacctctactctgtgtccagaatatcactctctgtcctggcatttattcacactgcactgtacttgttaatttgcttaatctgtttccctcactggcgtaggcaggcggacaatgtatccttgtcatctttgtgtcccaaagcttatcatgtatgggttatttagtaaatgttcattgaggaaaacatgcaataaaatagttgtgaggattaagtgaaattacctattttgactgcttggcacatagtaggaactcagtaattacaaaatacctttctcttagacttacctttaggtatttatgttatgaaggggaaggttttaagctgtactaagaaaattaagagtcaataaataaggatcctgctcaatgcacaggcactttagattcagtctctgtttggatgtgtctttgggcatcagaatagtgacagcaatcatctggtccaccagattcaaattattccatttaatacaaattgtttttttttgactcaaagaatgttgaaataatacagatatagtaaagtatgaccatatacctgcaagcccacccatatgacagtaataacagctaatatatattgagcgtctatatgtcaggcactgggctaagaactttacagcatgtatctcatttaaatcataccagttttctatgaagaaggcagaagtattgtctccatattatatgtgagcaaactgaggtgcagaaaggatgtctgaggcaatcagctatgtagtttaggctagagtggaggttagatgtcaagaaaaggtttatgtaacactgaaattgtcatgtgtgtagatatcagcattagcaagcttggagaatgccaaagctttccatggaatggaaagagctgtaaaggatacagacatttcgagcatggacatggatctaattatagtcatgtattacttaatgatggagatatgttctgagaaatgtgtccttaggcgattttgttgttatatgtatataatacagtgtacttacacaaacctagatggtatagcttactacatacctagactctacgatatggcctattttttctaggctacaagcctatatagcatgttactgtacttaatatttgaggcaattataacacaatggtaatatttgtctatctgaacatatttgtattagtctgttttcatgctgctgatagagacatacccgagactgggtaatttataaagaaaaagaggtttaatggactcacaattccacgtggctgaggaggcctcacaatcatggcaaaaggcaaaaggcacaccttacatggtggcaagccagagaggagaaatctcttataaaatcatcagctcttgcgagatttattcactatcacaagaacagtatgggggaaccgcccccatgattcaattatctcctactgggtccctcccacaacatgtgggaattatggtagctacaattcaaaatgagatttgggtggggacacagccaaaccatatcaatatctaaacacagtaaaaatgtggtataaaagataaagagtggtacacctatatagggcacttaccatgactggagcttgcaggactggaagttgccctgggtgagtcagtgagtgagtggttgagtgaatgtgaaggcctaggacattgctgtacactatggtaggctgtatatacactgtacactttggcaacgctacatttattaaaatatttttcttcaataataaattaactttagcttattataccttttttactttataaacctttatattttaaaatctttttgactggtttgcaataacacttagcttaaaaaacacattgtacatctctgtaaactaatttctttatagccttattctataagcttttgtctatttttaatttttttttaaccttttgaggttttttgtttaaaatgaagacaaaaacacacacatcacacagggtcagaatcatcagtatcactgtcttccacctccaacttttgtcccgttagagggtcttcaggggcaatagcacgcatggaggtgtcatctccaatggtaacagtgccttattctggaatatctcctgaaggacctacgtggggtattttgtggttaactttttaaaatatgtaagtgggactatacaacaatgattaaaaacaatagcacagtaaagacataaaccagtaacatagctgtttgtcactatcaactcttatgtactgtatataattgtatatgctataccgttatatgattggcagcacagtaggtttgtttacaccagcatcaccacaaacatgtgattgatgcactgggctacgacattatgaccaataggaatttttcagctccattataatttttcagcttccttataatcttatgggaccaccattttatatgcaatccatcatatggacggtggaggaagcattctctgaagagatggaggtatagagaaatttcattcccattggcagaaattttaaaagttatagccagtatctctggtacaaaaaagagcaggaggccgggtgcagtggctcacgcctgtaattccagccttttggcaggccagggctggtggatggcttgagctcaggagttcaagaccaacctgagcaacatgacaaaactccatctctaccaaaatacaaaaaattagctggatgtggtggcacgcaccttgtggtcccagctactcaggaggctgacatgggaggattgcttaagcccaggatgtcgaagctgcagtgatccgagatcatgccactgcactccagcctgagtgacagtgagagcctgtcaaaaaaaaaaaagaaaagaaaagaaaagaaacaacataacaagacaaaacaaagcaggagagaggaagtgcagtatctgattgtaagtttgaattgaggtggatatagggatggactgcattttgggtgatggcaagaaatcagaggtttgtggccactgtttagattagtctcagccttcaaatggtggttcctgaggtagagtctggggaatgatagctgtagaaactggattacagagaattgaggagaaagtaggtggtgaggaaacaaggacagctcaagtggagaataggacatctgttactttttgccacccagcgttcttttaccctgctgctaaatgtttctcgatttccttctgggacccacccgtgctcgctttcagtccatatggatttagcattggaactcataacttttctttaagaccattataacagtgcattttcctggccacaaggactggttcaggatttgtcctgttacacaagccaatcaaagtaggtttgtttttgttttttatcctggtaatattggacaatgagtctcatttttctactgtgggagggaatctggaagaacatgatgacagggaagaggctgtctgaggaggaagccaacagagagaactgaataaagggataaggttgaaccagatcctgatgatactgttgctggggggcctctatacccagccctgcctgaagtcaggaccaccccctagttttgcttaaccccatttaatcagtttctgtcattttttaacaaagcactaactgcttgtagggtaactcagcttctatgtgaagaaaagcagtaagaatccttcatatcctaatgggaaaatcattgtatttttatgagggtgagatatatttggtgtagagattatgcaaatctggtgatcaaggttcttattattaagccaaagggaagacagtgttttagatggaagaataattagtaggtttgactacaaaacctatgcatttttccctcaggcatgaccacattattatcaatttcaacagatatattcttgaaagaaggtttttttttcttattcactaaaacagttacttattttttttttcatatttgatagcagctttttttattggttacaaaacctaagcccatatacaaaattaggaacacatttagatgcctcttttgaaagaacattttgtctttttaaactgagtttaaaaaaaataaaaacaatgcaatttttaaacactattttgaaaacttaaaagtgcagcaatatacttagtttcctttatctacgaaatggtgcaattccaattcaaaactggtaaggtcacaaattgaatcaaggaaatgcatacaaatgtctgcattacttgatgctaatgttcacttgaatgttagtttgcactttaaaacatgagaggaaataggaatcatcacagtagaggcccaattttaatcataatgtgtgcaaattttaaaaggtaactgtcagttaagtaaggaaagtccagaagaaactaaactggaaggggtacagttcacaatatcaagaagatttggacaaaaaactgcaaaagtctaaaatacccattggtgatgttttttaaaaaatcttgctttcagctttcaggagttaatattctttgttttaacttgataattggatatggttgatttatattgggtttaaactgtggagctttcatgtttactgtaatttagtcttaaaatattttttacttagtaaccagtacttttgctaatgtggttggcaacaaaccagcaactatttaaaagtgtcataagggttcattctttgagtactgggaaagttaattcagatcctactcaaaaagcatcttcacatattaaaagattcagacagggatctgtgtagaggagtaatttgcagttatttaacataaacctgatttgcagtgatctctaagtaacagttacttattgtatgaatgcatatgtgggctttttaggtacttttctcctctccactccactcgggggcctttcagtttagggctatgacacagccaccactttgcatcatttacaccatcctgaaaacctgcagggctcttccttgctcctggctgttggaattgaaatatctttttcctcttcttcagaatggtgttttgatttcttatcagctgccagctggatttgaaggcctatagcctaatcacctagatagataaggaaagttgtcatattttgtctttggctgataggaatttagaacacaaacaaactcaaaagagtcaacctttgggtaagattaaaccagtgactctaattcagatcattccataaattgtattatcttgagcaaaacactctattccttgacattgcagattataaatgttgggaataaagagaaataagtgaatcccaaacctttttatattatgatacacatataaattataatgtttgataggtacatggaaataaatagatgaggcttctcactgctaaaggtggccaggctggtttgaggggatcagtagctcagcataccttaccctattcttgacactctggttgggaagctcttgaatttgtaaaccatatggactgggttttcgtcctggctcagtcactaagccccactacgttcttgtggcattctcttttccttttgagtcctcggttctgaatgcttaaatgaggaatctgaggtctagttcaaatgtaaatgccatttatcaggcatatataaaaaagcattatcagatataaaaatggaggtttttgagatatactgagactttaagcatgaaagcatctataagagtttaccacttagatctgtttaattactgctaaggacacttactttttaaaaaacagcatgcctacattatctagatacctgtatgacagtatgtgatggacagtgtcagggtctgacttaagcacccagagattagtcacagaatttctgaggtgagggcattcagatcctctattcccccaatataaaaggagactctttaaaaatcatcattgtatagttgcatagaacatcatgcaaatatgcaattgaagatccaagcatataaatccataatcttatacattattaactagcctaaccctccttagtcaaatataatcacatgaagttagagacaatttagttccagtaacatactacactctctcccagccccccacctccacccgccatcaacagcaagtgcagaccactttcatgggacagggcagcactagatccaccaggtaggaatatttagggacaaatgatcaggatgtaaggaagctgaagttaccaccaggcagtgctcattctggtgggcaaatccagggtccaagggaatcaataattaatgatcatagtccaggtaaactttggcaatgacatgaggaggttcaaggcgatggaatggatcaccatgaagaagactttggagttggaaatattcaatgaaccaagcagattttggcttcaagatggtctgtaagtgagtagttatgttacatacactaagatgaagttctggaacaacttcaatgatagagcttcagactaccggaaaatcaagggcaagaacaagattaatgttcatgaaagaacagggttgtgttcattgaatgcacacaggcacacacagaaattaatggacacatatggagtgtttacacgcaagactgtgtcacatgtttacacacactgctccatttaattcttgctaaatctccaaaggacattcattattctatttatagatgagacaacagagacttagtagctaccaatagtcacacagttagtaaatggcagaaacaagattcgaactcaggtctgacttcaaagttcattttcttttcactggtatgttacagaggctaggtaactaggatcttgagaatagggaccaaggaagaaacactgagtaaaatgggtagatccaattggttttcctattgtaacattggttttgggggcaggtatacctgtgccttaggtcaggtttgatccatggaatgggataaaaaatggagctagatcagggatccagaagcacagaccagagacttgacaccaagttgtgcctgacactcccgtttgaccatgcgtaagtttctttcaaatctcatgcagctaaaggaaggtattttcatctgaaaaattatggcatgttatactttttaggatagcagtttgaacctcaaaatgagctcagatatattttgatatcccttgctaaatttagtcaaaagctatcaagtccctctgtaatgaatttataattgggaattaatcagaaatggaactaaaatggaagcttctcatactctgatcaaacgtggagtttgaggttttgctttcatttatatgtttaatcttttagtagagctatccaaagaaggaaaacactcaggataagtaagaaggtcattaagaataacacaaaagtctcaaatattagattctaatctcttcgaaggcagctttctattacttaaacttaaacatggttttgcattctgtggcctctcagcacctacccctgattaataactttacaacttagtaattcatggtcttggagtgtacaactgctaatagttgaggtagcctagtctatactttactttgaagtatttatagttgagtaaatttataaaatttacattgttgtaagtaatcaaatgtctctgtggttaagggttatcaagaaatggtggaaaacacctcatttgtagacaaccaggcattttagagctagaatgacctttagggatcatctctcctatttaaaggtcaggatgccctgggggaaggacatacctataacctcttaatgaaagaatgaggctgagaacccaagttctttaattcttggaaatcttttctttattccatgatgtctttctagactattttgttagtttcatggctatttttatctgtctgtatatactgctgtatatactaatactgtagtgatagagtggtaattatgatttacatagcaatttgcctgttctcaaagtaatttccactgtgtcattttccaatgtttctaagaataaccctttaggtaaatactgtcttcaaccttgttttatagatgatgaaactgggattaaagaagggaagtaacttgctcaaggtcatactacaaagacatactagagctcagattcaaatgcagattctctgaatatggaatatattcttcttccaatgtattgctcataaaggcaaccatatatattaatccaacttgtgatacttttgggagtgagctattactggtttcattggcaaaacagccagttccatattagacaaattgggatagaacatgtgatcattctataattcactctataatagtcagtcagccaaggatatattagatgtctaaaggcagggatgtgacggttaaaacaaaacaaaaaaacacagcttctgccattgaagagattataattttgtgagggctataaacaagcaaatcaaggcaattaaacaatgtagtgtggatatactccaatggagaaaggaggaacctcaacctcttagtttaaatttgaaggactaggaaggtttgaagaagttatttttaagttgactactgaggggatgcagatatgagacagataaacaaagtcagaggtttgcagagggacatgtggtgaaaaagagaaagaaaatccatgtaaaggaacactgtggatcagttgcagggaagagcatagcatgtatatggagcttactccttctccatatgcctggtcattcaattatcaaaattgcctgaaaaatataggctactgatctacaccaagaatttcttttcatagcattaggcaatgaaaataataaatgtgtctctgtgaagtcagcatatgttaagtataagactaattgcaagactaaatagaacattcataatggtacctgaagaaaatatgatgatagaaaaaagccatttcctctctaccaaagaaattacattatggaaattgcaccatcagaatgaattaataggtggcttaaaaaattcaatgcccagcaaacaaaggcataaattaagtatcatgagaaaggttaatgttaaggtaacatttgctcaatttatacgaaaaaaagacttcatggagaaaaggggatgggtcagaaaggagatttgaaattggacagcaggagagttaacatacacatgcccgagggagctgagatctgtggaactgcctggaaattcgtgtttgtctaccagccattttcaaaaatctctggccaggcttgtgtttgttagtaagtccttggcggttcaggtggcagatacactggtgaacattgatgaaaagaccaagctgaactgatctagttggtgagctttctatttgctattaagtagagttttgctctctcttcttttcacagtacatttcacagccatttctgaaaaagcccagctgtgccgagatggccactgaggggatacagtgtggttgcatggagttcagagacatttgagagcagctgagcaagccccacagccttcaaacactcattgaattgccttccagaagcatattctttcacctttgtgtgacatgagagggagcagagggaatggtaatgatctgaaatgacagacatgctgggctaggatgagctaatttacagggtagaatgcactctccaaattaacaacaaagagactaggtgtcccatgccctgtcctgaggcctttaatggagccaagtgagaatatccttaaccctgggtggagtggtcttaaaagaactattcgggtgacaacatcttcccccccggaggttaagctgaggttgacatttatcttgtctgtccacagaagctgaacttctgaatctgacatctcagctttcttaagattgttgataacctgtgttctttaaatttctgtttcccaggaaagtaattgtgttgttcttttagtgatggaaaagcagagaaactctccttaagaaacccccaggatatattgtaaggcaaataggcttttctgcttgaatcatctactacagagctaaccactaaactcagaactttcttagaaaaatatcttgtgtgcactagctttggaggaagaattagaatgcaatttggcaagattgcattcaggcaaacatctgggggagaaaaaaacaacttcagtatagctcgaaagctggaaatgaagatgtactgctaaagaagttacatgtcatacatttctacagtaatcagcctgtgtctcctcttcctttccatttcctaacacaatttaattattgcatttcctgattgcagattatatttcttctatttttatatttgattatagaaatatgctagaaaaaataaagtttcagacatacccaattcattcaggtctcattagcttgtgcctacctatccagattcactttttactcttctcacttccacttctaatggggaacacctcttgctttgtctattttcatacttttgtacttgctggtatttctgcttggaattttctctgggtttcaactttttaagaaaatgtttctttttaaattcctttagcgctcaaacatgtttcttcctttctcctcccattgcagacaattcttaccttcattctaacactcggtatatatatcatattgtgtctttatgtagctgtctcccctcccaggctgtgattctcttaagaacagacctaatatctttcttaccttcattgcctagcataccatctggtccataaagagcattcagtgaatggatgtccaacacgaccattcatgtttgtgacatttatttttccaaggttctttcactttgtacctatatgatatgtaatttttacctctactgagcaatctttatataatgtatatttgctctctctgagaactaaagatagacataaagattggggcaacttgacttgagcacataaatgctacatttagtggatttatttctgcactgtgtagttaacagaactgaagagctactgatctgagtctgaagccaggtagaaaacaaatcaagtggcaacaattaagatctggaaggcagatctgctcttggatctactagcactggcatttttctttggcctcacgtcataagtagcttaaggtcatcattgtgctttgactgcttctttacctggaattatatagcaggtctcatcctgacttcttggggtcagctgtgttcatgttggcaaactgccagtgacctaaaaatgctcacttttgttaagatgtggaggctgttgccatcacagtaggtatgtgactactcacatagtgtctgtctttcaaagttcttgctctgggtgcaactgtggaggcaaggacaatgacaatgcagaagaatgattaagagtgtgagtgtctggctctcccagaagactgtgagaaaaggatttgagctcatagattgtatctgggaggtgagcaccggaagcacgggtatagggcaatgggcaagtgagacaggaaaggcaagacatccagtgttgggtacttcattcaagtgaagtgggttacagctgtgcacagcaggaacccaatcctggtaggaaattttgggaaaatgtgacccaaatttatctcactcaggcagtatgtcactgctacgtagctgctccacaggaaaattaatttcctagcactagttcctagagcttcccctcagtctcagagatgcagttgctggcagtgggaagtcaggcaggtgtgtgtcaaaatggtaagacccaaggagatgtaggggagggacgaacagtgtcaactgtaagaatatattagaatagaactcttcatgttccagtgtggccctgggatacaatttatgtgcagtttcaaagtgagatgccacaccactaagtgggcattctgaagtagatattttaaagctagtttcatgatgttgagctcctcatctatttcaaggatttggaaatttcaaggaaatgtagttaggattttatgataatactttatctagaggaatctgtcctgtgagcctcacattttcatctgcaagtggacttgcaccttccttttgatcaggcctgggagatcttcaatcagatcacttggagagcctcatctatgttgtatgaagtttggtgatacaataaactggaatctgagcccctcttgagacaacctagtatgtcagagagacacactgatgaactgatttggaggggaagtaaaggtgaactcctgaacattccaacaaactgttagaggagtcatagatgtttccccatggccagtatgctggactggacattcttgacaacattctttgtcaagaatgttgcttgaaagaagcaatagtacagtgagaatacaaatggattgaaagagaaccaggagttgtggctaaagtggccacctgaatgagagctgttgctcatgccagtttaatggtaggaggggattatccatgacagtgtccacaactgttcatctgccaccagagcatcctaccctaagtgacaaatgtaccaaccagcaagatacatccctttctcctagtctcttttcctcaatctgatcctggcagaagaaaacaaaaagcaacgtggggaagagggagacacattggtgggaagagagaaaggaccatgactctttgtctcactgtaagtgctcaactacaggagacgcccgaagtggagaagaagttaaaatcagatgttgaagcaagtttaaggtttggattcttatctggggctggacatttgtccacaggacttgctgttatctgagagtgagaaaaaaatgttatgtgacttgctgaaggccaagatttcatttgaggacaagggaaaatcttttcctccagtgtcagagccagaagaaaagctgtttcttgataacatcctatggatggtgtttgctgaagcatggactgtggaaacagacctcaattgaaattctagttctgtagctaattagcactgttgtcttggtaaagtattaattaggattctccagagaaacagaagtaatagaatgtatataaaatcaacatattttatggttaataattatgatattatgtatttattacataatataagaaattgtctcatgcaattatgaaggctggcaagtcctaaatttgcagagctgttgtactagtttgaagaaaggcaggcaggagaattttcttatttgtaggaaggttagctttttgcctattcagcccttcaactgattagatatggcccacctaggtaatggagggcaatctgctttattcagtctactgattcaaaatgttattctcatcaaaaaaacacgctcacagaaacactcagaataatgtttgaccaaatatccgggcatctcataacctagtcaagctgacacataaaattaaccatcatacttacactttatgaatccatttttataatctcatgagttgcttagagattaagtgagaaaatttgtgaagcataggcagagatagaggttcagaaaatggtagccataattattactaatggaattgtttagagaagcaagagttggatccaagcttaggaaatagagaaccaggaacagtatagtcacagggtcaaatgtaggccagtagtcagaccagcaaaaatagaacgtccctaagacaagaagactataaacctaaggtaaattttgtctttgacaaagaatgctttatattgttcctatagaagcgggaggggggcagtgcaaaaatggctgaggtaacacctaaaaacacttgttgggcatttattgtataagaaatactgtactagattttggagactcagcatgaatgagacaccatctccacccttgaggatgttataatctagatggagaaacgtttgataactgtacaattctattgtgctttaagggagccattattataaagcataatgggagtggtttgctataattagggggtcagggaaggctttagagaagtggccttatttccttgggaatttcaaaggacaagtgggactttgccaaatggatatgaggggtagacttttggggcagaggaatagcatgagtaaagttatggaaatacaatttttcagccttttggagaacaggatatcatgtgatggtgctgagttgcaatgtgagtggacagcagatgaaaagagttccaagaagagtgctgcaatagacagactggggtcggtagccaggaagccttgaatgccctactaagaattttggacctaaatccatctaaaacacaaaagtgacatgcttacactggtgttttacagagaaaaaaaagaagatgcaaaatactaagtcggagtttctctagaccactatagtccatagacctttttcttttttattctgtgttttcaaaaatgactttttttcaagaattagcttgcatagcttttgggaacccagtctttatgactgaagcaattcaccctgttaagcagatttgcatttaagttgaatttaaatagagttgttctaatcatgttttagagtagggtcatatgtgagcaataaatttgagatgtgatttatgtacactcaaaattaccaccaaatattttattaataaatcacctttaaagtacaactcagcatagttctcaattcattaagtgaacagatatttattgagtaccaaatactattctagatgtggtggatatagcaggaaaccaaacggaaaacctggcccattatatttgcatgttaaaatagtcttatcacataatattctttctgacattcagaccttggtgagcactataaaccatgtctctcaggcttttccccacaaatgacaccattattatgttcatttcatattggctcattgtggacatgttaacaaggtaataggtaagtgttagttttctgttcttctgctggtaattatatttgacaggcagtattgtggctgcctaaggatatagaaagattactgtccatgagactgcttttatatcaacagaatatcttcattaggtgtccctttgtataaccagagaagcccagtataatgtgactggcaaacatggctcttcagtggcttagagcatcctgatgtatttagtttttaacacagtcttgggcagtatggggcaaaagccatatggaacattcatcttcatttgaccatttaggtatgcacattcttatcctttgacgtctcataccaaactgtagttcagtgaagaagagtgtttgaagttgctggagaattgtctgttttctagcaggtgacccagcagactaataaatattcagcagatagagagtcttcatccacaggagagaaaatgacattatgtcttgagggttattgaggagcctctccttttttcttggcatactgaagaagaataaattttaacttatactcatattggctttacaaatattaaaaaattagccagagctcacaaaatatgaagacagctttttaaatatttttttttggtaaggagagaattatacatggaagttaattcatttttcctttagaagacatattaatactttctatcaatttctgaaattattaagtggagggaggttagaatattaagggctataaatattctttaagtggaggtaatattaaagaaccctctataccttattgaatagaaattcagtaagtgatcatagttagcaactgtattcagttatcaaagggttgcttaataaatcattgctacttagaatgttagtctgctggttcctcgacatttttaaatcataattttgggccagtatagataatttgggtgaaaataaaatgaaatggccttttttttttttacttttatttcaaggtcaggggtacaagtgcaggtttgttgcataggtaaacttgtgtcatggaggtttgttgtaagattatttcatcactcagatattaagcatagtacccattagttatttttcctgatcctctccctccttcccctttccatcctttgaaaggctccagtgtgttgttcccctctacatgtcctgttgctttagttttatttcttttattatttagatggacctaaaataccctcaaatattccatttgtacgactaattatgatcataaacttcatgttgagctaggcactgttcaaattgcatatatttagccctcacaaaactctgtgaggaagatactattacctacctgcatttacacaagaggaaacagaggcagagagcgattaaagaatttgcccaaggtcaagtagctattaatgaaagagccaggattaaacccaagcaatctgctaatttttaacctttatgcagtactgcctcaaaggaaaaatctgtttatgaacactgagaaattattttgtaatttcaagtctctacatacatgtagtttaaagaactaaacagttctagaaagttttatagggaagattaatcccttggaaacagttccctatttcctatccctagaggcaaccactttcaatgcttttaacagattcaattggtgttttcgttcagatctttaaatagcacatttctttgctactttgtgatatttttaagttttcatttttttacacacctctccacatatcttctcgttaggttagtatcgtttatgttattacgattgtgcgtgtgctattgataatctaatcatggaatatacttgattttctttcttgcatagctcttcgttcctcttgtcattaagaatcatctaatttattaatcttattatttagtttactatggtattatcataattaatcctcaaactccctctagttgtataaataccctctaagacattaactcttttatgttctggaataaatctcccccacagtttggttgatttccaggttcactgtgtagtgaatgtcctgggaatatatctgtaccatgactctggggtcctttttgcctctctgtcgggtgagagccccgttcctatgtactgtgcttacttttcttagttgaccgctctggcttggttctccattaattacctgagaaagactacatgggagatgaggttttgagaaatttctgctctgataactgtcttatgaagtgagttaatatttacaaattgctaagaaaactatctggcacatggcaaacaaaacatatacattttaaaaataattataccttcactcttgactggcaatttgaaaaggtattgtatttctgtttgtaaatcattgttccttcctcaggattctgaaagcattgttccattgtatcctaggttcctgtatggaatttgagaagcccaatgctattctgactttttatctttggttttgaaatccattgttttaaatttcatgatgatattggtatacattttcttcatcctgttggtcactcagtggactttttcaatctagatattcataacatttaagtctgtaaatgttctgacatgatatctttggtgacttctcctgtactcttactcctttttccttggtcttctctttctttttctagctttcctgttattttgatgctggactttctgatttttcaatttttatacttgtcttcttattttacatatatttgtcattttcttctaatatctggagacttcgttcactttatcttgtaacccttttcatttctgttgtcctcttttatgtttcaagactgctttttctcttcctgtgttttctcatagcatactctgtttcatgaacatggtgtcctttcactcttaggacattaatcatggtgagtaatcaagggatagtgataatgaagtgttctgttaatggagttctcacatccttcttcttgggtttgtctacaaatttgctgtggcttttgtcttttatgttagaagcctccctcaaatgtttaacccggctttccactcatacttaagagctctgcaataaaacactaatcgaaagctctgtgcaactggagatgtgattgttaatgattaaattcaatgtggggtaacggcgagccattcattctctcaggaaacacctgattgtcaatttaagtatttttagtttgtttgtttccttagaaaatattcttcaaaattcctgcccaggcaataaaagccatctttcagcattctgattgccatatacactttcactgatttcccggtattcaatatggaatctgcattcagttgtgtgtggtgttccatagtgcagaaaataaatctcccatctttttctaggctggtggagaggcagtcatctaactgggcagaatgggaagaggaaccaggtgtatacctagtttttaaggagactttcatcctatatttagctgccattgtcagaagtatctggtggtgttaattcctgagcctcttaaatcccatggtgcaaaacaaattgtttcttggcttttctcactgagtgtttgaattcagctttttcagatctgagaaagcagtcatcactccttcatctgcttctaagttttcaaaattttgttgagttacaattctcacagcctttataggtatataatccttaaaaaatggaaaaaaagctcttaaatatataactttaatgaaatttcaagaaggagcagatgaaattatgtgcatttagccaaccatgtttatttggaaacttgtttatagagaatttttttgttttgcctaattaccagcttctctgttagatgtctgaaagtctacaatggggtgtgtgtgtgtgtgtgtgtgtgtgtttgtgtgtctgtctgtctcatccttccctccttaggaataggggtgggagggggaatgtagcacctagagacatataaaagcacaggagaagaaaagcagcatgatatagggaaaaagagcacaggcttaggaggaagagaccgagattgaatcttctgctgactttgagttattaatctttttggcatctcactttccttatctatgaagtgattagaataacagctgtcttgtagttgcattttgcagatggagataaagtgtcatcctgcacaagccttgaatatggtgcccagtggaggccatgttgtatctggaatgaaggaagaacatttgccagcaggagatgggaaggctggagggaatctttttgagaatattttcagatatgtatagtttgtacaattatatctactttgtaatattgaccagggctaaactacttggctaaaatatctggcttctgaaagcccccactaatttctagatcttttagttattataataaccttactataggaattgggtcacagtggtttaacaaatgtggagtgtaccttatagcagactatgaatttggggctaattgaaatagagacttttggggaaaactcagtgtatggttgcctgagctggtgacaacagttgtggagtgtgtgtgtgtgtgcgtgcgtgtgttgaactaaaacagatacttttaccagagagcacttcattgactcatgtatcctttcattattagcacaaagagattctcttgctttatcctatttaaaaagaaagcctccaaaatagagagcagttgaagaaaaataataataaaacatatgaatagttcttggaaggacacaatcctcctagatagggagaaagataatttagagtggcatagtaaaggccttaggtaatagaaaagtatttaatagagttgttcatgtggctgtaatgtttagttagaagggaagataaaagataagctgtttccaatttctaatttacctgtaatcttgagtcttcacctgtcatcttttcaagaaaggctaacttttgctgcttaaacatcactttcgtgagtagactataaacacctctatttcagccaaaaaccaaaaaaattcagcatgaataatgtgaactattcaccccctccttaatactttctttgcaaaggaagatgtttttcttttactaaataaaaactatattcagaaggctcttcttagtgtaaaaataggggtatcacttcctcaaacaagggctacagtggatttggtattatataatgtgtattctcttttggaaaacagcaaggacatttctagaatcctttaaatctggctctccacagttttctgccatctgtcagctcttctgtggttattaaatagtgatggcatgacaggtgagaaattgcattaattgtgcaatagagaaaatggaacaaattaagtatctctgtattgattctttttagaaaaaaaagtaaataaaacaatgtttataatcattggttctctaggacaacatccaataagtctcaagagctttcttgaagagtatgtgtgtctgtgtgcatgttttaaagtttctgtttgcattaaggcaaatctttggtataaaatagtcttgggttcttaaaactttactgtctctctctcttttctgaagttcatattttcctttttaaggtagtatctttctgagccttgtatttttatttcagaaattctttaatgtctgtgtaccacgctaagggtattctacaaattcttagtttttcattcaaggccctctaccctctgaccccaatttactttccctattttttggtcaatatttttctacataaatccttcctttcagccaaacaggaatgcttagtgtaccccacagacctttcagttttgcctctgtgtcaaaaatcctctcccttcctctgcacttacctgctactagcccctccttaagattggatgattccctaaccctcctagtccagatacgcagtcagttcatctatgcacttccacaacccagtgaggtcactctggaaccatttagcatgaactggcagttcgcattccatttaggtattttttttttaactcggcttagaatgtaacctctgtgaaggcagtaggttttatatttgtttcatagtatttttttccctgacattaaaatgttcacttgtgtgttgcttgtctgtccatcaatcatctatctacctatttttactctctgctatttgttcccacttgaatataagctccaaaagatatcaggaaccttgcacaggctacagaggttgcacatggcagacatttggctctgcagctcatgcttttaaccagtaatctacgtgggcccatgaagcttatcaatgactccatcattgccatttctaactttacttacctttcaacaggattttgacacgttgaccctttatcctttgaatgttgcacttctcttggcttctgtgacacccttctctctctctttttctacattccagctaattatcttgtcatcttcttttgacagtttaaatattggtggtccccggttttgtcatcatcatttttctgtgctttctctacagtcctcttcctagcctagtcctcttgatcttagtggcatgacacattacaggatcacgatcagttatagcacgtgtcaaaactactcactcataagaattgttataaggatttgtgaaaattttaaatttttaattaattagactcacctcaaatttaccattataagaatgtcacacttatgcatttatttttcaatagtgtgtacctacttgtgtgtgaaaacatggaattagagttagctgtaagtgaatttctcataattcttagcctattttatatttgctgaaaacatccatgaactatgattattgatgtgtcattaagagttataacaattttgaaatattatagtctataaactgtggatttataggtatgtttcttttcttgatttatccatgggcacatttttaataacaaagagagatgaagaaaatgtatatgcatctacatcctcatggtatagaaatgagaatgaggctgtccttacaatctccaaatcaaagacaaagtgatcattcaaatagtgtgtgcaataatgttacttataataatatcatgaataaatagaaatactactcactatactttttaatgataaaatgataatttaaaaattactagtaatacatttttatttccttgtattacctgtgggggtttgaatttagtcttcaaaatatagttcaaaatagtttttatgttagattaaccatatatgcatttttttctctccaagaaatgatgttttaagataattaaatatgtgattttactgatcctttggtagtaaaatgcttttgcgagtatgatctataaaaacagtttgggagttctttgctttatttggccaactacttttgtttgtaagtgtgtgtgtttggttttcattacagtctgagtatgttcctgggagtgtgtctcatatgaatgtcattcacatctgtcatagcagaagaaaagttgaaaacctctgctctaggctattttatatactcttttgtatttaactcttgtccatatgttgatgactcttgaatcgatatcatcacccacaataacttatccagggctgcagtcatttattaagccacctactgggcatctttatgtggatgtcctaccagtttctgacttaaagtttattttatctgatataaatgtagctcctcctgctctgttttggttttcatttgcatgaaatgattttctccattccttcactttcagtaaatgtgtgtcattataggtgaagtgagtttctcatagacagcatatagttaggtcttgtttttaatctatttagccatcctttgtcttttagttagaaaatttagtgaagttaggtcacagggaaaactgctgccccccaaactggaaagacagacaggcagaaacaaagaacttaaggaagaaaaactccaaactgaaacttatgtgggaaccaggaccagggtagggaaacctgaaatataactgattaattgctttaggcttatagactaatgtgagtgtttaaaactccatagggtcggaggatggcgatagagaggccctcacacttttgtgagctttacatccaggagcttgaccagcttctaagaatgaaaaattcccctatgcttctggcaggaggagaagagaagaaaccatgtggacatatgccagagcattctgttcttaacaaaacctgcctttaagaggaactattttatttagcacagcctgaactgtaggggtttttatcagagcctacccaatctaggggaaaggaaatacccaactccagccacctcctagccttccacatgggggaagaaaaattcacagctccagcccactctaaccaacctgtcccacctgagtcttgtggggtggagatggagaagcacttgtgaaattcatagttcagaggcacagtcttaatgaaagaatgagacctaatcatatagaatgctaacccctcaacaacttcccaccacattacaaaaggtctgtttattacagtcccttttacataatacatcatgtcatgtctggttatcaagaaaaaatggcaagggatactaaaaggagaaagcacagttttaaaacatagagcaagtataaaaaccagactcagatgtggcaggaatattgggagtagacctggaatttaaaacaggtatggttaacatgaaaaggattctaatggataaagtagacagaatgtaagaacagatggtcaatgtaatcagagagatggaaattctaagaaaggattgaaaagaaatgctacagaagaaaaaatctgtagcagacatgaaaaatgccttttttgtgctaattagtaaactttacatggctgaggaaaaaaaatctctgagcttgaagatatattaatggaaacttctaaaatggaaaaacaaagaaaaagaaaactgagaaaaaaacaaaacaaaacaaaaagccaaagaactgtgggaccaccatagaatgtgtaaatgcatatagtgggaatatcagaagaagaaaacaaaaagaaacaataggaatatgggaaacaataatgactgagaattttctaacattaatgtcagacaacaaaccatgtattcaggaagctcagagaaaaccaagcaggataaatgccaaattgccaaatccctctctctctctctctctctctctctcacacacacacacacagaggcatatcctattcgaactgcagaaaaccaaagataaaaattcttgaagaaattcaggagaaaaaaaaattcttacctagaagaccaaagagaattaccactgatttcttagaaatcatgcaaacaagaagagaaaggtatgaaatatgtaagtgttgagggaaaaaaagcaacttagaatgctgcacccagtgaaattatccttcaaaagtagaggagacataaagccattttcagacaacaaaaattgagggttttgtgccaagcagacctaccttacaagaaatgttgaaggtcttcatagaagaggaaaatcatatagttcaaatcatggatctacataaagaaagaaagagcatcagcgaaagaattagcaaaattaaaattaaaacttttcccttatcattaattgatctaacagataacagtttgttcaaaatcatagcaacaatgtattcgattatatactcttatataaaagtgaaatgaatgacagcaatgatacagtgatgggagagagaattaggcttcttttgttatcataaggttcttgtactctctatgaagtagtatagtattatctaagggtatgctgggattaattataaatgtatattgaaaactctgtggcaatcgctttttgtttaaaaaaaagtatattgctatgctaagaaaaaagaaaaatagaatatcataaaatgattaatgaaaacctcaaaaagaagacaaagattggaagactaaaatagaagcaaggacacaggtagtgaaaagaaagcagtaataaatatagtagtgtcacttgtgtcaacaatcagtggtctaaatataccaattaaaagatacagaatatcagagtggatcaaaagacaagacccaactacgtgctgtctacaaaatactcactttattaaaaaatatacagattaaaagcaaatggaagaagaaatatatatcatgctaatactaaaatgaaatcagaatagctatattaatttctgacacaacagacttcaaagcaagaaaaattatcagggataaatgggcattacataattttaaaagggttaattctccaaaaagatatacacaatctttttgtgtatgtgcctaacatgagaacctcaaaatacatgagtaaaaactgaccaaactagaaagagaaacagatgaattcactaatatagtttgacaattagacactcctctttctgaaataaacagagtctgctggcagaaaattcttaaggacatagcaataataccacattaatcaactggatataattgacatctatgaactacatcattcagtgacagcacaacacacattcttctcaagctcacatggaacattcatcaaaataaaccatgttctgggtcataaagcagaccttagcacatttaaaagaacagaaattatcatacaatatctgcattcatgccacaatagaattaaaatggaaatcaataacagctggagaactccaaaattattggggattaaacaacacacttttaagtaacctatgggtcaaaacagaaatctcaaaagaaattaaaaatattttaaactaaataaaaataagataaaatttttcaaaatttgcagggaaggctgtgcttagcattgaatgcacatattagaacaaaagaaagattggagagtaatgatccaagcttccaccttaggaaactagaaaaaaattagatccaaaataagcaggagaaaacatataataaaaattagtgccaaaatcaatgaaattgaaaacaggaaatcaatagagaaaattaacaaaaataaaacctagttctttgaaaagatcaacaaaattgatgaacctccagtcaggctaagacaaaaaagaaggaagacaaatcactaatatcagtaatgaaaaagaggatatcactgtagtctcatggacattaaaaggttatacagcaatattatgaacaactctctatgcccaaaatttgataacctatgtaaaatgaaccaatttcttgaaagataattctcacagaagaagacatagattatctgaataggcctatatctattacagaaattgaaccaataattaataacagtttcaaacagaagcaccaggcccagatgggttcactggtgaattctaccaaacatttatgaaagaaattatacaaattctccacaatctcttccagaatacagaagcattgggaatacttccaaattctttgtgaggccaacattactctaatactaaaaccagacaaaaacatcacaagaaaagaaaactatagcctggtatttctcatgaacatagatgcaaaaattctcaacaaaatattagtgaattgactccgacagttatttaaaaaaatacaccataaccaggcggtgtatattatcccaggtaaggcaagactggttcaacatttgaaaatcatttgaattgatgtgttcagcacatcaaaaggctaaagaagaaaaatcacatgatcataacaatagatgcagaaaaagcatttgacagtgtggagccaagatggctgaataggaacagctccagtccacagttcccagcatgagcgatgcagaagatgggtgatttctgcatttccaactgaggtactgggttcatctcactggggagtgtcggaaagtgggtgcaggacagtgggtgcagtgcaccgagcatgagccgaagcagggcaaggcatcgcctcacccaggaagcgcaaggggtcagggaattccctttcctagtcaaagaaaggggtgacagacagcacctggaaaatcaggtcactcccaccctaatactgcacttttccaacagtcttagcaaatggcacaccaggagattatatcccacccctggctcggagggccctacgcccatggagtctcactcattgctagcacagcagtctgagatcaaactgcaaggcagcagtgaggccgggggagggggcgcctgccattgccaaggcttgagtagataaacaaagcagctgggaagctcgaactgggtggagcccaccgcagctcaaggaggcctgcctgcctctgtagactctacctctaggggcaaggcacagccaaagaaaagtcagcagaatcctctgcagacttaaatgtccctgtctgacagccttgaagagagtagtggttctcccagcacgcagctggacatctgagaatggacagactgcctcctcaagtgggtctctgacacccgagtagcctaactgggaggcacccccaagtaggggcagactgacacctcacacggcctggtactcctctcacacaaaacttccagaggaacgatcaggcagcaacatctgctgttcaccaatatctgctgttctgcagcctccactgctgatactcaggcaaagagggcctggaggggacctccagcaaactccaacagacctgcagctgaggttcctgactgttagaaggaaaactaacaaacagaaaggacatccacaccaaaaacccatctgtacgtcaccatcatcaaagaccaaaggtagataaaaccacaaagatggggaaaaaacagagcagaaaaactggaaactctaaaaagtagagcacctcttctcctccaaaggaatgcagctcctcaccagcaatggaacaaagctggacggagaatgactttgacgagttgagagaagaaggcttcagacgatcaaactactccgagctacaggaggaagttcaaacccatggcaaagaagttaaaaatcttgaaaaaaaattagacgaatggctaactagaataaccaatacagagaagtccttaaaggacctgatggagctgaaaaccaaggcatgcgaactacgtgatgaatgcacaagcctcagtagctgattcagtcaactgcaagaaagggtatcagtgatggaagatgagataaatgaaatgaagcgagaagagaagtttaaagaaaaaagaataaaaagaaacgaacaaagcctccaagaaatatgggactatgtgaaaagaccaaatctacgtctgattggtgtatctgaaagtgacagggagaaaggaaccaagttggaaaacactttgcagggtattatccaggagaacttccccaatctagcaaggcaggccaacattcaaattcaggaaagacagagaacaccacaaagatgctcctcgagaagagcaactccaagacacacaattgtcagattcaccaaagttgaaatgaaggaaaaaatgttaagggcagccagagagaaaggtcgggttacccacaaagggaaacccatcagactaacagctgatctctcggcagaaactctacaagccagaggagagtggggccaatattcaacattcttaaagaaaagaattttcaacccagaatttcatatccagccaaactaagcttcataagtgaaggagaaataaaatcctttacagacaagcaaatgctgagagattttgtcaccaccaggcctgccctgaaagagctcctgaaggaagcactaaacatagaaaggaacaaccagtaccagccactgcaaaaacatgccaaattgtaaagactatcgaggctaggaagaaactgcatcaactaacgagcaaaataaccagctaacatcataatgacaggatcaaattcacacataacgatattaaccttaaatgtaaatggactaaatgctccaattaaaagactcagactggcaaattggataaagagtccagacccatcagtgtgctgtattcaggaaacccatctcacgtgcagagacacacataggctcaaaataaaaggatggaggaagatctaccaatcaaatggaaaacaaaaaaaagcaggggttgcaatcctagtctctgataaaacagactttaaaccaagaaagatcaaaagagacaagtccattacataatggtaaaaggatcaattcaacaagaagagctaactatcctaaatatatatgcacccaatacaggagcacccagattcacaaagcaagtccttagagacctacaaagagacttagactcccacacaataacaatgggagactttaacaccccactgtcaacattagacagatcaacaagacagaaaattaacaacgatatccacgaattgaactcagctctgcaccaagcggacctaatagacatctacagaactttccaccccaaatcaacagaatatacattcgtctcaacaccacattgcacttattccaaaattgaccacttagttggaagtaaagcactcctcagcgaatgtaaaagaacaaaaattataacaaactgtctctcaggccacagtgcaatcaaactagaactcaggattaagaaactcactcaaaaccgctcaactacatggaaactgaacaacctgttcctgaatgactactgggtacgtaacgaaatgaaggcagaaataaagatgttcttggaaaccagtgagaacaaagacacaacataccagaatctctgggacacattcaaagcagtttggagagggaaatttatagcactaaatgcccacaagagaaagcaagaaagatctaaaattgataccctaacatcacaattaaaagaactagggaagcaagagcgaacacattcaaaagctagcagaaggcaagaaataactaagatcagagcagaactgaaggagatggacacacaaaaaaacccttcaaaaaatcaatgaatccaggagctggttttttgaaaagatcaacaaaattcatagactgctagcagactaataaagaagaaaggagagaagaatcaaatagacgcaataaaaaatgataaaggggatatcaccaccgaacccacagaaatacaaactaccatcagagaatgctataaacacctctacgcaaataaactagaaaatctagaagaaatggataaattcctagacacatacaccctcctgagactaaaccaggaagaagttgaatctctgaatagaccaataacaggctctgaaattgaggcaataattaatagcttaccaaccaaaaaaagtccaggaccagatggattcacagccgaattctaccagaggtacaaggaggagctggtaccattccttctgaaactgttccaatcaatagaaaaagagggaatcctccctagctcattttatgaggccagcatcatcctgataccaaagcctggcagagacacaacaaaaaaagagaattttagaccaatatgcctgatgaacatcaatgcaaaaatcctcaataaaatactggcaaaccaaatccagcagcacatcaagaagcttattcaatatgatcaagtgggcttcatctctgggatgcaaggctggttcaacatacgcaaatcaataaatgtaatccagcatataaacagaaccaatgacaaaaaccatatgattatctcagtagatgcagaaaaggcctttgacaaaattcaacaacgcttcatcctagaaactctcaataaattatgtattgattggacatatctcaaaataataagagctatctatgacaaatccacagccaatatcatactgaataggcaaaaactggaagcattccctttgaaaactggcacaagacagggatgccgtctctcaccactcctattcaacatagtattggaagttctggccagggcaatcaggcaggagaaggaaataaagggtattcaattaggaaaagaggaagtcaaattgtccctgtttgcagatgacatgattgtatatttagaaaaccccatcgtctcaacccaaaatctccttaagctgataggcaacttcagcaaagtctcaggatacaaaatcaatgtgcaaaaatcacaagcattcttatacaccaataacagacagagagccaaatcatgagtgaactcccattcacaattgcttcaaagagaataaaatacctaggaatccaacttgcaagggacgtgaaggaccttttccaggagaactacaaaccactgctcaatgaaataaaagaggatacagagaaatggaagaacattccatgctcattggtaggaagaatcaatatcgtgaaaatggccatactgcccaaggtaatttatagattcagtgccatcaccatcaagctaccaatgactttcttcacagaattggaaaaaactactttaaagttcatatggaaccaaaaaagagcctgcattgccaagtcaatcctaagccaaaagaacaaagctggaggcatcacactacctgacttcaaactatactacaaggctacagtaaccaaaacagcatggtactggtgccaaaacagagatatagaccaatggaacagaacggagccctcagaaataatgccacatatctacaaccatctgatctttgacaaacctgacaaaaacaagcaatggggaaaggattccctgtttaatcaatggcgctggggaaactggctagccatacgtagaaagctgaaactggatcccttccttacatcttatacaaaaattaattcaagatggattaaagacttaaatgttagacctaaaaccataaaaaccctagaagaaaacctaggcaataccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacagaatgggagaaaatttttgcaatctactcatctgacaaagggctaatatccagaatctacaatgaactcaaacaaatctacaagaaaaaaacaaacagccccatcaaaaagtgggtgaaggatatgaacagacacttctcaaaagaagacatttatgcagccaaaagacacatgaaaaaatgctcatcatcactggccatcagagaaatgcaaatcaaaactacaatgagataccatctcacaccagctagaatggcaatcattaaaaagtcaggaaacaacaggtgctggagaggatgtggagaaataggaacacttttaccctgttggtgggactgtaaactagttcaaccattgtggaagtcagtgtggcgattcctcagggatctagaactagaaataccatttgacccagccatcccattactgggtatatacccaaaggattataaatcttgctgctataaagacacatgcacatgtatgtttattgcggcactattcataatagcaaaaacttggaaccaagccaaatacccatcagtgatagactggattaagaaaatgtggcacgtatataccatggaatactatgcatccataaaaaaggatgagttcttgtcctttttagggacgtggatgaagctggaaaccatcatcctcagcaaactgttgcaaggacaaaaaaccaaacactgcgtgttctcagtcataggtgggaattgaacaatgagaacacacggacacaggaataggaacatcacacaccggggcctgttgtggggtgagggaagggggagggatagcattaggagatatacctaatgttaaatgacgagttgctgggtgcagcacaccaacatggcacatgtatgcatatgtaactaacctgcacgttgtgcacatgtaccctaaaacttgaagtataataaaaaaaaaagaaagaaaaagcatttgacaaaatccaacacctatcattgataaaaaccctcagtaaacaaggaataatagaagcgaacttcctcaacttgataaagaacatatacaaaaaccctacagcaatgtcacacaataatgagaaactacaagatttgctgccaaattaggaagaaggcaagtatatcccctcttaccactgtttttttcttagcatagtattctaaatcatagctaatgtattaagaaaataaaataaaaggtgtagttactggaaagaaagaaataaaactgcatttgcttttacataccatgattatctaagtagaaattttttaaaaaatcaattaaaaaatcccttctgaaactagtaagtgactatagcatagtggcagaatataaggttaatgtacaaaagtcgatagttttttctgtatactggcaatgaacaagtgaaatttaaaattaaaaacaatgccggttatattagcaaccccaaaatgatatacttagatttaaatctaacaaaacatggacgagatctataagaggaaaactataaaactcagtttaaaaaaaatcaaagaactaaatagagagataatccatgtttatggataggaagactcaatattgttaggatgtcagttctaccaaatttgattcaagattttatgcaatcccaataaaaatcgtagggagttactttgtggatattgataaactgattccaaagtttatatggacagacaaagactcagaataaccaacagagtactaaaggagaacaaaggtgaagaattgacactaccagatgtgaagacttactatgaagctacagtaatcaaaacagtgtagtactgatgaagaatagacaaacaagtcaatgcaagagactagagagccagaaatagatctatagtaatatagtcaactgatcttagacaaaggagcaaacacaatatcatgaaggaaaattgtcatctcagcaaatggtgctagaaaaactacatccacatgccaaaataaattgataaatgtagacacagatcttaaaactctagtaaaaataaatcaaaatggatcataaatggtaatgaaaatgaaaaactcgaactcctagaagataacaggagaaattctaggtgacctatagtatggcaattattttttagatacagtcaagggaacagttcatgaaagaataataatatgaaattcattaaatttgtaacgtttgttctagaaaagacactgtcaagaaagtgagaaggcaagtcattgagtgggagaaaatagttgcaaaagacacatctgataaaggactgttgtccgaaatatacaaagaactctttaaactgacaaaaagcaaatgaacaacctgattaaaaaatgggcaaagacctaacagacacctcactaggtagctaataaacatatgagaagatgctcaacattttatgttattaaggaactacaaactaaaacaacagtgacatacactacacacctattggaatggccaaaatctgacacactaacagcaccaaatcctcaaaaggttatgaagcaccaggaactctaccatcactttggaaaaaagcagtttctcacaaagctaagcatgttcttaccatgcgatacagcaattgtgcttcttggtatttttccaaatgagttgtaaactctgtcctcaccaaaacctgcaaacagattgtttagagcagctttattcataaccacccaaacttggaagcaataaaaatgtcttccaggagttgaaaggataaactttgttacatctagacaatggaatattgttctatgccaaaaagaaatgaactatcaagccatgaaaagaaacggaggaaacgtaaatgcacaatactaggtgacagaagccgatctgcaaatgtcacatgtgatttcacttatatgacatgatgaaaaaggcaaaactatgaagacagtaaaatcttcaggggattccagaggttgggggaagggagagataaaaggtgctcaaatagaggatttttaaggcagtgaaactactctgtaatgatactacaatggtggatacctatcattatacattggtccaaacctgtacaatgtaaaataccaagagtgaaacctaatgtaaactatggactttggttgatactgatgcatcagtgttggttcattggttataaaaaatggagaatggcagagcaagacggccaaatagaaggctgtaccaatcgttccacctacatggtcaacaatttaacaattatctgtgcaaaaacacactttcataagaaccaaaaatcaggtgagcattcacagtacctgattttaacttcataccactgaaagaggtattgaagagggtaggaaagacagtgttgaatcactgatgccaccttttccccatcactcagcaggagccatgtgacatgaagagagaatctgtgcatttgtgggagggggagagcatagtgattctgagatattgcattgaactcaattctgccttgtcacagcagaagacaaaactgggctgaactttagtaacaccagcccacggagggagtatttaaaccagccctagccagaggagaatcaccatcccaacagtcagaacttgagttactgcaagcctcagcaaagcgggctaaaatgctatggggcgttaaataatgtttatttaagtttaataaacttaaataacaatttaagttccaattaagtaacaattttaagtttaataaataacaatttaagttaataataaacattatttaaggttccaaagcctaggctctaaacagtctaggccacagggattacaactcctaggcatgtcctagtcctgaactggactcagagccagtggacctggagaacaggcaacctattgagacaccagccaggccagctaagggagtgcttgcaccgtccctcctccaaccccaggctgcacagcttacagttcccaaggagacccctttcttctgcttgaggagagggaagagtggggaggactttgtcttccatcttggataccagctcagtcacagtaggataggcaccagtcacagtcagagtcataaggcccccttgccatgccccagctcctgaacatcatttctggacaccccccgagccagaagggaacctgctgccatgaaggtaaggacccagtcttagaaagacccttcacctgctgactaaagaggcttatggtaatagtggctgtgaggtgaggctcctctgcctgtggaaacgggagggaagggttggagggactgtgtcttatgatttgagtgccagttcaattgcaatacaatagaataccaggtagacttctaaggtttctgactccagtccctggctcctggatggcacctctgtacccaaccagggcctggaggaacttgcttccctgaagagaaggatgcaagcctggctggcttcactatccacagattgtagacccagggccttgagtgaacttagggggtagccagttagtggttacagcagaccttggacaaggcccagtgctttgatggcttaaggactgacccagcatagttccagtggtggtagccacaggggtacttgtgtcactccacccccagatccagagagagagagagactccatttgtttgggagaaagtaaggaaagagaagaagagtctctgcatggtaatccagataattcttccggatctcatctaagaccattaaggtgctacatctaggagatgcctatctctcgtcatatacaaaaataaataaaaatggattagacttaaatctaagacctcaaactatgaaactactacacaaaaacatcagaggaagtctcctggatatttgcctgggcaaaaattcttcttgtgtaataatttacacgcatagacaacaaaagcaaaagtgggcaaatgggatcacattaagttaaaaagcttcttcacagcaaaggaaatagtccacaaagtgaaagacaacctacagatgggagaaaatattttgccaactatctatctgacaagagattaataaccagaatatataaggatctcaaacaactctataggaaaaaaaaatctaacaatctaattaaaaatgagcaaaagatctgaatagacgtttctcaaaagaagacatacaaatggcaaacaagcatatgaaaaggtgttcatcactgatcatcagagaaatgcaaatcaaaactacaataagatataatctcaggccagttaaaatgacttatataccaccacacctggctaatttttgtggttttaatagaaacagcgtttaggctgaggcacgggaatcgcttgagcttgagaggtggaggttgtagtgagctgacatcataccatgcactccagcaggggcaacacagtgagactctgtctcaaaaaaaaaaaaaaaaaaaaggcttatatgcaaaagatcagcaataagatgccggcaagggtgtagagaaaagggaacacccaacactgttggtgggaatgtaaattaatctgaccactatggagaacagtttggaagttcctcagaaaactgaaaatagagccaccatagcatctagcaatcccactgctaggtatatacctgaaagaaaggaaatcagtgcatagaaaatatatgtgtactctcatgtttgtctcagcactagtcacaatagccaagatattgaagcaatgtaagtgtccataaagaaatgaatagacaaagaaaatgaggtacttatacacaatggagtactattcagccataaaaaagaatgagatcctatcatttgcaacaacatgaatagaactggaggtcattatgttaagtgaaataagccaggcacagaatgacaaattgtgtatgttcttacttatttgtgggagctaaaaattcaaataattggactcatggagatagaaagtaaaggatagtgaaagaagctgggaaggatagtgggggagtgtgggggaggtggggatggttaatgggtacaaaaactagaaagaatgaataagacctagtattcactagcacaacagagtgactgtagtcaataataatttgtgtacatttttaaataactaaatgagtgtagttggattatatataaaagataaatgtttgaggtgatggatatcccatttaccctcatgtgattattatgcattgcatgcctgtatcgaaatgtctcatagcaatctataaatacatacacacactattgtacccacaaaaattaaaaataaatattttttaaaaaattaaaaaataagatagaacaaattgagcactctcgtgtgggattttggtagtggaagaggttgtgcttattttggaccaagagaaaacaggacatgtttgtaccctccactcaatttcgctgtgaccctaacactgctctaaaaataaagtctgtgtttttaaaagcatgtgatacagagtttcacacactgaatttgtctagtgaattattatctagatccaaaatagttgtattttctactatataacacattacatcatctgtctagctatctctctcacaaagtagaatgtctgtgaaatagaacacaaggaaggagagagaattatgacccaagcaagaatcatgggtccagaattccacccaaggaagctagttcaaagccagagaaagagcacagcttttcacacaattgaatagatctcaacttcatgattttggtattgaagatgctgacagtagccagtggctctgtgaaggcaattttccaacctaccattcttggctactcctgggatattttacttggctgtgagatccccctgagaagcttctctttttctcacacaattcctccatcagcgaagtgtggtgggcagcacacagtgactatgattcctggagatggcactgggactgaacttatgctgcctgtcaagattatgttcagacatgtgtgtgtgcctgtggactttgagggaatgtcagtgacctccacctctgcctcacatgaagaggaaattcataatgccatcatggcagttcattgaaaccgtgtggctttgaagagtagcgttaaaactgacgacaccctgccaccatcatacaaatccttcaacaacatgttgcataccaccctagatctctatgccagtgtcattcatttaaaaaatttgccaaacgtggagacctggcacaaagatgtagacatcctagttgtttgggaaaacacagagggtgagtatagcaatctggagcatgagagtgtgaaaggagtgacagagagcctaaagatcatgactaaggccaagtctttgtgcattgctgaatatgccttccagctggcccagaagatgggatgcaaaaaagtgatggctgtgcacaaggtcaacatcacgaaactgggagatggtctcttcctccagtgctgtgggggaggtggcatcccgctatcctcagctcaccttagaagacatgattgtggagaatgccacaatgcagtgagtatcccagccccaacagtttgatgtcatggtaatgctcagtctttatggcaatgttatcaacagtgtctgcacaggtttgattggtggggcaggccttgtgcctggagccaactatgtctatatgtatgcagtgtttgagacagcttcaaggcaatgtgacaatttagtcaatacaaatctggcaaaccctaccgccatgctgctggcaatttgtatcatgctggattacctcaaactccactcctatgccacccacattaatactgcagtcttggcatccttggacaacaaaagtgtccacactgcagaccttggaggccagggtaccacattggacatcattcaaaacatcatagaccacatttgaaatgtcaattaattgttctgtgccttggaggctaagctatccctcaaagtctgtcctgtcctacttgttacctccactctttctgctttaaaaaccctagccagcttagctactgcagactccacaagaaaccagcttatcctttaattcacaagcagggcagggtgggggcctgtgtgaaccaaaactgatttttttcccattaaattgaaatgccataaaaattttttgtttaaattgaggacaattttatctaaatgaattgaggacattcttatctattttagtccacaattctcccttctctacgatattatatactgaataaatcagagctgtttgtggagtcctggggctttcccagagcttggcacactgattttctctttatcttggtcattaacattcagcaaaccagcctgcagagaagcctggcttctctctagaggtcgttaatgagttaattagtgcaataaactttgcctaaaaaatatacattgtaacttttctaataaataggacaacatacagcagagctgacatagaatgcttccactccttcctagatagcccatctttcctatggtcttatttatgacctttacgttaggaattttctccagtgttctgtttcacacatgaacatttttaggcactgcagctcttctggaaaggggattcttgaattcttccagctggactcaagagtgtagaggtcaaaaccccagttaacaggcactagacccacaacattttgcgaaacagagaactatcgattgtaaactctttggtcagtgtttcacagtcttttacggtttactttcaatctttcaaagaaagaatgtgtgtataaaacaaaacaaaagaaaacaaaaagcactgagctaaatgtttactgtcactttatcctattttatttgtagtattttttaaagttatagttgggagacaaactaaaataactttattggtgcttggaaattgttacttaattaggaaattaaaaacacaatgactgtaaaaacttacagtagttttatcagtaggaaaggcctgtagatagaaatgagacagagaaaaataatgaattctacattgtggaaatgtgtgtctcgcctattacctttggatctctgcctggttaataggtcacaagttaaagacacttagaccatagaaagtttcttacagtttccaccaggctctgccttaatcatattaccttggtctaacctttcctaattgggcataaagtcagggccaggatttggacaactgaaagctagtttgagaggatttagtctgaaaagaaagtgactacctgaaaccctatctagaagtctttcttgaagaataaggcaaacaggaaagagtctatgtataaaatgaccctgatagtcactttactggccattagacatgtcactgtccagggctgccactagcccaaatggtgcccacctctgggctgatctagacgtgcaccaaaggcatgttcttttcaagtggagcaaggggcggattttagccagatggccccctgcacctccaatgccacgctaactgatcttactttaacccatactatccactcgtaccactcttttttatgatgacaaggatttatttatggcacaatcagcttaacaaaagacagtggcccagttgttggcttctatttagcaatgggggtttatgatacacttcagttaaaatttctctatctgttaaagatggtcattttcagaatcccattgcaattcttggaccagactgctgcagtgacacctagtacaccatagtaaaatttttcatttccactgttagatgctctcacttagatatgaacatctctagggtaagctccacgtgttttctttccttgtcctttgtagtctgtaacataatggctggtacataatgcatggaatacatgtttgttgaatcaaccaaaatatgagtgttatggttgataccgctacacttttttatctgtaaagtgtgataactgtacctgccttatagggttgttggaaagacggagaaaattcacgtaaaacctgtgttgttgtgcctataagtgcttagtgtattttagaaattattatattccttattacacagaatataccattctaaaagataattctgaatagaactgagtgaattttattaattcattatagatttttggtttgcggccaacttttaaatagaaaagcaaatcatatctgctgattcatcaagtctccttattctagctcctttttatttcttgaatctggcaacccctcttttttttcaccaacaccttcttcctcattagcttttcttatcattggtaacttcctaatttctcttactgcaagtatagcttcctaactgatgtcttgcctgtagtttagccctgttcaatctattttcacaatgcatccagcatgatctttctgacaggcaaagagatcatgtccctttcttacttaaaacctttattcaaaggcttcattttttctgtaaaagaaaggcagtggagcatagcatgaaaaccatctaatgttctggcctcattttcccttcctcaggttcaccatgtctgtccccccaccctcattccaatatcaatgcaatgtggcattccaacaagactataacagaatttattgttaaaggaccatctattctctctagatcaggcctttgtatacagtcttggttcctttcttcttcattagatgaatttctcctcatgcttcaggactcaacttaatcatcaccttttttggggagtcttatctttttacccctcttcccattttttgctgagattgagggggtaactctcagtgtcccctgccacagctctctatatacactatctagtatttatttctctgattgtgattacatgttttatccccaccatccctcgttaactttactgtacaatgcatcccttggcaataggagtgaagtcattcatcactatagcatcagaacctaggatagggacaggctcttagttcatactcactctaaagaaaagaagagaatagaaggaaggaagaaaagaaataagggaaggaaagaaggaaggaaagaaagaaaaaataagggaaggaaggaaagaaggaaataaggaagggagaaggaaaaaagagggaaggaaagaggaaggaaggaagggaaggaatgaaaggaaggaaggaagggaaggaaagaaaggaaggaagggcttactcctaatggcttaggagtagggaactggaagagctaatctattgcaaaatgctcttgtctgacttcagtctatgaaactatcttacaaaattactcctctctaaagaagactaaagccctcaagtcagtaaaacagttggttggcaggctgcctctgtttcctgagaaaatgtctgtactgcatttgttggataatttcatcttagcctttatcagtttactgtgctttgtttacaattctggtgttataaaaaatggcatcaacaagttgtctgatttttctctaaattactccttctctttacagatttgttttggttactggtcttacaaattactcagtcattcagatttaatagctgactgacattcatcccaactctgccacacaggagcagtgtgacattggataagttgcttaacctctctgatttctagttgcttatctgtgcaataaaggtaaatgtgtaccttcatgggattgttgtcaaaattaagtaagattgttttggttgtctattgctgtaaaacaaactatccaaacattagtgagttcgaatgaccagcaattatttgtcatgattatgtagattagtcggggggttcttcttatcagcagtaggatggctaagagctccagaatcacctcattcacatggctggcagttgctactaatgattgtcagtcagggggcctccatttttctccacctggttgtcgtatgtggtatgtggtattttgatctcctcacagcaatggcacctgggttctaagaaggagtgttctaagaagtgaagaccaaggctgtagacctcttaaggctcagacatgaaagttgcttaatgccctttctactatattctgttgatcaaattaggcaataatagggtagaccagatataagaatgggggaacaaattctgactcttgatgagagaatgacagggtcacattacaaaggggcacataggtgaggagcactattgatgtgaccatttttggaaacatgctctaccaccatgaaaatgtatttaaaactcttgggcaagatggcccaataaaaacagctccagtgtgtggctcccagcaagatcaatgcagaaggcgggtgatttctgcatttccaactaaaatacctggctcatctcattgggactgattagacagtgggtgcagcccacggagggtgagccaaagcagggtggggcggttcctcacctgggaagtgcaaggggtcagggaactccctcccctagccaagggaagccatgagggactgtgccgtgaggaacagtgcattctgacccagatactatgcttttcccatggtcttcgcaacttgcagaccaggagattcccttgggtgcctgtatcaccaggccctgggtttcaagcacaaaactgggtggcagtttgggcagacagggagctaactgaaggagttttttttcatactccagtggcacctggaatgccagcaagacagaaccattcactctcctggaaaaggctgaagccagggagccaggtggtctagctcattggattccacccctacggagcccaagaagctaagatccactgccagcacagcagtctgaagtcaacctggaatgcttgagcttggtggagggaggggcatccgccattactgaggcttgagtaggcaattttcccctcacagtgtaaacaaagctgccaggaagttcaaactgggtggagcctaccacagctccgaaaagccacttagccagactgcctctctagattcctcctctctgggagtagcatctctaaaagaaaggaagcagccccagtcaggggtttatagataaaattcccatctccctcggacatagcacctgggggaaggggcatctgtgggtgcagcttaagcagatttaaatattccgggctggacgcggtggctcacgcctgtaatcccagcactttgggaggccgaggtgggcggatcacgaggtcaggagatcgagaccatcctgtctaacacggtgaaaccccgtctctactaaaaatacaaaaaattagctgggcgtggtggtgggtgcctgtagtcccagctacttgggaggctgaggcaggagaatggcgtgaacccgggaggtggagcttgcagtgagccaagattgcgccaccgcactccagcctgggtgacagagcaagacgccatctcaaaaaataaataaataaataaaataaatagataaataaataaataaataaataaataaataaatattccttcctgctggctctgaagagagcagtggttctcccagcacagttctcaacctctgctaagggacagactgcctcctcaagtgggtccctgacccctgtgcctccagactgggagacacatcccaggaggggttgagagacacctcatacaggaaagctctggctggcatatggcaggtgcccctctggggcaaagcttccagaggaaggaacaggcaacagtctttgctgttctgcagcctctgctggtgatacccagggaaacagggtctggagtggaccttcagcaaactccagcagacctgctgcagaggggcctgactgttacaaggaaaactaacagaaaggaatagcatcaacatcaacaaaaaggacatccacacagaaaccccatccgaagatcaccaacataaaaaaccaaaggtagataaatccatgaagatgaggaaaaaccagtgcaaaaaggctgaaaattccaaaaacaagaatgcctcttctcccccaaagcatcacagctcctctccagtaagggaacgaaactggacagagaatgagtttcatgaattgacagaagtattcttcagaaggtgggtaacagcaaactctctgagctaaaggagcatgttctaacccaaagcaaggaagctaagaacattgaaaaatggctagaggaattgctaaccagaataaccagttcagagaagaacataaatgacctgatggagctgaagaacatagcaggagaactttgtgaagcacacacaagtatcaatagccgaattgatcaagtggaagacaggatatcattattaacgatataatgaaattaaggcagaaacaagttttttgaaaccaatgagagcaaagacacaacgtaccagaatctctgggacacagctaaagcagtgtttagagggaaatttatagcactaaatgcccatggaagaaagcagaatagatcaataataagttctgaaattgagatgataattaatagactaccagccagaaaaagcccaagactagatagattcacagcccagttctaccatagggacaaagaggagttagtaccattccttctgaaacttttccaaacaatagaaaaataggaactcctccctaactcattttatggggccagcatcatcctgataccaaaacctggcagagatacaacaacaaaaaaagaatatttcatgccagtattccctgatgaacatcagtgcagaaatcctcagtaaaatactggcaaaccaaatccagcagcacatcaaaaagtttatccaccaagatcaagtcagcttcatccctgggatgcaagcctggttcaacatacacaaatcaaaaaacgtaacccatcagataaacagaactgatgataaaaaccacatgattatctcaatagatgcagaaaaggcctttgacaaaactcaacaccccttcatgctaaaaactctcaataaactaggtattgatggaacgtgtctcaaaataataagagctatttatgacaaacccacagccaatatcataccgaatgggtaaaagccggaagcattccctttgaaaaccacacaggacaaggatgccctctctcaacattcctattcaacacagtattggaagttctggccagggcaatgaggcaagagaaagaaataaagtgtattcaaatagaaagagaggaagtcaaattgtctctgtttgcagatgacatgattgtatatttagaacaccctatcctgtcagcccaaaatctccttaacctacctgataatcagcttcagcaaagtctcaggatagaaaatcaatgtgcaaaaatcacaagcattactatacaccagtaatagacaaacagtgcaaaatcatgagtcaactcctattcacaattgctaccaagagaataaaatacctaggaatacaacttatgagggatgtgaaggacctcttccaggagaactacaaactactgctcaaagaaataagagaggacacaaacaaatgcaaaaacattccatgctcatggataggaagaatcagtatcgtgaaaatggccatactgcctaaagtaatttatagattcaatgctctccccataaagctaccattgactttcttcacagagttagaaaaaaacaaatttaaattttatatggaaccaaaaaggagcctgcatagacaagacaatcctaagcaaaaagaacaaagctggaggcatcatggtacctgacttcaaactatactgcaagcctacagtaaccaaaacatcatggtactgataccaaaacagatatatagaccaatggaacagaacagaggcctcagaaatgctcataatgctacacatctacaaccatctgatttttgacaaacctgacataagccatggggaaaggattccctatttaataaatgctattgggaaaactggctagccatatgcagaaaactgaaactggaccccttccttacaccttatacaaaaattaagatggattaaaggcttaaatataagacctaaaaccataaaaaccctagaagaaaacctaggcaataccattcaggacataggcatgggcaaagtcttcatgactcaaacaccaaaaacaatggcaacaaaagcccaaatagacaaatgggatctaaataaactgaagagcttctgcacagcataagaaactatcatcggagtgaacaggcaacctacagaatgggagaaaatttttgcaatctatccatctgacaaagggctaatatccagaatctacaaggaacttaaacaaatttacaagaaaaaaaacaaacaacaaaaaaccccatcaaaaagtgggtgaaggatatcaacagacacttctcaaaagaagacatgcagctaacaaacatatgaaaaaaactcatcatcactggtcattagagaaatacaaatcaagatcacagtgagatactatctcatgccagttacaatgacgatcattaaaaagtcaggagacaacagatgctggagaggatgtggagaaataggaatgcttttacactgttggtgggagtgtaaactagttcaaccattgtggaagacagtgtggtgattcctcaaggatctagaaccagaaataccatttgacccagcaatgccattactgggtatatacttaaaggtttgtaagtcattctactataaagacacatgcacatgtgtgtttattgcagcactgtccacaatagcaaagacttggagccaacccaactgtgcatcagtgatagactggataaagaaaatgtggcacatacacaccatggaatactatgcagccatgaaaaagatgggttcatgtcctttgccaggacatgcataaagctggaaaccataattctcagcaaactaacacaagaacagaaaaccaaacaccacatgatctcactcataattggaagttgaacaatgaaaacacatggaaacagggagggcaacattacacactgaagcttcttggagagtgggggactaggggagggatagcaataggagaaataactaatgtagatgagttgatgagtgcagcaaaccactattccacgtgtatacttatgtaacaaactggtatgttctgcacatgtatcctagcacttaaagtataatttaaaaaagtaataaaatgaagtatataaaaatggcaaaaaactgttaacacagtgccagtcacatgggcattgcttaatcagaggcaactgttatcagccttgactgtttccctcctacatctttagcttcactacctgccacttctgtccccatagtgtaccctttgttggttcccttcattcatctagtttattctgtgcttataccatctcaaggactatttaaaaagttgtcgaactagtctcaaatttgaacttctttatttcacattttgtcttgtattaattggacatctacttgagtttagccttaatgaatcatatgtaccttgagagtaggaaacatattcaatcaacattctggaccttgtattacccagcacagtgccttacatatggttggtgcaatctggtaattaattgcatggcaaattggattgaagataatagtgattatagttattatgcattattgagtttatgatgtcatatgttgttctacatgatttgtatttatttattttcgtatcgacctaatctgatgattattattgtaatcctgattttatggttgagaaaactgagggacaaaggtgttaagaaatttacctgaggtcacacaactaacaggagttgaggccacctttaaaagtcaaagggtttggctctaaaacccaaggatttaaatggtcatgagtgtttgtacattgtgaattttcacacatttatgtgaaagtggactaggtttcagcgacagatcaatatctgcttttgaaaaaaatactatagactcacagaatttaagaaatgtaaagaaagctcagttttgcaaaagctgaagcccaagaaggcaaagtcagttgcctcaatctcacaactactacatagctgagacagaatgagaatccacatcttctgatttcagatgaagttttcgttctgttattccacagctatctcctgatgtgacctgtaggaaatgccatttctgacttttaaaaatacttaccatatgtcaggtatggttgtaattggtttacaaatattaataaatttaattctcacattcacccattatgttgataaagaacctgaagcacagaccagctcactgacttgctcaaggtcaattacagatagtaagtagggaaccaggattaaaacccagcccagggcactggagtataaccatactactaaagctatctctcaaaatgttggattaactagatatttgtgaacgaaaaaggaagactatccagacaaacgagatcatttggtaccagaaccaagcatcaaatattgaagacagatgacatttcaagaatggtaaatcaaatagtcaacttatttccttagagtaatgacagacaaaaagagagaacacttaaaacaggaatgatgtgctattgaaacaaaagaattgctaaaataatgatatggagtagacacaaagaattttgcaagtaagaagaggatttgtaagaaatgtagccagttctgggtcattacagcagttgcgaaaaggtgacatcactaaaggctcagttgggaatacgcataatttctgcaggaagctgattaaggagctagacattttttgaagggaggcacttggtccttggagtttccctgacaacttgcataacattggaactcagtgtggtaaattgttcttcacatcaaaatgaatttgcttacactgatatgggaagctactgtgattgctccaggaaatgcaaggaaaagagaaaagagacatatttgaagtggaaaaaaatgacttaacttcacaaaggcagttaaaaaattggaatgtcttgttaccaattttgcaaatacttaaaaaccaattcagcctgagtaaaaacagtctactgatgaagactctcatatgggctctgatcagtttaagcatctggtttgctacagttaatgccaaatttagtgcatacacaatagatgtaaatgaataaatgttgccacaaaagagagagaaaatattgtatatgtctaaacacaaggttactacttttttcctttctatccctcataaaaaggaaatgccttaaattcaaatccttataaatgttctcataataccgggtattatcccagttctgttattttgaacacaagaaactattttggggagaaaaaatgacattatctatgccagcttatgattttaattgaaattatctggagaataaattttaaaaaaagaccaaaaaaccccctctcaacaaataattagttattattcctgggagcgtagtctcacaattgcaaatattgaatgtcattgtttaattagcttgattgtgatgacaattctgcattatatgtatatatatatatctctaatcatcaagttgtatactttaaatatatggaatttaaaattatcaattatacttcagtaaatcttgaaaaaatacaaatgtaaatactgataaccatacaaaacacttaataacacagttcagtgtttggttacattgtaaagatcacaaatacagacctattagacaaatggggaaggaagaagcgctgatactatgcagttggattcgtgtgactttgctggaaaaggcatcaaatacagattcaaaaagtgctttatctcaaacaacttagacagatggaatggtgatgaatttggaaaatctgagagaacttgaaaagtggctctgggttggggaaatcctttaggtcaagattcatgggaagaaattaaataaaattatttaatatttttatagtaaagaaaagataatatttctatactaatatataatatagtccatgaaatgatatacttaatatagctatgcctaataactgaacccataaatcaaatattatacagatatttatttaatatattccttaaagttattcaagttggtctagaattttttttcattctttagatgttgtcattaatttaaaaaaataattattttaattatatttggaatttatttctatgtaggcatttacattttctcctatctgcagcattctgtgggaaaagggatcaaaggagattttgaagttattgcaaagaaatctataatagcaaaggaagaagccagggtttctggacatatcgatagtattatggaaagaaatgcaaaggaatttaagacaagataggctacattcagggtgatatggtcatagacaaggaatttcaaatgaagttatgtttaactacttaaggctggtactagagcacacctatggtacttcatctagttttgatattttaaatttataaaacatgtaatttctgttgaaggtgtacagtgtcactttatgataagcttcagaaaaagatgttgaaaaacctcatgattaaatgaactgttttctccaaggtaagaaaagcctctggattcatccttttccagtgtgcaggttgtgatagaattaagttattttgatctgttttatttttaccagcagcaagatctgtgtatactcagtaacctcatccattcattctttgactcctttacttgtctctcaatgttctttgtcttccattgaatacttgctttgagccataaactgtgcaagcactgagactgcagctctgaaaattgttgtgctttctctcaaggagcccacagggctgagagaatcaacaataatcaggcaattataatggagcataataagtattgtaatggaggtataagcaggatctatgagaggacagaggcggggaagggaaatcatagtaacctctccagagtaactcctgtctcagatgagccttgacaaagtttaggatgagggacagaaggagggagggagtagagaaagagaaagagagaggagagaagaggagagcaaaatagggctgagagggctgccatcacctgcccattgcttgacatgcaaaccttttactttttcctccatcattttttattttgtaccctataattattgttgaactcattttaccccaaaaagtctgccctgattatgtttttaatctatatggaaagattttcaagatttaaggtgaacagctgatttttctatgaaatgtttttgtttcaatgatactctttacattggttaattaacctgattcaaaatctcactgtggttggttctaattcttgtgattaggatttattattttccttaagctagttcccagcaccatcagtagctctgcaaaccttttctattctttgtcatgattctatctcaatgtcagtttctctgagctcatgttttatcaatttgttattttcagttcacttcttatttatttcttctcttctcagatgtctccttagtagtgaaatggatctcatcttcccttctttggtgctcagctccagagtgagctcacctctctgacaccgttttgatctcttactctttctggaagtagtaggtctgagaattgatgtgctttctttcaaggagcctgcaggagtttctgctgaaatcttatccatcaccctccttagtcagccttcctagagcaggtggcataatctactcttgccaagagctctgagaagccaccaataggccagtttctgcccagggtctatggtaattcccattaccacttttctgcagtagtagcaggatgtataccatctggaccattcggtgccatcaggaaatggtcaaaatatttgcatgcccctcaggttcaagtaaataaacagcagcagcagcagcaacaacaacatttccagtgaaaatgaccctgtcactcttctacctgatactttcctcatcttttcccaagaaatcacctttcccccgaaaaaagattatctgctctccatcttctctctcctgtgaggctattttgtatttgtctagagcactccagaagtgggcaactgaagttactagcattacttgaccatggttatagtttttatacagattggcagatgctttttacagtctgtggctggatttcattggaaaaagcttaaaattcacaggaggaggaaagtacttctctcccaggatccccactgagttgataacagtctatgggaagtcatctatttaaacagaaataaacatgccttgggatgccaggagactattttcagttttattaagctattttcagctttattaagaaatctgtgtttaatttttgcagcattttcagtcctgttcatttagcttttctctgtgtgtggatcaattagatcacttgatgagaatgcagacatcgcattctgctccttccattgcattctgctccttccaggatcacagtacatttggaggagagtaaagaacctggaacaccttcaatcacccagccagaaacttgtgcttaattgacttttcatgggaaaaagtagtcctgattagatattgcctgtgtctgggtcctgggaaatttcaacattttattgtcttatatgtgtgtgtgtgtgtgtgtgtgtgtgtgtgtgtgtgtgtgtgtgtgtgtgtgtttattttttggacccatataaattggtagattggtcacctgtaataagttagacactgttttaggtcagggtgagcaatctgtgcatatgtaaagggtcagatagtaaacattttaggcactgtagactttatggtcttcatcgcaactatttaactttgacatctgaaagcaataggagccatagataatatgtagactaataagtggctgtcctctaagaagactttatttatggacattgtaatttatattttgaatacttttatataacatgtaatattttctttaatttgtttttcaactatacaaaaatatgagccatcatttgctcccatgccatactaaataagcctgcaggccataattggtgaacctctgctataggcaaagcagcttaagtaataaacaggacagaaaccccgacctcttgtgactttcgtagagaaattagacaatgatcacgtaaacacacaaataatgaatattatttcaaattctaagtgctaggaagaaaggaaaacaaaacaaaacaaaacagctgttgtgactgaaaacccctggtggtaagaggactgagggcatgggctgcattagctgcttagagaagacttctctaagatagcatctgaggtgttctctgaatgatgccagggagacatgtgaatgttgaaggaacagcaaaggcaaagctgtgagtcagggatgagctcaggatgtttaaagaagcaagaatacttttctggcttgagagaatattacagaggagaaggaggaaggtaatgaaatgaaaaaggaaggtagggacaagtgaggtaggacctggaggccagaaaaagggctttaggtttattcacatttctgggctaggacatgggttttttaataagctgaagagtgatgagaagtggtttatacctttagacagatcactttggctgctgtgtggatgagggaccatcattggaaaatgagagtagaggttaggaggagggtactcaggaggctatagtgggctctagcagtccaaaatagaggcttttccattttctcttcttctaacacttttctcatgtgtgagtctggtagaagcttgggggaaggtgagaaataatgacacaatgcagttcaggttggactactgaatgagattcgcaccaataacattttcaaattaactccatattatttctttttttaattattatactttaagctctagggtacacgggcacaacgtgcaggttggttacatatgtatacatgtcccatgttggcatgctgtacccattaacttgtctttacattaggtatatctcctaatgctatccctctccccaccccacaacaggccccaatgtgtgatgttccccatcctgtgtccaagtgttctcattgttcaattcccacctatgagtgagaacatgcagtgtttggttttctgtccttgcgatagtttgctgagaatgatggtttccagcttcatccacgtccccacaaagaacatgaactcatcttttttatgactgcatattattccatggtgtatatgtgccacattttcttaatccagtctgtcattgatggacatttgagttggttccaagtctttgctattgtgaatagtgccacaataaacatacgtgtgcatgtgtctttatagcagcatgatttataatcctttgggtatatacccagtaatgggatggctgggtcaaatggtatttctagttttagatccttgaggaatcgccacactgtcttccacaatggttgaactagtttacagtcccaccaacagtgtaaaagcattcctatttctccacatcctctccagcacctattgtttcaggactttttaatgatcgccattctaactggcatgcaatggtatctcattgtggttttcattttcatttctctgatgaccagtgatgatgagcattttttcatgtgtcttttggctgcacaaatgtcttcttttgagaagtgtctgttcatatcctttgcccactttttgatggggttatttgattttttcttgtaaatttgcttaagttcttggtagtttctggatattatccctttgtcagatgggtagattgtaaaaattttctcccattctgtaggttaaccattcactctgatggtagtttcttttgctgtgcagaagctctttagtttaattagatcccatttgtcaaattttgcttttgtacaaaagccaacagaaggcaacaaaactccatattatttctaatgctcacaatgatagctaaggatttgggggatatttaataatgtagcattatttcttttaatcctcacagcaattctgtaaggcaggtgtcattatttactccatcaatgaagaaattgaggtactaatatgttctgcaataggtgaagatatctcaaaactggcaagtggcagaggcagtataggttccatgcttggctcttaagcccatgatctgttcacttgctcatcttctcctctgttttagttatctactgctacatataaaaccaacccaaagtgttgtggctttaaacaacaaaaatttatgatttctcatgattcgtgggttgaccaggctcagctgggtggttcttctgttccatatgttgttgactggaattatatgtgaggttgcagtcagatagaagcccatcacagcctgaggcctcccagatgccttcactgtcatggctagtagttggtactacttggctgaggtgtctcttgttttcctccatgtgacttctaaaccaccattatgttagacagaatttcttactgaatgatagatggattctgacaaggaagcttccagaaaaccatgttctaatgtgcaaatggttatcaagctcagcatgaattacatttgatgatgttattacctcagagtaattcatatggccagttatgaaattaaacttaaaaaagaatctacatgaaaggtgggctcatttatggaaccaacccatacctataatattattattttggcttctgcctttagatagaaatgtaggggaatggtttcctcttttgtagaatatcagggccctcttctcagtaattaaagatagactaaggcaccagatatttattaactcatgtgctgattagacatttgttggtttttttcctgtgagtgaaacactgctctaggttctgtgggagaaaacaaaaaggagaatgggggctaggcacagtgattcatgcctggaatttcagcattttggaaggcctaggtgggaggatcacttgatgtgaggagtttgagatcagcctgggcagtatagtgagaccctatctctacaaaaaaattaaaaaaaaaaatagcttggcatggcagcacatgcctgtggtcctaggaactcaagagactgaagcgggaggatcactggggccctggtatttgagaatagagcaagccatgatcatgctgcttcatgccaacctgggcacaagagcaagaccccatatctctcttttgctctatatctatatctatatctatatctatatctatatctatatctatcttctgtctatctatacacatacatacatatatagatagataaatagaaacaaataaataacagtgtaagacatgggccgttccctcaaggtgcttagtgtctaggagaaaatatgctaccagctggttatctaaaacatatgaatgcatgtttgtagataaaatgtatactttaagatatattgcaaattgtttttttagaaggctgatgtttttcaaaagaagacatacaaattgctaacaggtatgtgaaaaaatggtcaccactaatcatcagagaaatgcaaattataaccacaatgagatattatcttaccctagtcagaattgctattattaaaaagtcaaaaagcctaatgggtttccatctgactgtagccttatgtatgattccctctccatgaggatgtggagaaaatataactcttatgcactgttagtgggaatgtaaattagtacaacctctatagaaaacagcgtggagatttctcaaagatctaaaactagaactaccattctattcagcaatctcacttctgcgtagttactcaaaggaaaagaaatcaatataccaaaaagatacatgcacttgtatgtttatcacagcactattcacgatagcaaagttgtggaatcaacctaagcgtccatcactcaggttgaaactataagaaaacagaaacatgtttcttacagtttaggaggctgggaaacccaggatcaaggtgctggagaaagcttgatctctgcctccaaggtggtgcctcattgctgagtccactggaggggataatcactgcgtcctcacatggtggaaggcaaaagggcaaaagagtcctctctttaaccttgagcccttttataagtgtgctaatcctattcatggggcagaattaatcacctcccagtggccactcctcttaatactcttgcactggggattaatttgcaacatgaatttcggggaaaccatcattcaaaccattttgaatggtcacatgctcatttaattttaatttctaagcagaacttactgatcatggttataatacaagtgtcgggtattctaatgagatacaaagccaaagaaaaaccaccatgccatttaacatgtacttagactattccacacactgtctaaatgcgtcctatgtattatttccttttatctctgtagatgcctttgtatatgtactgtaattatcttcattacctagataacaaagtcttaggaattgttactttctcaggagtcagagacagggcttgaaccctggtccctttgactccgaagtctattgtctctaccactgtgtgacacagaagtgatgcagtggggaaaggattgcagtgggaaaaggattggaatagtgttcaggacacttgagttccagtccttagggctgaaccaactaatatgttatcctgtacaaatcagcttcttttgtctgtttttttttttctctctctctcctttaaagcataggagtctacagcctacatttctatggtaatttagagcttatattttcctgacagcttacattgtaaatcttctgcactcctattttgtcttgccctgttgtatttttttaaagagtatatatcacctaatattctgtatcatcgacttaattattctatattgtttcttccatttcccctgcagtagggtgcaaataccagtgccaccaaaatttccaggcacatgggagactcctaataaataatatgatgcacactttttaaaggaagatgggagtgggaggagaagataggaagtaaggatagaaaatatgatgtaacaagaaacaagaagacattggtgtactggtattagaatgatttttatttctgtggggaaacaataaaagaagatgggactgtaggcaggatgcacaattaagagggtcttccatgttatatgaaagagtccagattttgttaggtgatagaaagctagttttatctccaggacttgttagtggaccaaaattctaggagtgcaatggttgattctaagaaacaacccttgaggcttaattgtatttgaaagtgtcatttaactttatgctcaaatgtatggtcaatctttcttgggaaatgacaagagccatcaaagaaataagaagtgatattgtactctgagctcagtgagaaaaatgtgcagatgcagatgtgttcgtccttatttatggtaattgaattttaaatttaatttagcagtaaaagtctgctatttagaggattgttacactgtaaaagacttgagaagcacatagattctaagggtacttagagtatcgtttgatgcctgatgggtgacaagcataaatgcatccaaattaatcataattgccattctagcaagtgaaatgcagcagtgtgtttttcaaaagtgtgcttccaaaacataaaaagaatatgataaatagcaagtcaaaagactgatgctacaaggcgatgttgtgaatgaacagaggctaccaaactacatatctagtagtgtatactacatatctagacagtatagattctatatatatgtacactacatatctagacagtatagattctatatatatgtacactacatatctagacagtatagattctatatatatattacatttgttacaagcatttcataatccttttaaaatagctgcatattattctattttgaacaattacaaaactatataaaagctttatacacttttggacatttaagatttcaaattttcataatcataattaccactacaatcaatatctttctgcactgtttgttttttctctgtattaaggatcgttctccagagagcccatactcgcagtgaaattactggatcaaaggatataaattatttttgcatcaattctgtatgccaatttggttaaaattggcacttgttagtgtttttatagattagtattactgaggttgagattatatttattagccagttgtttgctcttctctgaaatgcctgctcatgccattggatattttatcttttggagcctggtgtttttcatttggatatcacactcagaattctacgtacacaaaaagccaagtctcagtcaagccaaattgtcaatatactgaaacaattaatcaatttattggaacagttggtcaatctactgacatgacgggtcatttcatctataagagtggatcaattaaatggaacatctggtagagtaaaggtgctcccaataaatcatgttagaaagtagagctgaaaataaaagaataaactgcataagctagttcacgacttgctcatgagtgcacaagcacctcttttctgattcttactgaagtataataataatgatgatggaaagttcaagaaacatctgttttccacatatactaggaacctctgcactaattgcagtatgtcgatgtttttattttctttctcattgggtgttctgagagcaattatccctttaaaattaacagcctcagttctctcttttcagtgacctttactcagatgaaactctcatcaacttcacctaataaatgagaaagctcattccctcatttatcataggttctactctgcagttggattcatgccagatcaaggtacacggaaactatccaaaattatgagcacaaggttattacactgtacgtgaaagagaagaatatttttttccacctgagtttgtgaaagtttttcattagcagggatgctgtctcccaactttgccatcatgagcatagaatgtaataacatttaagatgcaataggagctaaggtcagcaggcataaaaggggtctgaattctttcagtcttacctcatgccattaattggaattagattcttgaattatatgtttgttttatgaagaattagggtattgagtcaatagcgtgcctttttccatgatttcctattcatttaagtaatttatttatgtctggatatttgctctaaaaatagacactgttaattttgtcctgcattattgctgtgctgtaatgagccttggtgaccctgcatcaggggacaccgttttcctcttgcaggtgtcatggctgtcaacatcgacagctctttgactaattaaaatttaacagatggtagtattcatgcagctgtaataagattatatctgatttactgtagatgaaatagtccaataatttaatccatttgcagctaaccctggatgtgtgtgtgtttgtgtgtgtgtgtgtatgtttttgtacatgtgtattgataagataaaagtaaatttatgtaacagaaaaaaaagaaaaaaagggcaatttcttctttctttattctacacttattcccaaacacacacctacatatttaccggtacactcacacacaggaaaatacctctccaaagagcaatggctcataataaatgtattatcatttttaaactcagccaagcatggtttctttctggattttgttctgaatatccaggatgttaaggatattctggatattctgcccaatggagtagagatctaaccagatccttaaaaatggacccaggacacaaactggttccatggtctttaccttgacaaaatatagtagtgacacatctccctagctttattctaagataacaggcaaaatttatttatactctttcaaaagagaggcctatatgaacccttactttaagcaagcagattgagccacagttcaatatgaacccaaggtcaaattttaattagcaagtaaaaaaacaagtaaccttgtactcagagttaattttttaaaaattattgagtaaagttctttgtttttattgcacctcagaaagatttagggccatttgtcatgaataggagccaaactaaattggtcatatggaacaaaatgctaagtatgattacttacatacaggaaaaagcctgactcatgtggaatcacatagctctaggttggaacgccggctttgccacttatcactgggtaacctttagcaaattactcaactgctctgactctcagtgtctttatcaataaggatagtaataggaaatacctcgtggggttgctgtgaaccttaagagagataatgtatgcgaaggaggctatagtgtatcatagtagaaagctattaaagataaccatgttgctaaatgtagaaactgttaaagaaaactcactagatttgaaaatctggtttctgagctaagacatcaaggaagcaagctgctgagaacaagagcatatttagcctctccactccctctgagaaggctgggtaataggtcataagaggggactcctctggactgtaagactctgcatttctttctcaatttaaagaaatatgtttaaggagtatataggaatgaaaatgtgatgaaagcagcataatctataaggaataatcaataagtgtcttattcttttatcatggagcttatggtttaatttccaagattactgtctgttctagggagaaagatgtttttgaagggatgatcaggatctcaatttttaaatttcattcctccaaaattctactttcatcttctctccctcctcccccaattcactatcaattcttcaactttactttgaagtttatctagctgtgggaaaccatttccttattacattatcttgtgataggatcataagccactgacattatttctaattatacacatagtaaagtgcttaatttcctccttgaaccactcacatacagtatgtcaaacatgttccttttgatcatcccatggggttgctattacattataggaattttatcaaaaggaaaagagtttaggagcaagaaggctctaaaatgccttgaaaaaaaagcaaagttcctgggtggtgttaactttcagctaaacccaagtagttatcatttttgggaaacacttatttgagccagacatcattttagacatttagcatatgctttcatttaagttttacatttattttgtatagtaagggtattgtccctattttattaaagaatcagctggacagagaaagttaatgttattaaggtcacataacaagcagtttgattcaggtcaaactccaaagctggttttattactctatgtatgcctcttaaagcctattaaaaaaacccactctaaatatatatatgtatatatatatatatatatgtatatatatatatatatatgtatatatatataatatatatatatatttcctgaatatgaataaactttctatcatttcttagaatgatttttaaaatgcttgactttcctgctttttattattcaaactctacttccacaataagaaatgatgtgaaaacaaatattccttaaaatgagtttaccttaccccttccaaattgaatgagtggatgggaacttttagaaattgtaagttatttttaatctttcactttacaaatactaacttattcttcattccagtcggtattctaatgttgcttattgtattagtccattttcatgctactgataaagacatacctgagactgggaaggaaaagaggcttaatggagttacagttccacatggctggggaggcctcacaatcacggcagaaggcaaggaggagtaagtcacgtcttatatggatggcgtcaggcaaagagagagcttgtacagggaaagtcccagttttgaaaccatcagatcttgtgagactcattcactatcatgagaacagtgcaggaaagacgcaccccattaattcagtcacctccccctgggttcctcccatgatgtgggaattgtgggagttacaattcaaggtgagattttggtggggacacagctaaaccataagacttatgatcttaatgatgtagtttattttagataggataggcatggcagatacaacttcttagtcttcacataaaggcatttctacttaatagaatatgtagggagttctgataagtacattagatgaattattttttaacctcaaaagaactatatgagaaaacagctatttaatttaaaataatagataagaagaatgaggttcaaaataactatttacttgttaagcctatgtagaactagtatgtggcagaactcagatttgaaaccagatctacctggccctgaaacatgtgtgctttcttttacatcaatcctaataaataatactaacattgactatcactgtgattaatatccagacatgctgataattacggtattaccttgacatttagtgctatgcaaggagtaatataaatttcactcagcaaatattcactgagtggctgctatgtgtcaagcatcatggttggcaatgtaaagcaaaaacaaacatggtttcggtcctcctaatattggtaatctagtcagaagatgtatcatttcacataataggacaattgtggtacatactgtgaagtaatattgagtgtatgattataaacttgacctagctcctgggtcaaggaaggccatcatgaggaaatcacaggttgaactaagaaggtatcaaaatttgctgacattccttttgatcatctgtgaggttgatgttgcattatagaaatctaacacaggatgcgatttggaaagatggtgtccaagcagaaaatgttgttataggctatgtatagaatggaatcagcttgttgatgctatgcaggttcagagatgggaggaactttccatgttggagtggaaggggagaagtctcagaaggtaatgtgggctagatcctgcagagacctgagtgcatgttagatatattcatctgtatctgatgggtgctgagaattcattgaaaggttttaatttgaatataatctgtcattcaagttgactgagctttcttttcaagcttcggtatatgggcagcagacaccaagcaagtaacccatgtactggctttatgagctgaaaattaatctgtgcgtttcagtaacaaaatctgtagctttactggcttctcatagtgtttaatgactctgaagcagcttattgatgctgtcaggaaactgatacatttgtaaaaagaaatgcattacccatgctataaaattaaatgttgcattgcaaagcaatatactaaatatctctttagtcaatttttgtaaactaaatgttataaaattatattagaacagaaagacagcataaatctgtgtggaatatatgtctttaaggcgattattttgttactctgtactgataggtaggtttaattacctttttactaaagtgtgtatttcacatgcctgggaaaataagtgcattattttgcccaatttgtccttcttgtttacatacgtatatttggggctttgaaggcatatgtattttgggaactgcttttttatatttgcataaaatcaaatacataatttttatctctttttacacaaatattaacaacctgccactgtgtagccgggatcctgtttaagaacctctaaaataaagtgtgactattaatgcctcaattaacttttaatgcaagaattgggactgtctctagagcatgttgaacctatccttcataatggataatgctgaacattttcataaaaagaggtcaaataatttcttctaatgcccatgaaaatatcagctagcatttattgagcacctactatatgtgccagctactttacatattgtctcagttaattctctcaaactcagaggtattattatttcattttatacatggtactattgtctgaatgtctgtgcctgtctcctctcaaaataaatatgttgaaacataatcacaaatattattgtattagaaggcaggatctttgggatgtgattaggttataagcttggtgccttttcaacagtgggattagtgccttcataaaagagaactagttaggtccttccaccatgcaaggacacatcaagaaagcaccatctgtgaaccaaaaaagtaggcccttaccagacactgaatctgccagcaccttgattttggatttcccagcctccagagaattcaatttttattgtttgtaagttactctgtgtatggtattttgttataacagtgtgaatgaactaaggcagtaagtaaactgaggtgtagattggttaagtaacttgcttagtccacacaactaatgagagttagagcgtgggtatgaatccagctagtttgactggtgagtccctactcttagcaactacccggaagagctctattccagtgtatgatggctcttttagaaaggatttttttttttgtatgatagttttttctttatttttggaatgattactttgtccaaatttaagttaacacattgctttccaaattaactaactatccagaaaaataatttaataacattgattagaaggaggaaaatagcaactgccatcaatcacaccctgattacctgccagacactggcttcagtaccttacattttctcatttcattcttacatctttgagggaggtatgagtattctcttttctcagactagcacacagaaggttagaggattgaagtaaactgtcccttcagtgacaaatgtaagtctgtagattaagtctcagcaatgcacaagtacatgttcttgcccagtacacagaattgccacaactacacatacctttgcatgcaatgaaaatatggataagtgaaatagacaggaatggataaaaaacattttatagtttattaaaatatgaagtatggcactgcagttttataaacctaaatgtcactgcatttaatgaagccatctcctcttactcacctctcagaggagagggagatcaggggatgtctttcctccacataagtaacccttttatagcaatagtctcccacctgtaatcccagctacttgggaggctgaggtgcaagaatcccttgaacctgagaggaagagattgcaatgagccaagatcatgccactgcactccccgtctcaaaataaaataaaataaaataaaataaaataataaaataataaaaatcatgagacagatcccttgtcagctgtcatttaggatttataaaggtgaatgaggcatgatctcttctcttaaaaagcatcaaattcaatgagaaagatagaagagcttagagtgagtgtgatctgttgaatctatcagcaagatgaccttagattctctgtaatgcatgttttgtttccatgtctttaacttttttggctttgactatttttaggcaaatccaaagaccattgacatgggataattctcaattttgatgatacactgattgggatcttttaggcttgagaatcaagtcattagcactccgaaaatagggagttatccaattaggcattcaacaaacacttctagagcgcctgttacagtgactgaggcacaagctccagagtctgctttccaaggtttaaatccccactgtcacctactgtcttagtccattttctctttctatgactggatacctgatactaggtagtttataaaggaaaccaatatacttcttacagttctagaggctgggaagtccaaggtcaaagggctgcatctggtgagggccttcttgctggtgggggctcacagcagcagctctaggtagtgcagggcatcacatggtaagaggcttttgagaaacagccaaacctggcctttataagactcactcctgtgataacccattaatccattacttcattaacccttgatatattcccctccaaatctcatattgaattgtaatccctagtattggaggaggggcctggtgagaggtgattgcatcatggcagtggatatcttgtgaacagtttagcaccatccactttgtgctgttcttgtgatagtaagttcttgcgagatctggttgtttaaaagtgtatggaacctacactctgcccccccccccccccccgcgacccccacttgctcctgcttttgccatgtgaagtgcctattctggctttacctccaccatgattaatagctccctgaggcctccccaggagcagatgctgctgtgcttcctatacagcctgcagaaccgagacccagttaaacctcttttcttataaattacccagtgtcaggtatttctttacagcaatgcaagaatgacctaacacaaatgggttgatccattcatggcccaatcacttttaaataccccacttccaatactgttacattggggattaagtttcaaaatgagtttcagaggagacaaatatttaaaccatagcttttaataactctgcaatgttgagcaagtttattgatctttttagacttcttgctcttcatctgtgaaatgtgaatactattagtaatgatgccatagaactgtggtgagagtataatgagatagtagaaataaggcactttagcataacatctgagacacagtaaaggcttaataaatgttagctgttattaccaagagcagcatttttaggtactctacaggatgctggatataaaatgatgagcaaacctagacatggtccctgcccttatgcagccagtatttgaggatctgaaagaatactcagcatgcctggagtacgaaaagcagaagaagttattatggcctgtgaaacaggcagaggacaggtactttgtatatataaaatttagccttatacttaagagtaatgggaagccattgaagtggttaaggtgagctgacattttagatttacctttggaaagattattggctgatggctcgatggactggaagaaagtgcagtggatacagcaagagggctttttttttttgagacaaatctcactctgacgcccaggctggagtgcagtggcgcaatatcagctcactgcaacctccacctcctgggttcaaatgattcttctgcctcagcctcccaaatagctgggattacaggagtccaccaccacacccagataatttttgtatttttagtagagttggcgtgtctccatgttggccaggcaggtcttgaactcctgacctcaggtgatccgtctgccttggcctcccaaagtgctgggattacaggcatgagccaccatgcctggctgagagctcttaaccagtacacaaactgccttaactataaacacttttgtatatagtgcaaacataaacaggtggaaaagtcagaaatagataagagaaaccttttatagtttattaaactatgtgtcacagaactgtaagtggtgaactgagattggaaccagaatctatgctcctagctacatgatcttgcttagttcagtgacccagttaagacacaagggtcgattggaatagtatagagacagtggccaaggaaagcagtgcaccagattcaggatgggtttaggttaaagaatggacagaacttggtgaaagattggatgtggcaaacaagccaggctttgtctctcagtcactctgcttaaggtaatgcttaacaaatgtctgatgaaggtcactgaaatttctcagatcactgcattagtaagctcagttatgtttttttcaaaagtgttcttgaatcttggagatttgctaaggtcttgatacctcctttctgaatgattgccacatttatggagaatatttagaaccttgtgattgtttcccctgcagagttagtcactttcaaactaggatataatcaacagcattttcccccaatgtgtttggtgctggatttattttccctccaaacatattgcagagctttaaaactgttgtccagtgagtcagtgaaaggaatgactttatttgaatgtgttggtggtggtggtggtggtggtggtgtgagtgtgtgtgtgtgtgtgtgtgtgtgtgtttgctttgttttttggctatggagtgttttaaaagctaagatttagttacaaatattactttttacctattactttatattctttccataagttttcttctccttctataaggtctagtgtttctcagaacgtatttttgggacagtttgtgaatatcaatttgtcaaaaatatgttgacttatagtaatatcctcaatatgccagctttctctcccctttgtgtcatccacagcttgaatcccttccatcaccacagctaaatccctgatttttaaagctgctaatacccaggggactttttaaagaaaatttataacatgaaaacactgtcaagttatgacttttatttgacatcacaccgtcaaagcttttttaaaacacgagatgataggcttggtttttacacatttaaaaagttaatttttctcccattattaaaattaaaatgtagtcagttgaacaatttttgaaaacacttaaaaagaaggaagccaaatcactcaaaggataatatcactgcttacgtgttggtatatttccttccaatcttttcttcacatttagtgtcacagttatggtggagttccagtcacaggggtgccatgctctgtcttagtaagaaatctcaaactggcttcatctagtctcaacatggtcaggtgtccccacctccaatcatacttctgtggtgtccagagtgccccctctgatcctggggactcaacagtatcccagattactgaatagagaattgtctccctaaaaatgggtcagatgtaagtggggaaacttttaagattctagcaggtggcatttctgctgggtcattctcaggaaaaatgctggcagctgctcctcactgacagcaaagagaatgatgctcagagtctcttgtgggtagggcttcctcctggaggtagagctggggaagaggcagggaaaggggtgggccttcagactataatgaaaacgattcataagcacaaaggctggggtgggaacacatacattattatcctgatatgagtttttatattatgtaggtatgattatgatcataatgtaattatcattttcttacataacactttattctagttaatatatttcatctaatgtaaacattttattgtcctaggttagtataaatactagaattgataataagaatcataataattaacacatatatagtgtttattttaagtagagaagctgagactagagcaagaatttatgctcttagccactacattactatttccaaaactcttcgtaaacataattgtagtagctatatactattccattgattgcataaattaaaatttacttaatctttctcttactgaagtaaaggactgtttctagggtttatttctccttccacttattaataatgctgctgtgatcatcctggcacataaagcttccttgttgtttcattgttatagattttttccttaggatatattcatcaaggtgggattattagtacaaattttgctatttacttttcaggtttgtgtaattcacactgccaccagggattggtgagagtttctgccttacatattttatctctctgtggcactcacactaagcattctaggtggaaggcactcttctggctgccaaggaggatattttatatgttcctcaggacagcgcagacccttccttgcggcatttgacagcatatagataagtatggacatagaaagtgagtggtataggaaagaaggcatttcaggcagaggaaacattagcaaaaccagatgtcaaaaagtaaaggccttgatttttgagcacagagtttactttttctaaatgtttgtgatttgtgtgactgtaacaatgagttctgaccctggacaaggcatttatagtctctgggcttctgctcaatagattataaatccaaaagattagatcatttgattataaacttcctcagaattctaatattattattatgtaaccatgtaagttaagtaaaaattatccgtatcttgaaagaaaaatcctatgtgttgcttgaattctaaaatatgtatttcttatggggtaagacatggtgcctctatgtgctttcaaatgaaggctatcatttccagaagacagctattaatcctggaagatttatggtggtatatgtcaattgtgaacaatttaagacttcaaagttcctgttaccctctacagcctataaggatattaatttgtttccctgaccttgactggattctatagcatagcatgctctttctcctgtactgtaaagagaatttcttataaaattaaggaaacataaatcaagtcaaacctgacattggtgtgcagagataggacagtatgtaattcatgttcttaatccagtagacaccatctgccctttgaggtcagggaagcagtgatttaggatggggccatggccagtaatttccagaagttgtgtgtttgaaggacacagaatagtttacctcttcccagaaaatcatttctaggggcttctccatctttccaaagttgctacctttgtaacttctttgaaacaaagttattattgctctatcagaccatatatgtcttatccatacttccggccccactcgagaactccttctttcaggaaggacctcaccctcataatacctctattttttaatataaccagtttatcaattaaacatttatttatcttcttcactagtgtgcaaactccagagcagaatgcttgtaatatatcttagccttcccaactttcaacacatagtaggtattcaataaatgtttattaaatagatacagaaataagtgatgggttaattttcctaataagacattttttctttctgttgtgttcctactttgctttatttctgctaggagtaaatcaaaatcgttaagagtacttgccctagagtcagatggggtgagttaaaatcccgactctagttcttccgagctgtgtgactaaccatagtaaatggctaggctttttgtccctcagtgtattcatctgtgaaatggaattactttataaggctcttctttggattaaatgaggtaatacttgtaatgagcttgcttagaacattgtgttacttgtttcttcattattacttatatgcatgtaaatatgattcctcaaattagaatattctaagtagagcctcgtttaactactaagagtgacatctcagcaatatgtgtgtgtgtgtgtgtgtgtgtgtatatgtatgtatacatattattttattttgtgtttttgagacagagtcttgctatgtcacccaggctggagtgcagtgacatgatctcggctcactgcaacttccaccttctgggttcaaacaatttgcgtgcctcagcctcccaagtagctggaattagaggtgtgcaccactatgcacggctaatttttattttattattttttatttttcagtacagacaggttttcaccatgttggccaggttggtctcaaactcctggcctcaaatgatccacctgccttgaccttccaaagtgctgggattacaggcatgagccaccatgcccagctaaatttatatatatatatatatatatatttttagtagagacaggtttttaacatgttgatcaggctggtcttgaactcctggactcaagtgatctgcccgcctctgcctttcaaagtgctgggattacaagcgtgtgtcaccgcgcccagccggaaactattcaaaaacaaactcttgggctaggtgcggtggctcatgcctgtaatcccagcactttgggaggccgaggcaggtggatcatgaggtcaggagattgagatcatcctggctaacacggtgaaaccccgtctctactaaaaatacatttactgaacagaattgatataggtaatgtggaaggttcagctcatcaaagcactgataactgttaaatctgtcagccttatgacctgctttagactctaaactccatgagagctaggactgtacctttttatttgtgccggcttatgaaattcaacaagaagcagagagtataggagagtatgaaggctgatgggtggagggagagtataggaattggggatatacctcaaaatccctgcaaaagtgtttatccagtagatcacgggacttcataccttctacatcactccagctacttctatgcctgccagagccttgctgccatgtttcagtgggatggttcatccctttttcttcttctcctgctgataacagttatatggttgctcaaaacactggctcaggtcctgttcaaagcagatctacttgaatgtgagcctgtgtcactgtgtattgtttataataataataattatttttgtttttcctctggaaatcaaatgctaaactcttcagaaaactgctcgagagatcatgggaagagatggaagcctttaatcttttattaaaatactttaaacataacattgtgcatttacatcaccgtgatagagaggcactaacagctgcactgagacagtgatgaagtatcagaataaatattgaaaatatttggtgtgaatatggtgctgtcctggcaaggaactcaatgcactttcttatatgttatcttgtcctcacaatgcccctgaaaagtggatggtgtgattcctatttgacagatgaagacactgtactaaagtggttggctggaattgctgtttattccatcagggctgaggctcttaattgctctcttagaatctctgactcttccaaatagcgaaagcccccacatttggttccatttggtctcattgccagctagacatcagctctaaaagcttatttcctttacctgacagggaattctgattttccattccacttgctgctgtccaggatgagacccctgaaatatgctttctatgcacatttaaatattttatgttaatagtgatcaaagtcaaatttcaagtaatacttcctgtggtttattgaccaagttaatttaacattaagaaagaaatgagaatgaatgaaaagcattgcacatttccatatgcaaatgtgtgcctggaggaagctgttacatgtggggcaatcaatacattctagaaatttagtagatttgcacatgactttgacattaatttccacaggttctaggatttgttttagaactctttcttcatccattgtcttccatcacaggacatgatattttctgcaactctgaaattccctggctctgaaaatgcacctttggtgctgtacatgagcaatgggatgctgtctcccaggagatttgtaattgcttggtgctgacaggtgctcattgtgggccttcatttcctacccagcatcagcaatccatctcaccctcagcagtaatcctgccaggaagagggaaagatcatggcccaggggagtgattttcatgcagaattctgattaactctgagatccctcagaggtgattgaagtgggggcattgctagagggtggggggctgcgcggagtggtgggcaggggaggaggtcaaccagcagcatgccagacaagttttctctttttatctcatataaatgttatcttaaaaaataagagttctactggttaaaagtaaaaaataactgatatagaataggagagagcttattataataacagacactgatatttgctacgtgctgaaaattgtactaaattccagctctctcacttgatcctataaataactctatgagtatttccattacttccattttatagataagaaagctgcagctggagatgtgaaatcacttgtccaggccacacagctgataagtggcagaaccaggactccttttctttatcttctttctttgaacaaacatgcatcaatctcctgcacagtcccacacatggtgtaaggtattgagaatacagcagtcaacaaagtgggcagggctctgccctcacagggtttatagtccagcaggatttgaatctagatttatgtcactgtaatatctgaactgttaacttctatactctattgtttctaaacaccaactcctggagtctcatcttgaagtagtctctgggaaagataggagagattgaaataaatagatgaattccaaataaatcagactgtgcttactttctgggagatgtgtgggccaggatgatcccatggaatgatggattctgtgctcctaaagtctaagacaactctcctgttttgcaatgacaggaaatgcgtggacaactcagaacaatccctttccaattttaagctctgactttatagtgtaatgcagagcactagactatgagttaaaagaccctgcttcatgtcttgggccccttgtcatttggggaatgtaatttcacttctttagcttatttccccatctgtgagacaaaattaaatggcatctatggttccttctaaatcagatgctctgtgattctgagtttatgagtttagttggtgtatgccctgagattggagggcatacacccatttgtcctcttcaagatgtggtatctcctacaagagtagattttaattttgttgactataaccaataataataaaaaataaattttacattgtgagtcagtacaaaagcacacacacatacacacacatcagaaaatggtataaaatgctattacttatatactctgaaatactctatggtattccattctagtctggtctagtctactatgtttcatttttgtgcaagtgttgactgtgatccaataaattgatttcatatacatttaataacccactagctgagcctggttccatgaaaccagacttccaggaagagtttctcaaggtcaagccatgtttgcctcctgcttgctttagaagattaacaaaaatatacatatttattcctcagacttctgagcaaatgccccattgccctctggggtgttcattcctccctctttgactaggcaagcaatttctcccaatttcctgctttgcctccatgatgccattagaccctctgctatcctttaagtgaattgaaagtgcccccttaggatagaagcacaagccattgttgtataaaaaagtgatcggccaattcagcctggaataaaactgcttcactcagtcatcaaagggctctttaaaattctctaatgcatggagtttaactggagagaaaaaataatcacccatattcgtctgtacaaaacaatgaagtagagtacttgcagcttttgaagtggctttattattatctggttggtctctctttcacttgatggagaaattattgtgggaatgtaacaaatttttaaactgaggctgaaagctctaaacactaggggatctcagacagtgactacatcacattgtgagacagaacagtgtgtttaaagctcgctgatggttctcttcatgaagtatttcctgacaggaactctaatttattgcttgggaagctaataataaggacaggggagaagaaagtggtcatttagccaaatctacatgaatacttaatttctggtgttctcttctgcttccattagtgatgggcatcatttaatttttgccccatttcttagtgacctaggaaaacctataaatgtagtaaaatatttatatctattgggttttccactttaaccagggttatttacttctgataacaccttccattttacctctgacatgtctccaagatggctgccctcttcatctagctcttaactaaaatgtcacctcaaaaaaagccttttctgaaacacttcactgaactagcttcccgtctttgtcatgttaccctcttttattttacaacactttttaccatctgaatttttcttatttatttttatctgtgtttgttatctgataccttccagtgacatacaggttccactgaagataaagactctatctgccccctactgtaccccagaaggcataacgctccctcacagaatcagggttgagcaaaaatatgttgaatgatattaggtgtttactgtccaccccctaactccaagctaaaaataatctctcctttctttcattctcaagcaacttgctcttacctcacttcctgctttggatggccatttcttatgtaaatgttgacatcttttgccaaatagtaagctcctaaggggaaggattaacatttcattaatttaggagtgtaataaactacccatgtgccagtcatggtgctggatactttgctagcattgttttattttttcctcactgcaaccctatgagacagtcattattaccccattttgaagatgaggattccagacttaaaagctcaagaaatttttttcccaattcatttagctagtaaatggcagagctgggattcggacaaaagagcttttgactctattttattttcccttatatttgcatctctttgggcctttcatggagaattatcttattaagtgtttcaaaaattattggataaaaattgaaaataaagttagcagattctatcttgattctcataaaaggagtactgttgattttcctcaagagattttacattttcttctaatatttgttctacattttcttcagatactgtgatgctgatacaaatacctgcttcctaaagaaaccctagtggcaacttccttgaaacagattagtgatttttcagtcaacattgatgttttgtaagtgcctgtaggttccaggcagtatgatgggaatcttaggagaaaggatttagtaagtacaaaggctgctctcaagcaccttaccgttcaatggaaatattgaactggtacttccttgccaaggtgctagagaacagagatcactcaaaatatgattgttctctcttcattccacaagtaacagaagagggaagagagaataggtgaggcccagaaggaagaggaaagagaactgatgttatagagtaaggtcttgaaaacactgactcttcactgagaaatgcatttctttctccttgtttaaaaagagagttatgtgtttgtgtttcccctttcttctctgtctcctgagtgttttagaatcatccttactttccaacctccccccatctttgttttatagcatatttgtattttattttttgcaagttgactctgactttctccttattagtccttctgtgtgtcttaaataggggtttccttttcttcttggaataaaacaccttggaggaaattcttaaaatacaaaaaagtacaaatgcaccgataattccatcactcagataaagtactattgttgattcccttgtagtatgactactttaatctctcttatatcgtgttttgtcagactgaatatataattctgttttctgacttgtttttgttagaatttattaaacatttaggttgtttctgatgttacctgattataaataatgcttcagaggattttttaccttaagctttgtcaacatctctgatttatttcctctaaatagatcattggaaacaataatttagaccaaaggatttccactaaggctacaccaatttagtttcttaccagtgtggcatgagaattcttgttttgccaccctttcttctaaatttgtgtgcctattttggggtacaaaaataatattccattttttaaggtgaaccttttcattgctaataagattgatttttttccccatttctatactggtcctttgcatttttttaatattaacttattttgctcatttaattttttgaggcaaaattgcatacagtgaaatacgtaaatcacaagtgtacttttaaacaagctatgaaaagtgtattcaattgtttaatctcatcactataaagatataaattattactattatctcagaaaattcccttgtgctgcttttcagtcaatcactgtccatcaattctcagccacaggcaacaactgatctgatttctttcacaataatttttcctgtcctagaacttcatataaatgtaataacataatataaaactctttttgacaagtttctttcatccagtatgtttttgaggtttattctcatggttgggtatatcagtagtttatcccattttattgctgagtagtatttaattatatgaatagacccacaatttgtttatccaccacggatatttgtgttaatcctagttttttttttttttttttttttttttttttttgggctattttgagtaaagcttaaatgaacactcttacactaattctctttttggctttatatctaccattttgctatttttttttttctatttgttccacttattccttgttccttttgttactcattttttttgccttctttttggatgaacagaatagtttttactattccactttatctacactattggcttattggctgtatgtcttctttttttgtttttccaatggttgctcaacgatttgcggtatttcacttaaactcatcagagacaaacttcaaataataggatttttgttcatgtttaaactaaaatatttaaaagggtaaattttaatttccctggtccaatgtctgtgtcttcattgttacacattttaaatttatgcatgttataaactctcaaatacatgatttaaaaaaattttaatagttaatttttaaaaagttaaaaatatcttctacatttggtcacatatttaccatccctagcgatctttatttttttgtttggatccaaatttctgtctgatatcatttccttctacctgaagaacttcatttaatagggtgcaaatttgctggtggtaatgtccctcagtttttactgtctgaaaaattctgtcttttgcctacatttttaaatattttcactgattatagaattatagactacttttttttcttaagacttaaaacatgtcattctttgtcttctggctttgaaaaaaaatgcagactgaatatctctgtcttatgattggatggttaatctatttgcatttaatgttatttaaatagttggattggatttatgcctgccattttactttttgttttctacgtcttgtgtccttttgtttttaaatgagtttcattgtgtgtattaaagtataggacatgatattatggatacctatatgatatggtttggctgtgtccccatccaaatctcatcttgaatgtggttcccataatcctgacatgttgtgggagggaactggtgggaggttatttaatcatagaggcagttacccttatgctgttcttgtgacagtgagttctcatgagatctgatgttttttttttttttttgtgggggggactgttgtggggtgtaggaaggggggagggatagcatttggagatatacctaatgttaaatgacgagttactgggtgcagcacaccaacatggcacatgtatacatatgtaactaacctgcacattgtgcacatgtaccctaaaacttaaagtataaaaaaaaaaatctgatggttttataaggggcttttccccattttgcttggcacttcttattgctgctgccatgtgaagaaggatgtgtttccttccccttccaccatgattgtaagtttcctgaggcctccccagtcatgctgaactgtgagtcaattaaacctctttcctttataaattacctagtctccagtgtgtctttcttagcagcatgagaacagactaatacagtaaatttgtactgtgtagtggggcaccactggaaagatacccaaaaatgtggaagtgactttggaactgggtaacaggaaggggttggaaaagtttggaggtctcagaagaagatagaaagatgtgggaaagtttggaacttcctagagacttcttgaatggctttgaccaaaatgctagtaatgatatggacaatgaagtccatactgaggtggtctcggatggagatgaggaacttgttgggaactggagtaaaggttactcttgctatgcaaagagactggtggcattttgcatctgccctggagatctgtggaactttgaactcgggagagatgatttagggtatctggggaagaaatttctaagcaggaaagtgttcaagaggaagcagagcataaatgtttggatgatttacaatgtgatgatgtgttagaaaagaaaaccctattttctgtggagaaattcaagctggctgcagaaatttgcacaagtaatgagggcccaagtgttaattagcaagacaatggggaaaatgtctccaggggttatcagagaccttcatggcaacccctcccatcacaggcctggaggcttaggaggaaaaaattgttttatgggctggacctatggcctcactgctctatgcagcttgggacaggttgtcctatgtcctagatgtttcagttgtagccagggctaaaaggggccgatgtacagttcaggctgttgctttagagggtgcaagccttcagccttggcagcttacacgtggtgttgagcctgtaggtgcacagaagtcaagaattgaggtttgggaacttccgcctagatttcagaggatgtatggaaacacctggatgtccaggcagaagtatgctgtaggggtagaaccctcatggagaacctctcctatggcagtgtggaagagaaatgtaaggttggagcctccacacagagttcccactggggcactgcctggtggagctgtgagaagagggccaccgttctcctgactccagaatggtatatccaccaacagcttgcaccatacccctggaaaaactgcagacactcaacaccagctcatgaaagcatccaggaggggagctataccctgcaaagccacagaggcagagctgcccaagactatgggagcccacctcttgcatcagcatgacctggatgtgagacatggagtcaaaagacatcattttgaaactttaaggtttaatgactgccctattggatttcaaacttgcatgaggcctgtagcccctttgttttggccaatttctcccatttttaatgggtgtatttacccaatgcccatacctctattatatctaggaggtaactatcttacttttgattttacaggctcataggcagaagagacttgccttgtatcagataagactatggacttggacttttgggctaatgctgaaatgagttaagactttggagaactattgggaaaggcatgattatgttacaaaacatgagaacttgagatttgggagggtccagaagcagaatgatatggttcatctgtatccttacccaaatctcatcttgtagtttccataatctccacatgttgtaagagggacccagtgggaggtaatttaatcatgagggcagttaccctcatgctgttctcatgacagttagtgagttctcacaggatggttttataaggggcttttcccccttttgctcagtatttctccttgctgctgccatgtgaagaaggattgcttgtttccccttccaccatggttgtaagtttcatgagacctccctaatcatgctgaactgtgagtcaattaaacttctttccactataaattacccagtcttgagtatgcctttattagcagtgtgagaatggactaaaacactatagatgtgaaaaggtgattatagtgaagcaaattaacatattcatcatctcatatagttaaatattgtaatagcaactagaatctactcacttagcatgaattctatatacagtataaattatccttctttttaaacccactttttaaagtatacatataagcctttttaaagtacactgtatactttggcattaggtaaatgcttttttgtgtaatgttttaattactttaatgatccttttttactagatgtcttgggtaatttttgtaaatcattcctctagggcttaccatatgtacctaatgagaatctatgtcagattaatagtaatttaataccagtgatctatagagatgttattctcacatagttctgttttctcttcttctttgtgccactgttgttatactgtacatgttacatctatatgttataaacccaataatgaattacaataattatttctatatatagcttaatgtcttttaaagtagctgagagaagaaaataaattatatgtttgtaaattttgtcatagtaaacttcttatttaccattgttggttctcttccttttttcctgtggatctcggtaaccaattaatatattctccctacttcaatatagctttgctcctaactaccttctttgtgtggcaagtataaatatttacatatgttgttaagtatagatatttacatatgttataggcttaacaatacaaatgcatacacatcatattatgcaattccatttaaaacatgttaagagaaaaaaggaaaatatgcatttatactgtctttaaaaattgcttaattacctttacttgtgcttctcctccctcacaccatgtggaatagaattccatttgggggtcagttggttttagactgaagaaattcttttaatagttattgcaagtgcctttactagcaacaaattctgtcaattttgttcctctgaaaatggctctttttttcttcatttttgaaagatagtttttctgggaatgagaaatttgttagttttattctttcagcactttgaatatgcatgtcatctcactatattctggcctccactgtttctggtgagatgtcagttgttaatctgcctgggattcttttatgtataataagtcatttttcctttgctgttttcctgattttctctttgtattttactttcaacatttttactatgatgtgtctgggtgtatatctgtgtttatcttacttggaatttttttgagcttcttggatgtgtcaattctttctgtgaaatttgcaaagtattaaccattatttattaaaaatatttttgttcctttctgttttttctcttcttctggcaccccaattttgcatatattggtacaattaatggtggtcttcatatctctgaaacttttaaaatttttcttcattgcttttctgttgttcagattgcataatctttattcgtctgtctccaggttagctgattcttctacccactcaaatcagtttttgagaccctctagtacatttttcatttcagttatattagtttcctactgcagaatttccattagattcttgtaaaaataattcttattttttatttgatgagatattgccctcatatcttccttaacctctctaagcatatttttctttagtactttgaacatatttattgtagttgctttagagtctttgtcatgttcatatctagtccttctcatggcacctcttgttgtctgctttttatttttatttttctgtgcatgagttatactttcctgtttatttgcatgtttcccttttttttagaacagtaggcattttagataatataatgtagcagtgtccccttccctaaaactgctttttcttatcttttatttgtttgcatgcttatttgtttagtgacttggctgaataaatttagtgacactggcagtgtaaagcagtgtaaagcctctgatgttgttcctcagaggatgcaggctttggcatgctcacagtcactctgggagacagtagttttctcagaactatccttgactcttcccttctttggtcttgctggtaaactgcctgactctactggtaatacactcaggtattagtgtttgctaattttcagtcagtcactttattgttttggacaatgctgtgggaaataaattaccctacaatctgatccaattaatttcagacctctttgcagaagttttttgaggccaggctttgaagtatgttctaaccacaggaggtctctttattgctgtctctttcccagttcactctgataaactagctgacttgtggtttagtttattgctcttatggaggtatcagccttctcttaattgcttattgttgaaatcttcctggtttttgagaatgccctaaagcttgaacttccccactctcttttctaaataaaatcagtgattttgaggagctctttggcgctctttccccttgtggcatgttgaggcttccttctaagtttggttcgtgtcagtctaatatagactttaccctagggctcagttagttctagaactatttctatagatggtctttctgaggtctctattgaattactcaagtattcaactggactctcagctcttactgatcagaactttaatgtctcccagacttattaagcttccatacgttcttgtcataatgccccattggttattctttgactggcttttctgtgtattattctaaggatgcactgctttgcgttcaaaggtccaagggggctcctatggagatttccaaagtgttctctgtacagtttcctcctgttaggtactctgcccccttaattccagtcaccttggcttcttcaaactctaatcattgtctcctgattgcagcaagagtactgtgccctgtttagagttgcttatcctatgccatttttctagaatatacctgcagacacaaagttgaggcaatcttggggatccctttatttgtatcccttctatgtgtcattatatcctttgctactccttgtttgatgtctgaaaacagttgttttatatattttatacaattatgattgcttatggtagaaggtatagtctcatacaaactaaatcttcatgggaagaagtggaagtcctgtctttgatttttgtggctttgtgtttttcttatttgaccaagctccttaaaaattcaaaattttgatttttgtctgttgtattagctaacaatattttcctttgtgtcattcacttttaaattattttacagttttatgatttccatattttaatttttatataactgaaattatttttttaataatttcttccaactagagaacaaacattttcctagaatttctttcatgggtgtttgaggggcttcactttttataattaatattcagtctactgagattatttttggtataagttataagatggttttgtgtgtcttttattctaaatttctttaaacaacttgtagaaaatgatgtggtataaataaatcaataagtgcatatcacaggaaagtggttgaatgtcatttttcattattttagaattcatgtatatcaattttgttccatggacttaaggtcattcttgggtgatataagattaagacagataatactgtgtgcttccttttaaaaggtaaaatttgcttaaaaccaataaaaatgaaaatgaggacataaggactaggatgtaaagactaaagggcaaagcagcatccaaagtgggtgtttctcatttaagacaatggataccatggccagacttgcagtcagaaagacctagttttgaattctatcatttacttcctttctttctaggttacggttaaggtgaaatcagacaatgtaggtaaaccattcttgccatatcatcactacggccaccatcattgttgtgattatagaaatagaaatagaaagattaaaagatgaagatgcagtttgagtagacaaggatgaagtcatatgatctagcctttgctttctttgtaataaattaaatagcataatgtggattatgtgctttcaaactttcttccatatgtatgtatacacatatgtgtgtatttagtttcatcacatggttcccatcgatacatctctttccatttactgtcaccatgggttgtcgtctatattcagctcctggactttgtaaagagattcactaaagcattgaagcatttggctggggaaagtgatgaggaggaaaaggagacctagtagtgattgtgtcacttttccttgtccagtaagtgactgctgtccctggcttatctattctccatgcacatatgtttaaaccaggtcacacaaaattggctcttttcttgtttgctcaaaggaagtctgtggtagaattttactggaattggagttggtatcactgaattgaaattcctttttctccactgctgagtcgtgagatttggggcaggtcccttcttctttaatgtccatttttgggttggaacacacaattacttaagggccatagaaatttctgcatgtgcattggagttcattcatttattaatttttaaattaaatcattgttgagtgatttctatgtcttaagcactgtgtttggtactgaggacattgatatgtaaaaaccatagaacttattcctaccttcaaggaacgtgtgtagaagaatagacaaacattagagcataaaaagaacataggtataatgaatgctacaaaggagaagtgcagatattatgggtggtaaatattggaggccaggagtctaaaactattttggtaaagagaaagacagtaatattttaggctttttgagccaataggcaaaatggaacaattcttcttaccaaaatgccttgttggtaagttttaaaaatattttatatctaaaaaaaattaagtcacaaagcccttacgaaaacaggccacaggctacagtttgtctgattagacaaacattatattcataatagagtatgctaagataatacccccacctaaagaatttctgtggtcactattctcctaaaggactgtgtaagagacctgtctctgtctctctgttttcccctatttctaagtccctctctctttctttctatttctattatatctttgtagaattcaaaaatatgtatggaatacataccctcacgcctacaattttctggtatcttaatttggctgcctatttgtgtcttctgagaattttaaccattttattagttttcatacaatgttctggcgactgtgtcgttgagtaactgcaattgtgtagatgctttaccaggagctgggttaatccatcaatatattgtatgtcaatatgctgtatctgctgaggcagctggagaaggagattgagagcaggtactgagggagcagaaagaggaagagaaaaaaacagataaaatgcctagctgtcccagagcaggattagcaaacatgttgttttggttatccattgtttcacagtttaaaaaaaatctctttgcgtcaacagaattagaggcatggtgtcctctctgaacacattaagccatttgaagaggctccaaaagtggaatcaaattcaattaaggaaaaaaagaccacttattaccctttaaaactcataatatggaagatatttcaaaacataaaagttgaaatgttttaaaatagcattttaaatgcctgaatcacttaaaagtgttctgaattttattcattctattttaattctatcctgagatatttcctatagatatttctaaatattttttgcagttacatcaagagctagaaaaggacaaatatccttatgcaatcaatttgactttaactatttcctctctctctctctatttttctcactttcctattacttgtgtcagtacctgagttttttcttatcctattttatttagagtgggaaaaagctatgactgaggaaaatgccaaagatctaatcaaggaattgtcaataataatcgtgtggctcaagccataaatcactttggattaagcatcacccttcatctgggtgtgaaatttccaatgccttttatttgttatctgccaatggaaattaaaacattcccttcacaggggatctttcagaagcagatggatccccactgtcagggcatctgggaagttgtctacctgaagacagtcaaataaagcttatgacattattaggtcctttccccaccctctaaaaacgcaaatccatttgtacacaacattcagttagcaagtaaaattttggtcaagccattatgttttgtatatgatgccaagtacatcttaatggatgagagagccaattgactgatggccttaacatgttttataaatcatctctgtttgcatgttcagcccagcccaaaagacagaggcaatagacaccaaagcctgccattcttaagcaaagtttgctttagttctgtataaatattaggccttaacatagtttactacaaatctgttttagtcttaatttcatgcgaaatcaacaatggacatttatatagcattaattaaggtacactattcaatacatataaaatttttcaacattatttatatacaaccttagtttattataaaaactgttattgagatgtcaaagcctcagtgtttttttcgtaaactttctcaggctatgacattaaacctgcccttagacattaaactagaacctttttatgtatatatgagtaataagaacaacatcctgcatctatgtagaacttacagaaacacaaatacttagtgtttactgttagccaggaactgtgctaagcctttttatatacagtatcttattgaagctcacaactctccatacgtttgtacccattgttaacagtgaatcacttgaggtttgtagaaatttgtggcttgcccaagacaaagtcaacaagtgggcaagttaggttttatacccagtactgttctattcagaatctaggttgtttccactttgctttccagtctaacctggttttctcaaaattatctgcccccacaaaaaaaagaaggaccaaacagtggatttgctcaagatcataaagttaattgaacagacaaaggctacactagaattcaggtctttttcttctaacatgttgctcttggcatgacacttactgcttcatatgtgtgtgtatatatatatatatatatatatacacacacacacacacattaaacagaaatcagaatgaaatgctttgtatttgaactcttctttttttagttttactgtctgtttttcactgctgtactcagttggccctttaaaaattctaattactgaagttattatattaaagaagtattggaagaacaacttaaattctagaaatcacaggaaataaaagttattccctttgagaatcttattgagatgctgagagaataatgcttaaataaagagatacctgggttgaatttgagaccaattttgcatgtgaaatctcagcaaatattatgctcagttaaacaatatgtgaccatttgaacagatgatgttgtaagaaagaacttttctgtaaattgttgaaatggaaagaattcttcatgcaagtagaaataggcagctagttaggcttttcttaatgaaatgacagttttcaaggtacttagcttgagagtacagagtgcagtatttcctgaaaatggaaccaaaatggaggggcctggggtgtactagtcagtctatataatttactatcataataaactgggttctttttgttttttcttctatgatgaaaaataatgtaggaacaaaagtccacataattccatccatcacatttgatatgtccttgtattaatcaggatagaaaaactatgttgttctaatggtaaatcacccaatctcagtagcttattctataaaagtgtatttcttgctcacataaaatctgatatgctttggatcttgctcttccattttatagctatgccaaatggaaaatatgtcttccaagatcactgcaacaacagaaaagaaggctagacagcatacaggagctcttacatggcccctgtcacttctgctcatagcccattggctagaattagtcacatggcccaggccagctacaagggaaactgagaaatatgtaaaagaacaagtgattatttagagaatgatgtctctgacccacgaattatttctaccctccttcctgctggcaccctgcttttccctttcccgcttttcattcttttctttctttcctttctttctttctttctttctttctttctttctttctttctttctttctttctttctttccttctttctttcttgctttccttctttctttctttctttcttttctttctttctttctttctttctttctttctttctttctttctttcagtgctggtctttcttcacctttttgtatttcttttgcatttagccactatttaacaaattatacatctatcctatagaatacttgcatgaccctaagggtgaatgcatcctaaactgtgtgccctaggtgcttttcttgccctagtcctgctattctgtgacaggttgtttctaagttgagcaatatgtaagagtcaaacatgattcctaacttcaagttgctttccgtcctgtgagagagatgtgatgtacagatataatgacaatgcaatgtaaaaataaaatgccggtgtcatgcaatttcgacaggtgttgtgctgtgggaattgattgaatattgttctacactcaacagtgcttgctaaatgcaaatcagagcactgtgagcacatgttaaacaggtaaagaaagtgtaatccttctgctttagagaggacaatcacaaatggagaaccttggagaaaatacatatggttgcccatcacacacactttaactgggtatgtgcatcgtgtcagaggttctcagactttgctggatggacatgggattctctgtatagcctaaaatgtgtgagattttctattctagagaaggcccagatctataaatgttcctgaaaaggttattgaccccagagtttccagggtttccagggtgggtacagatggcgactactcttttgtttcatgaggatttaccccagacttataggaacagagacactctgaatcctcataaaatagccaacatcattcatcccttgaaactactggcatgaattgtcttgcacggaggaaacaaacatttcctttttttttgttcaatgtctgaagggagctatccctgcagcaggacttggaaaggctcataaaacttgagcaaaatgtttataaagcatggaagtaaatgacaagactgtaactttgcaaagtttcaagaggagcagagattggtctcagtgatccagggatgggctttaggaagcctgtgaatccccagaaacatttgtgtgtatttggttctatgcatttttatggagaagggtccacctataaacattaagagccactaatctcattttaaaaagatggaatctccagtctaaatagatttaaatacatacctaagatcaaataattaatcagcgctgaatccagttctgaagccctattctaatccccactgttctgggctaaattgtgtcccctcaaaaatattgtcaaagttctaacatttggtacctaagaatgtgactgtatgtggaatagggatgtaactgcagatgtaattaagttcatataaaatcatgaagatgtccctaatccattataagaagaggaattctccctgtgaaggcaggtacacatagcaagacaaccgtataaaggtaaaggcagagattggagttacacaactgaaagccaaaggatactgatggcttaccaccactagaagctaagaagagtcaaggaaagtttctcccttagagccttcaaagggaacagagcactgacaacagcttgatttcagacttcagcctatagaactgtgagacaatgaatttctgttgtttaagacattaagtttcttatggtagcccaaggaaacaaatacactcactatagctaactctccaaactggtacatttcttttcatcgtgtcagtgccaatactgataattatgtttcctggtttttaaaattcatgtttaccagacctagtttaggcacctctccaggcaatcagggtccgctggtccttggtgacttgctctgtttcctggctggaactgctgaacaatggcttctgccattcccacaatcaaaattgtagctaccaataagaatgtactaattctaccacctttctgggctcaagtgccaggctttagggccaccttcatcatgctagctctggcagaagctgcagcagtttccatgtccaagtccaacctgactagacctatagaggccccagcttccccaaaagctccacaggggctggctaacatcaactggagttgcagggcagtaaatgctccgtgaggcaaactttaagggaatacaggagtcataaggagacagaccatgaattgttctgtcttcctcccatcttagaaactgttcagagatgcagaggctctacagtggctttcctgagttatcctatttaaccaagaaaccattgctactttcttggaaagctttagccagctcatcatacacaaggttattatttttgctttacctactttttgtttttgcttttgtttttgtttttgagacggagtctcactctgtcgcccaggctggagtgcaatggcgcgatcttggctcactgcaagctctgccccccaggttcatgccattctcccacctcagcctcccgagtagctgggactacaggcgcccaccgccatacctggctaattttttgtatttttagtagagatggtgtttcacagtgttagccaagatggtctcgatctcctgaccttgtgattcgcctgccttggcctcccaaagtgctgggattacaggcgtgagccaccgcgcccagccagctttacctacttttatgagttgaattaaatttatgtgttgaactcgtaacccaatgtgtatcagaatgggactttacttggaaataaggtcattgcagatataattagttaagatgagggcatagtggagtagggtagggtgggcacctaaccctttatgacgggttacacacacacacacacacacacacacacacacacacacacagaatgagagagaatgagagagagagagaacactccatttgaagatgaaggcaaatattggggtgatatttctacaagctaaggaatgccaaagattgtgaagatgggagagatgcatgaaaatggccctcctttgtagccttcagaaggaaccaaccctgttgacaccttgatcttagacttctagcctctagaactgtgagacagtaaatttatgctgtttagcaccaaatttgtggtactttgttatggcaacactagtaaatcaacgtacctatttctctaccatacttctcacattctcttattcttgctgtcattggattgtgacaactccatctctgcccccctataatgagtaagcattcaaaattgtcctcagctctgtttccctggaaatataagctaatatagcctttattcctatttaaaaataagtgtgtagttagacctgggttgagcactgactgataaaaagaaatatgatatgtcctcttcttgaaaacgcctacagtgttcagcaagactaatctaattcgtaagaccactagaaatcagcaaaggcagaatgttgcaggtttgacatctacattgtgatagagttcaggaaagggagagttacaccataagcctccagaactacaaaacaaactattgactatgagaaattctattctatctctgtgttttcctcatatcaccaaaaagcaagagttcatatttggcgtattctgtacatattttttaattcttacacatgagtgtgtggcaggcaaaggggaatcattccaaataggaaactcaggcatttgtaaacaaagcctcatgttggtaattcaaagtaattagtgtttatgactgtaggagtctggagtatatgtgatgaattatattaatcgggagtgaattgatactggagggtaaagaaggataatttctccagctaagagcgcatggccagtagctgaaactgttccccagaccaagccattacatctatcaaaaggcgtttattaactgcttattcacacatcacactatgctaaatgaggaaccaagtcttaaaactcactttcttaacttgtgtataatctatactggtttcaaagaaagagcaagaaaacttcacttgaaatttagagccttagagcttttagagttcctttaaagaaatctttatatgtaataatacattttttttggagaagaaatcaattgagatctcatttttcttgttcacgttttctaaacatttccactgttagtggttcacataaacttgtttatgtgtatgagttattaatatatggattgactcaaactctctaaatgatttttgcttccataatatagcttcactaacctaaatgagttgtcgatagcaataccatggactgtaacttctgtaataccattgtcttcactgtatgtggagtgcctacagaaagcctgggtgagagaaggtatataaaaaacatctgttgaatgataaaaccctcattcctggttggatccaggaaggataattttttcaaacattcctgtaaggaaagatgccaaaactttttgagcacctgtcatgtcccaggctccctactaagcactttacataatctcaagggatatcccttctttcactttaacatgggtgcaatagcatttacttatctgtttatagcaatagaaagacttaaatactgctgggcatggtggcttgtgcctgtaatcccagtgctttgagaggcttaagtgggggggggggtcacttgaggccaggagttcgagaccagcctgggcaacatagcaagaccacatttctacacattataaacaaattagcaggcatggtggcatgtgcctgtagttacagctacctgggagactaaggagggagaatcacttgagcccaggtagtcgaggctggagtgagccatgatcatgccactgcactccagcctggatgacagagagagactgtctttaaaaaaaaaaaaaaaagaaaaagaaaaagaaaagaaagagataggaaaggaaggaagagggagagagagagagagagagagagaaagagaaagaaagagaatagtatgcatgtgaggaacttagcattgtgtctggtgccaaacaaatgctgagctactggttacctttctcttctttttcttattacattcagtatccactgaacattccttacagtgattttccattactctttatatcagatgcagaaatgttgactgtgtttttggttagcatcatttataaggaaattcctccaggaagcacatcttcctctttgttgttcttcttttaatactgttgaatggaaagctcaccacaaccacagcctaggccccagagacctgtcgcttggactattcaactgcctcctaagtctaacagcttttggttttgtctcttgcaatagatactgctctttgcaccaagaaagctctattcaaaatataaatttgactatattattcctttgtttactctaattgccattccatacaaataaagtccagactccccagcatggcatacaagattcttcatgtccaaagccctgtcttcctcttaagacttatataattcagctgcttctatgcaggatgcattttcacaaatgtatatgattcatgatctcgttgctcaacgagtctgcactttggcttgtgcaggatcatctgctttgcagcctccctctctttccttatctttcttcacctagcctactctgctcaatctcttagacacagctcatgcatcacttcctcttggcagcctttggaaagcttaggtacccttccttaatgtttttttaattactctgtgatctgattatcaggaatttaggacattgccttcaaatcatccattagtgtctgttgctgccacaacagtctaggccatgggtgggcaaacttcttctgtaaagaaccaggtattagatattttagctttgtgtagcatatggtcttcatcaaaattacccagttttgcctttgtaacacaaaaacagccaaagacaatatgtaaattaatgagcttcactgtggttccaatagtttacttacaaaaaaatagatggcagggtggatttctccagtgggttgtaggttgccaacccctaatctaagcctcttgaggatggggatcctcttatctttcttagattctgtagcacctagctcagtgtctgtgttaaaggaggggctcaatcaatgttaattgaactgggagtgtactatgccctccaaatcatcatgtgccaggtgctgattcttgtttttattcttgcttttatttgaagtataatcaggttgctgttgaacatttttaattttgtaccaagcagatgtgccccatttgaagaacagaagcaaatcagtacatactaaattaccaggtcacattctaacacagagatctgcgcattctgtctgagcatctaaggcttctaattttctcgggtatcctattgccctcaaatgttgtggctttccttgaaaccagccagtgttgtctgtgaactgtttattgaaagctgtgtaactaagtacagtaatagaatttttcaatcaatactcaattgcagcaggagctggtagagagatttcagcagccataacatgctgagataacttggtgtcactaagaaatcaggcagcagagagcagtactaattgagttctgtcagtcatacatgtgggcactgggcttgaaatctggtgtagaagctatagtattatttaatgtgtatttggttgtgtaaacccagacagcaaactcatgtgaactcagctgaataacattcagctgttctaggcctctcataacaattttcttttttttttctctgtttaaaaactcagcagtatcctgtatgtgcataacataaaaggaatagcagtggtatttaattgtaagtctgggatagatggtataaagaggaaatataacctaatagaaagagaattggaagtcaaaagactcaaccttcaaattccagctgttctacctgttaactctgtgttttggctgtgaatcaagtgatagccaacgcatcggtttttctatctttacaatggggattatacctgcctgccttattagtgtttcagtgaacttcaaagcaatttttggctgtgaaaatgctctgcaatgatagttgttgttttatgagcaccttaattattctgcttctccaggaaaaaaaaaaatgtgtcaacactaagtgaattttccttgtaatttaatcctttaattttaataatttttattgaagtctttcccaaagaatgcacaataaactaactgctttattaaactgaatagtttatgcaaattgaacccatttatggctcagagttaacactgggatttctgcttctgtgattcatgttgtagctgtaggtgctgctgactgtgggatttacctgtgattgagcccagaagtagcttggtttagccttctggaaaaattccaattagtcactttgttaatttgggctatttgcctcttctgcaaaggaagatttagggaatgactgaaataatgttatagtttgaaggaacactgaacaccattaagtccaatcccttcttagaaggaaataaactgaaatcccaagggtttaatgagttgctcaatgtcacacacaaaatgagtgtttaagtgtaccctatccccaccttctgacaacattaacattaatgaacattttctcaaagctttactattttcaaagcatttgcatatccatatcttatttagacatctccaaagctgtgaagttgacagagcaggggccattctctccatttcatgagtgtcaagtgacttttcctcagtcacttagtgggtgtatgctcagggaaagatgctgggacatgaaaacagatcttctgaccacaggtcctagtatcatcccaagacattatgtttcatgctattggactatgccttgtctactataacatgcaatattaatgctgcataacctctgcagtagcacgacttcgctgactgctgtaaaataaatcatcttcctaaagatagaagatgtcttttcccaaatgagtttttcatgttccagagcagtttcttcaatatcactgtttgtgtgctttgaatttttcacagaacttacagccttatgtatgagatctgcacgaccagcaataggaataactggcaccttcatatcagcttttacctacttgcaatcacagtgtgcttctgcctcaaacctcatgtcctataactttttcttagcactttagattccaccaatactattagttgaagttcccaaatacatgatagcctgcttttgtgccatattagtaaaatgtgtttctctgagaactgttgcaaacctaagtcaaactggcttaagatcaccttggattttttggttcctgaaactaaaaatccagggatagagcaagcatggctggactcaagacttccaaattagtgtgaggaaacatctctctcttcctctgtctctctcctctttccttctatctgaatttttctgcattagactttgttctcaggcaggttctaacaagaagaagaaaagatggccactgctgggtccagaattatattagctagtgaattccattgaatcaagagtacttcccaccagccccaaccccacaatagcatcaagaaaaaattctctttgaattgattgagttatatacttccattcttggaactgggacatgcagccaactgtacccaagccatataaatggagagaaagggtaagagggattcctgaaataaattatatcaatataattcaattattaaatttaaaatattaaataaattatatataatttattatatatgatatataataatatgtggtatttgatataataatatatatgataaatataatatataatgtatgatatttgatatatatgctgtatcaaatatatattaattatatgatataatatcaatttataatatcaaattaaatatataatatatatgatatataatgtgtgactattaatgaagcatagatgcttaacaggaaaaaatcacaaaatattcactacacacactaaaatgcctatgccatgttcactgctaaaatgccttgctctctcacttacttgaaaaactcctacttcaccttctaactctactcaaaagccatttactatgtagatgatcttggggtaacttacagaacctctatagcctcttattataacgtggcatacaataataataaccaaatgttaagctagtttaggagattatatgcctgatccatataaagtgcttaagacaatctttggcaaaagttatgtgctctataaacttaacaatgctgctgctgctgttgctgacacttgaacatcatggagagacaagtgctgtgagggaagacaaagcagggtaaaggcacagagtggcagtggtgttgtttaagaaatcctaggtcatgcaaggcatttccgaggagttgacatttgagtggagaagagaatgaagtgatgctatgagctatgtgaacaacttggaggtgagtgttctagtcaaagggaacaacaagtgtaaaggccctaaagtggaaaagagtttggcttgtttgaagaataaaatcataacggggctggtcttggtggctcatgcctgtcatcccagcacttcgggaggctgaggtaggtggatcacctgaggtcgggagtttgagaccagcctgaccaacatggtgaaaccccatctctactaaatacaaaaaattagccgagtgtggtggtgcatgcctgtaatcccagctacctgggaggctgaggcaggagaatcgcttgaacctgggaggcagaggttgcagtgagccaagactgcgccattgtactccaggctgggcaacaagagcaaaactctgcctaaaacaaacaaacaacaacaacaaaagaaaccataacaggacatttactagaggtgtcatttttcttaagatcttcaattttatcttttaacaaattatggacatatataaaattaaacactgagtcattattattagtaagaatttctatccatttagtcacccttcttgaaagtttggagctgagtcaagtgcagatttttccaggcagagtcctgggagccagtggaaggtaaccaccggtgccttatattggcattggtagtatgtggagccaagggaccaaattgtgtccagaaaaggggcgcatgtctgatttgaagtaagtagttcaaaagaaggttgccaatcttaggagctggaaagagaatggaggataaagctttggaactgaaaaggctgagctaacaaggatatgacaggacaaggagtgttgtgacctgatgtggctagaagctccaagacagggtgaattattgttgtgcaacttgggttgcaatgtcttccagaataattttttctatttaatataagatatggctttctagatagaatcattaagataacattaggaggtagaggcatgctcaggctatttcccaaaccttacttctatttcctcagtagagtgaagactttggatataagatgaaatgtaaaaatatggtagaatatattagaacaaagaatgttctttgaatttgacatccttttagttagtcactgaacatgtggtattcacttacttatgtgtaccggaccctgtgctgagctctaggggagatacagaaatgaggattttagggctctttctcttttgtaagctggaataaaagtaaagtacatgtaaaccaataattttaataaaatgtgtctggtgctttaccattcatgagctatataaatttgataagatatttaagcatttatttcttgatttataatgtttggataaaaatagcacctaccttatggcattttggggtggggttaaaagaaaagaaaaaaaacagtgttaaaatgtttagtacattacctggcacatgctacatgctaaatgcatttttaaagggctttgataccagcaaggggttgtggtagcatggagcaaaaaatgacttattttatctgggcctggaaaaatccccataggactactaagtcttgaaggctgaattgataaatggggaaggaattacagagtgaacagtcatgtgaaatactaggaaactttctggaggagaattttgtttatcaaacaattaggtaacatatatggaaaacattaagagaaactttaggaaagttgggctggggtcagattatgaatggcttcatatatcatgtcaagaaacacttctttaagtaattacgaagagccttcacaggtctttatgcagaggagtgaaataacaggaaatcaggtgtgtctgaaccaacactaatgagatgtagaggaaagcacaaaaggtcatttggcaaccatgtgcctgggtagaatcacagaggatgattctgtattagagctacaactcttgggtgaatggaaagagaaaataacaagaggaaaaaaaaattcttgcttttaaggcaactggtatatgtgtgatgccttagacagctgtaggagttgaaatgtgccactcatcagtgatattattttatggaagctggaaaagcattaacatgtatgacaatagttagcctatccatggtctatatagttgcagggaaatgtaattcacaaacacctgcctgagtctatttggcaagtattgggagcatcaaccttagttttatcagcatgaaaaactgctcagggaatgtactgcattcaaaaaagactttgctgaaaaccccagaaaatggttttgaaaattcatggtgttatggttattggttttaattttaaatctacaatgctttctgtcactctgaaatgcctttattttgaaaaaataatacagaactcagtctattgtgttttcctagtaaaatagtgtccttttttttttaaagcagtgaatcagaggaagagactgattttgatcacttgagtttgggaatgtatatgttatattgtctgtggatagagagacctttatatctttgctgcttgtgcaaatgctacagtgtaggttgcagtacattgctgcattatagtttagcttggtgacctactgtagtgaacataagtctgagatcctagataggtccatgtgtcctcaatatggctgtatcttattacaataatgccctatgaagccaatattatgaatataatttgatatggccttttattaaatgtttcacaatctactatattgtaatcatttcaattaactgtgcacctcttaaaataattaagacttagaccttttacttgctgtccaacatagccaataatttttaaaaatctgatagatgataggacacctcagcagtcatgcttgggaggcttcaaacttttatatccagtgatcatcacatccatttttttctgatttgagacagaattaaaacatttttggatgatattttgattcactttatttaattatttagacattttctctcatgctcactgctttgatagtctttcttaatgccagtaattcttgggtataactattggatatggtattattctggatgttggaagttcctgatcccaattttgagaatcatcaaatggaaactaacagcactagtaatggctaataaaagaagagaaaaatgatttaactactgagcaagatctttttaaaaaaaaaaaactttaataaccactaatatttaacaaataccattgtccatatagttaagaatccaaaaggaaaaaaacttcattgcccaatgcatatgtttataatttcatcctgtgcattccattctgttgaagaacaaaatagaagccaaagcatttataaaaggccaacattaggtgaaaacacctgagtgactcttctggcaggtttaaatggcctggtgagactcgctaactctgctggttttttaagtttactctgggatttgtaattaatttattcaataaggagtgattgattatgtattatgtgcaggaattttgcttggaactggagacagagagttgaaagacaccatctgtatgtttcagaagctcaagaatctattaggctaaacagatcagtgggaagacaattataggacagtttgataaatgttatatgagtacaacaaagattccctggaggaatacaggagggactctgtactgggttgaatagtggacctaaaaaaatatgtccaagtcctaaccctcattacttattaacgtgaccttatttgggaataggacctttaccggtgtagttaagttaaagatcttaagatggtatcatcttggatttagcatgggtcctaaatccaattactggtataattggattggtataaatgatatcagtaataaggaaaatgagagggcaattcgacacagagcacctagaggaaagtcacataaagatgaaggcagagattggagttataatgctacaagccaaggaatatcaagaactgctagcagccaccagaagctaggacagagcacatggaacagattttccttcagatcctccaatgtgaacctatccagccgacaccttgatttcaaactgagtgaatattttttttgttggtttaagtcaccaagtctgtggtaatttggatatggcgactctgggaagctaatacaggtctttaagctagactggaggtctgggactggagatggtcatcaggtaattacaaggcctcccagttcagggaacatttcagctgagatttgcaggtcaagtgagagttacctgatttactaatgggaaaaataattgcaggcagaaaaaagtaagtgtaaatgcagtccatattatttccagtaaaaaaaaaaaaaagaaactttttaaatttctaattctataggtggaaggaaagagatatgctgctcacccagttttgtctactccggacaaagatctgatctctactatgtggtctaccttctgtggatctctgtagtacatagattattgtcttctctcacatctccacttccatcacactgattgaggggaccataaatttctctcctgaattattgtaatagcttttaactagtttatttgcattcaccattgcttatgccagcccaagttctatttttcttaacacgttagtcagagagagcgtctattgaaacctaagtaacataatgtcattctgtagcacaaaatcttccaatgcttcttaattgcgttcagaacaataaaataaagtctttaaacatcctaatgaccgtaggagaactgatgctttatgaattttctgttaccgtctcctacaactcagcctctgactcacttggcctttttgcaattcctggacatactaagtatggtcctccatgaagcctttatgctaagctattctctttgtctagagtactcatcaccacaccatctgcctggcctgttctcggtcttcctttatgtttgtgccaaaatgtcagtttattaggccttttgtgatcatcctaaataaatagtaacccctctaccaatatttcttatctcctttaccctgctttagtttttcccgtatcgcttactataatttggattattgtgtatttatttgtttagtttatatttttctccactagaggataagttgcatatgaccaggaacattatctgttttgatcattgttattgttaagtgcttaggagagtacttggcacatagtagtattttgattgatagtttttgaatggatggatgaacaatacatagaagattttttttaactgggaaattcatagaagcattcaaaatgtttgatgagaatttctgggtccatgctttattaggaaaaactcaataaattttaagtgcaatattacttaaaacagattacaaaggctgcagtggggtctgatattaattcctcatttcttctcacgaaaaatacacacaaataaattggggatggcccttaattggtgtggctttaataacaggtttgatcaattttggatcctgttcagtgatgttcttatcccccataggctagtttctattgcaaactgcttttcttacgtgagctctcttgtccttaattcttattactcttacagaaagaaagaatatagtccttgaggcccaaatgttattaaatgatttctctgggaaactttgcttctctcctgtgtactctgcaaatgttggatgaagccgtgagatgccacttctttttgtccctcttacctgggtactctgtgcctgtcctttctttgttttgatcataatacactaatgagattccatgttttctgcatactgtggatatgggagaagcactttaaagatctcaacatgaggacatgagtagattcctttccagctgagagtctgagttgagaatagctctccagttgggcagaaagatgaacattatggaaacttcattatagcaccctcaggaaatagtcagacaaggcatcttgcttgatcccttcatggccagtatcatgtggactaaacagatgggtaaaaaaagcaaattcagcatgattgaggaactatacctagttggataaggctatagaacttgctactggtgaacagtggaaagtaaaaatctttgaggtatgaggcacttactttcatatttcccttgtcatttaaacttcatcccaacttgaagaagaggtattcatttcacaagtgaggaaactgaggcacagaggaggtaacttgctgaaggtcacacaggtggtgattaaatccagatttgtctgtttttccacagactatgcttttacctccaccatgctgcctataaattagaaatacattttgagggatttgagcttaaacctttcaaaaataacattagcacaagaacaagggcagcccatgttgtagatgagatatagctaaacatctagaaaggcagatcgctgggctccagtgccagcggctgtgtgcagcatgaaagcagctattaatcagacacgctcgcttaagaggaccctgggttttgactttgaaggcagccaaagaaaggtcgaatatatgcttttgaattctacagcaagcagagctcttttgaattctttattttctaaaaatgataattaataattctaatgcttacttccttggttgagctcttcaaacatggaattaaaagtagtaaattttcaacaaaatacatatgacagactgttaaccccataaattagggtttcatttgccttaatttctcacatcagtgtatttttcccaagatggctttccccacatgtatgtgtctaataaaccaatgatgtcaacaataattagtacctttgaagcagctgaaacttaacgctggacctgtggttacattattcctcacaacaactatataaagaaggtgctgttttaacattttattttgtcaaaaagaagataagtcttaccgcagtttctagatgagcccaatgtcacatagctagaaaatggcatatgtgagatttgtgcgaggctccccacatccaggagcccattgtctgaaagaccaagtctctgcatgtgttaagtatttgaaggggtggggttaggggcagggacagtattgtctgcaggatatgatggctaagttgcgagatatgatggttttttcttttctttatttattgtttgtattattcctcttttcctccctccttctttctactctcctctccttcccgcttcacttagttaaaacttcaaaccaggtttctctcattgggtgaaactggcattgcttctcaggcacctgatgttctgctgaatcctgggtgtgactagaatcccagcacctggaatttagtctcagcctcataattaactttctccgggctagctatctaacttttctcctttcagcttccccaactccagaatgcagatataattacaaattaccttttaagattattgtgaagtgctttttaaacaaaagcagaaaatgctttacaaatctgagaagttgttcaggtttcaggttggagatgggaaacaaagaagctctcttgagaactctggtccacccgaattacccagctactatcactgcaggttggattcgtatttctttcaagatttaacatgtaattccatgcagttatataaagttgcagaatgcttttacctgggagagtttgctggaatttatctctttaaaagtctctagactgtgacctccagggctaatataagcgttggctctgatatagcagtgtaataggaaaccttctgaccttcttacctggggctttctcttcaactgcttttcacagatagccctttcaggctcccatttcctagtgctcctgtaaatgttgaatgccaaattttgaactgctttcagaggttttactgcaaagatataatttgatgttgctttagtgtcctagggagtcctgaattaatttcttgaattttgcatgttaaaatgtgaacatcatcttttattctattcctcttcatacctttttgtcttaatgtcccatcattttccttgctgttgattccagtgcccaacaagctctcaaagtctgacactgatgtgtgcaccagttagtgagaggcagactgcaaagagtttttgatatttgagaagaaaattctctgctatatgaattaacctagagaaaacggggctgatatatttaaaaagtgctcaccattttgagcactcactatgggtgggcactatgccaagtgctttacatgcactacctcatttaattccagttttaccagtatgatacaggttcccttattgacctgattatacagataaggaaggtgatacttcatagagattaagcaatttggcaaaatcagtcagcaaataagaagtgaaaccaggactagaagatagatctgtttctagaatcatgcttttactaagccaaaggctgtatggaagaagtactcaggtacttgagttgttttggaaaatgtgtccatgattgaccacaaggttaggattaaatactcctcactcctaagttcttggtgattatctgttgaattgcccttccttttaataaatctttcatttctacattctggagagtttaaattcataaaaactttttcaaattcagcatcagttctatggagccattcttgaccttctggtcagaagagttttccttcttggcacctcctcttgacttgtacaggcagtattgcttggatctctaagtcactacgtgatctgcacacttcattccttggggcctttgcacttgctgtaacctttgcctggaacattctttgcttgataatttcatggctcactcttttcccctttaggtctctactcaaatgatctcttttcagtgatcacccgttatatgtcaccctatttaattgcaaccttccccactgacacacttcccacactgtgtctgctttttctcctatcacttgctatcatctaatatcctatgtctcacatttattttacctgtctcttctccataagaatataaacatttatttattctgtctcttctctatgagaatgtaaacccatcagaaatatttttatctgttctgttaactacttgagccctggttctgagtaatctctggtacagagagggtgcacaatatatatttattgaatgactgaatgaaggactgtctgccttttttcacctttgacactgttgagatagggagctagataattctttgttgcaggactgtcctgtactgctaacctgtaagatatttagcaacatctctggtttctgctcaccagtagacccactagtagcagttgtgacatccaactgggataactgagagtgtcaccagacattactaaatatctcctgcaaatggggggcattgtcctccgcgcaaacactgttttagactcaaagatcctggagaacaggatctatattactagagcatataataatactgtagcgcatagtagatgcttgataatattttacaattaatttgtttattaaaatagtttttggggaacagggtttttggttacatggatacgatctttagtggtaattactgaggttctggttcacccatcacccaagcagtgtacactttacccaatgtgtagtcttttatcccttgaaccgctccctccttcatcctgcatccccaaagtccattgtattattcttaggcctttctgtcctcacagcttagctcccacttatcagtgagaacatacgatatttggttttccattcctgagttacttcacttagaataatggtctccaactccatgtaggttgctgcaaatgccatttcttcattcctttttatggctgagtattattccatgctgtatatataccacattttctttattcacacattggttgatgggcatttaggctggttccatatttttgcaattgtgaattgtgctgctctaaacatgtgtgcgcaggtgtctttttcataaagtgacttcttttcctccgggtagataccctgtagtgggattgctgggtcaaatggtagttctctacttttagttctttaaggaatctccatactgttttctatagtggttgtaatagtttgtattctcaccagcagtgtaaaagtgttccttctcaccacatccatgccaacatctttattgtttttttactttttatttatggccattcttgcaggagtgaggtagctcattgtggttttaatttgcatttccctgataattagtgatgttgagaatttttttgtatattcgttggccatttgtatatcttattttgagaattgtccattcatgtccttagcccactttttaaaggattatttgttttttcttgctgacttatttgagttccttgaagagtctggatagtagtcctttgttgtccatagttagtgaatattttctcctgttctgtgggttgtctgtttgctgattatttcttttgctgtgcagaagctttttagtttaattaagtcctatctatttatgtttgttattgttgcatttgcttttgcgctcttggtaattaactctttgcctaagccaacaactagaagagttttactgatgttatcttctagaatttttaggtttcaagtcttagctttaagtctttgatccatcttgagttgatttttgtataaggtgagagataaggatccagttttattcttctccacatggcctgccagttatcccagcaccattcgttgaatagggtgtcgtttccccagtttatgtttttgtttgctttgtagaagatcacttgactataagtatttggtgttatttctgctttctctattctgttccattggtctacatgcctatttttatactagtatcacgctgttttgataactatagccttgtagcatagtttgaagttgggtagtgtgatgcctccagatttgttctttttgcttagtattgctttgactatgtggggtctttttcggttctatatgaattttaggattgctttttctagctctgtgaagaatgatgatggtccttcgatgggaatcacattgaatctgtagattacttttggcagtatgtgattttcacaatattgattctactcatccatgagcataggatgtgtctccatttgtttgtgtcatctataatttctttcagcaatgttttgtagtttttcttgtagaggtctttcacctccttggggctaggtggtatatttgtaaggttttttttgttttgttttgttttttttgaggcagagtcttgcactgtctcccaggctggagtgcagtggcatgatctccgctcactgcaacctctgctcccaggttcaagcgattctcctgcctcagcctcctgagtagctgggattacagacacatgccaccatgccctgataatttttttttttttttttttttttggatttttagtagagatggggttttgccatattggtcaggctggtcttgaactcctgacctcgggtgatccgcctgcctcagcctcccaaagtggtgggattacaggcgtgacccaccgtgcccggcctttttgttgttgttgttgttgttgttgttgcagctgttgtaaaggggattgagttcttgatttgtttctcagcttgggcattgttgatatgtaccagtgctactgatttgtgtacattgtatctttaaacttgactgaactcatttatcagatctaggagctttttggatgagtttttaaggttttctaggtatacaattggcaaacagcaacaatttgacttcctctttactgatttggatgccctttatttctttctcttgtttgattggtctagctaggacttccggcactatgttgaatagaagtggtaaaactgggcattcttgtcgtgttccagttctcaaggggaatgctttcaacatttcccttttgagtgtaatgttgggtatgggtttgtcatagattgattttttattaccttgaggtatgttccttctatgtaaattttgctgaaggttttaatcataaagtcacactgaattttgtcagataatttttctgcatctattgagatgatcctatgatttttgcttttaattctgtttatgtgatatatcacatttattgacttgtgtatgttaaaccatccctacatccttggtatgaaacccacttgataatggtgtattatctttttgatatgctgttggattctgttagctagtattttgttgaagatgtatgctagtattttattgaagatgtatgcatctatgttcaccagggatattgttctgcagttttgtttttttgttatgtcctttactggttttggaattagggtaatactggcttcataaaataatttagggaggattccctctttgtcttttggaatagtttcagtgagattggtaccaattcttctttcaatgtctaatagaagtcagctgtgaatccatctggtcctggactttttttgttggcaattttaaaattactgtttcaatctcactaattgttattggtttgttctatttcatcctgatttaatctgagaggggtgtatatttccaggaacttatccatctcctctagattttttagtttgtgtgcattaggtgttcacagtaaccttgaatgatcttttgtatttctgtggtatcgtcgtaatatttcttgtttcatttctaattgagcttatttggacctcctctcttctttcttggttaatatcactaatgttctatcaattttgtttatcttttcaagaaccagcattttattttatttatcttttgtattgatttctttgtttcaatttcatttagttctgctctgatctttgttatttcttttctgctgctgcattttggcttggttttctccttgtttctctagttccttgaagtgtgatcttagatcatctatttgtgctctttcagactttttgatgtaggcatttaatgctgtgaacgttactcttagcattgcttttgctgtatcctagagattctgttacgttgtgtcaccattatcattcaactcaaaaaaaatttaaatttccatcttgatttctttgttgacccaaagataattcaagagcagattatttaatttctatgtatttgtatagttttgggggttcctttggagttgacttccagttttattccactggggtctgagaggatacttgatataatttcaatttttaaaaatgtattgaaacttgttttgtggcctatcatatggtctattttagacaatgtttcatgtattgaagaaaagaatgtatattatacagttgttgggtagaatgctctgtaaatatctgttaagtccatttgttctagggtatagtttaagtctattttttctttgttgactttccatcttgataatctgtctagtgctgttagtggggtattgaagtttcccactattattaagttgccatctaccttatttcttaggtctagtagtaattgttttgtaaatttgggagctccagtattaggtgcatatgtattttcctgtttgatccttcatctttatataatgttcctctttgttttaattgttattgctttaaagtctgttttgtctgacataataatagctactcctgctcacttttggtgtccatttgcacagaatatctttatctgctccattcccttaagtctttatgtgttaggtgagtctcttgaagacagcagatacttgtttggtggacttctatccattctgccattctgcatctttttaagtggggcatttacgccatttacattcaacgctaatattgagatgtgaggtactgttctattcatcatgctagttggtgcctttataccttgttctttttcccccactgtgttattcttttacaagtcctgtgaaatgtatgctttaaggagtttctttttttgtatattttgaagttttgtttcaagatttagaactccttttaccatttcttgtaatgctggcttggtagtggtgaattctctcagcgtttgtttgtgttaaaaatgttttatttctccttcatttatgaaactagctttgctagatacaaattccttgtgtgacaatttttttttttttttttttttttttttagtttcaggaaactgaagatgagaccccaatcccttcttgcttgtaaggtttctgctgagacgtctgctattaatctgatagattttcctttataggttaactgatacttttgtctcacacctcttaagattctttcctttgtcctgacattagataaactaatgactgcatgcctatgtgatggtctttttgtgatgaattttccaggtgttctttgagcttatcacatttggatgtctagatctctagtaagaccagggaagttttcctctattattctctcaaataagttttccaaactttcagatttttcttcttcttcaggaacaccaattatccttatgtttgcccatttaacagaatcccacatttcttggaggctttgttcatgtttttattcttttttctttgtctttgtcttagtgggttaatttgaaagccttgccttttagctctgaagctccttcttctacttgttctagtctattgttgaatgtttccactgaattttgtatttctctaagtattcctttcatttctagaagttgtgattgtttttcctttatgatatctatttatctgaggaatttttcacccatatcctatactgttttttaatttctttaagttggttttcacctttctctggtatttctttgagtagcttaataatcaacctttcaaattctttatctagcaattcagagacttcttctgggtttggctccattgctagggaactggtgtgattttgaggagtgttgtagagccctgttttgtcatattaccagaattattttacttttctttttttgttttttcatttgagtggacgaattcagtggagaggtctgaaactcaaggcctgctgttcagattctcttgtgccagaggatgatcccctgatataatgctctcccactttccccagagatgggacttcctgagagctggactgcagtaattgttatggctcttttggttctagccacccagcagagctaccatgctccaggctggtggtagagggggtctgcaaaagtcctgtgatgtaatcggtcttcaaatcttccagccatggataccagcacctactctgttagatgtgacagggaagtgaagtagactctatgagggtccttggttgtggatatgtttagtgtgctagctttcttgaatgctggttatactagcagtgaagttgtcacatagacacccttacgacttctggttagccaagatgttgtgggcattggaattaggtgtcgtcttcttctttctgagatcagagttattctgtcctgaattgctataatggagttggttggcctccagccaagaggtggtactttcaagagagaattagctgcggtagtagtagggggctctaagcttgccctaagatggccagggtaagtattttggtttctcaggcaaagggatgggccataaaactcccaagagattgtcttttgtgttaggctaccagggtgggtagataaatattatcaggtgggggaggcttacgcaagtcttggctcagactctccttgggtggggcttgctgcagccacagtggagaatgggggaatggtcctcaggtcaatggggttatgttccagaggggatcttggccacctctgctgtgttatatggttcatcagggaagtgggggatagcgagaggtctcacccagctcccatacagttggcgagaccagtctcactcccgcagtgctctgctcaggccttgccccaggccatgagctactcttctgagaaagctcctatctacagatgctcccacatcccccagacttcactcaagaaaatttgtacccagtcaaaaccactgccaatttcaggtgagagcttcctttgccccaagaccctttcccaattccactggttgcctgccccgaggtcccctgtgagatatagtgaagggatggcttcctggggctcaagttggaggctgggagtatgttcaaggtacttcctgtgctacttgtactttcaaatttcttgcgactccctaaacccatttcatctctaggtaaggtaaaatccttctttggtgatctggattttcagattgccaagtggagatgtgtgttcagaggtaggtttttccccctttcacattttgggcactcacagtttttcacctgtttcacagaatttgcttctttcaaaggattggtgaattccttcagttttcctggtatgtttctgcagtggttcttggaacaaaagatcatggtgtgagtctccaaatgctgttctgtccatacatgtgggagctacatgttagctttgtctcctatccgccatcttccccagaatctcttgatattttaagctggattgatctgactttaaatgtttatctcaaatattatgatatagttactataagactatcctctcaaaatttttattttctcatataataaatttacttcaataacaaatacatgtttattatcacacaggttcaagatgatatacaggaattcagaattgcaaaaaatgtgatcttagtccctaagaatctcacagtctggttagagaagcatatacactggccaaaaatgaaatgcagaggaatgcattatctgtctcctcaacccatgcctctcccatctaatttatcctctatagtagagattttctgcagaggcctggataataaatattttcacctgtggaggccatattgtctctgttatacctacattcatggaagatagcacttgtagacattttcttatataaatatttctaaaactaagagcaacatctcaatttgaagatttcaggagtaatgtaaaagacttcaggccaggcgtggtggctcacgcctgtaatcccagcactttgggaggccgaggtgggtggatcacaaggtcaggagatcgagaccatcctggctaacatggtgaaaccccatctctactaaaaatacaaaaaaattagctgggcgtggtggcgggtgcctataatcctagctactcgggaggccgaggcagtagaatggcatgaacccatgagacagaggttgcagtgagccgagatcacaccatggcattccagcctgggagacacagcaagactctgtctcaaaaaaaaaaaaaaaaaaaaaaaaaaagacttcattcccctatcctatcacaaaatgctatggactaaaagggtaaacaagtggtttttaaacttcagttttagtggattgcaaaaacaagtcattggatcgtagccgcactttataaatgatatagaatagagtacaatagagtagaaaatatcagaatgcattatacatactaagaatacattttatgtttctgtttatatgtgcatataaaggtctttaataaaaattttatttcatattcttctaaagttagcaatgcatagtcttaaactgactaactcaaataatagacagggcaaaagtctgtatgcagatatgtaggtggtaaatgattgtgccttaaggtaaccaacaaatccaagaggtagcagggagatgagaaggtgaaggggatggttcacagattctaaaatgctcctgcttctctgaatggcttactgcattctttttaaatattcagcctctcacctcagtgtgagttataaacaccttttcattttcttctattaagtacctttcctcaggacaaaactttgacctgaaatgtctcttttcctgtacttcacctggcaaaaagcccattcattcttccaggcccatctcaaatgctagctgttttgcgcagctttgcatcagtccaccgggcatagttaatcattttctcctctttgttctttcaacactgtgttcgtgctactgcagtagcatttatcacattttattatgcttggttttatatgcctttctctctgctattccactatgagattcttggggatggggacaattttcatgactagttgtagacttcccaacacccagtacattatctgcgcatagtaggtggtagagccctaaacggagaaagcttagtgatgtggttaagactctgggcttgaaacccaggatgccactgtgcagtggtgcaaacttcgataacttatttagcttatctaagccagctttctcatctggcagtgagtataatatgattaatcgacagtgttactgtaaggatgaaatggaattatgatatcaggctttactgcagtgcctggcatttgataagttttcaacaaacagaatttaccattagtattgctgtcattattattatgattactgttgaaaggacagtggaaatggctactggaactgctgatacaaacgtatatagtaactgatagtgtcaaaagtgatttttgaagtaaataattaaattttgtaatatactctgtgctttagaagagaatgataatatgaaaagcaagtattgtagacttctggatgtttgtttttatattcaactggccatgttactgatttttactcttatctttcctcgatattttaaactattttgggggagaggttgaggggggaggaatggaaaacaggattaaaataatacaattttgctcctgaagacacttcatcaacttaattgtgtaaagttggggcagaatttctcaacatcaccactattgacattttgggccagatcattctttgtcatatagggctgtcctgtgcattgtaggatgtttaaacattcatggtctcgactcaccaagtaataggaccacattgttcctcccttcatcttgtgacaaccaaaaatgtttgaggggcgtttgataaatatgctctgaacaaggtgaggaatgaaaccaaaaagcaaatgtaaaggtgatgatatcacccttattatttacagagctgggttggagaaatgagtttctgtttgtaaactgagctggcttgataaaaatgaacacagaagaaggccgacttatccgctgagttccagagaggaaagtgtcattaaagaagtaaggaaaactgataatgtctgaagtcagctcattctcaagaaagaagaatggcaggcatggtcctttgctgaacatgaccagattttaatgatttccttcccattttggattttaggcagacatggtcaaattaattataacctttggttcctgacaccttgtaatcactgtctataggggccagcttttatttatttaaacagttatttttaataatataattcatacctactaacatgctacccaaaataaagctggaaatgcaacaattgtcgcatcgaagcacatagagcttcccaaaccatccttctgcctcttccacttgagcagcatcatcctgatatttatctttctcaaatttaccaacaaaataaatccctccacctccatggggtagaatgagcaaagtcagcaggcagaggtcagaaattagcttcaggaaaatgctgcctcaaggaaaattcttcctcaaggaaactaggaaggaagaaaaggtttaccttctaacagatggtgttgaaatttgtatgtttacttactgtttcaggatttcagggtgtccctaggaactaaatatatgtcaataaactttaagaagattatgagaagtgtttagaaagtgaagggctattactttttattagtgtagaactgcttttgttgaattgagtacatggtgatggtactggacatccacaaacctggcatctgcaaacccaccttctcattttgttccccttaatacccacattttattttacatgctgagaatattttatattttaatataaaaaaagtactctttctgtggattgaacctctctcaaatatgaattttgtgattttattttcttgcacaatgaaaagagttctttcaatattagaagcataccattttacagttgatccaatctaacatctcctccagtgcagcaagttaataacaaatggcactataatgacagattcaggtttatcttactacacacacacacacacacacacacacacacacacacacacaatctatttttgccacacttcagaatctgggtagcagttgaagaagtaccaacatatgaagtcacatatccatggtacctgagtttctctgagttttcaaaggagctatgattctaagttgcattgcaaaccacacgatattacaaagggcactaagttaaggaaggagtgacgaggagtcctcactaaagaataagctccgtggcacagggatctttgccgtcttactgcagcatctttagaatctagaacataaactggttcataactgtaccgttatctggaaaagcagagtcctggtgataaataacaacaatcacatccagttcgtgagcacattccattggctgtgccttatgctgtgtgggtatacattggtaacttaatttaatccccccagcatgagtgttattattatcctcagctgctttttttcttgagaaaactgaggcacagaggagtggaatgatttgctgtagttcatacagttaataaatatagagccagaattaggaccatataatttctgccagcccatctcctcacaaactggaaaggcaatgtagcggtgacccagctccttgttttgcttctgccatcaactaaataatgctgtgcaaattaccagtcctctgcatatcagagtccttttcattgaaatgctgagttcatagtcaatcaagaagagcctgtccatatatgaataatccgtgcacaatctttagactaagatacatcagtatttctgatattttattacatattcaaagaaagcttgaattgatcttaatttccacaaagtattttatgtttttgatgacatatcccttctttatttgctttgtgttgaaattactttggtatattgtctaaggttcaactagggaatgatttcttggttatttcagataaagatcattaaaaataatgtgtgcctagattgggagaaatgtgactagtctcaggcaaaaatagaaattagataataggtacatgaacttgaatagctcttcatccctatcctttaatgcgacatgtgcaatttaggcattggttttttttttttttcttttaacttttagtcagttcccttagcccttatggaactattttaaaaataaaataaacctgcctttgtgaacaccggattgtagattaacccacactgtaacaaacaaggaaggggtaagatttcgaaggcaaagatgtcttcacttgaatcttgtctctgctactttctacctatgcagccttagggcacttgatttcagagcctccagttcaccatttctgtaataagaacaatatacctatcagatacctccatgaaaagaatgaaaactacccttgttaggaaacaaatcaagcataaatgaaaaggtatgtcttaagcccatcttggtgaaggtgaacaccttgtatgatgatgattacattgtattctagtatcaggtttatattgtctggatattagacaatttgttcctggtccgtgtccgtgtttcacagtcataacaattctgttatcagctaattttatttaacaggatatttatataacactatgtgccgaacaccattttaagttctttgtaaatgttaacttatttaatcatcgtactactctgtttattctaatatctgcacatccttagaacatcacagacatctcgtgctctcctcataaaaccctccactgtatcatcatttctacttaaagactgagtaaatcaaacgcatatacctacgatgaaacagcatcaagtctcctaaccaggtctgcaaaacttagatgaagtgcagtttcaactctgcactaaagaaacccaagctgaaccttctcttttcaagccctgccttcttttggtgctacttaaaactttttcttactggctttccatctgttatttttagcttgcaaaaacactttactgttctttgaaatgtcagtcaccacagcccacaaggtataatttttgggacaagagattttacctccatctctacatgtgtattttatatatttcgttttctgtgatgaacttaccatggtaggtactattttttttttttttttttttgcataggcgaagtgttctaagatgctagaaacaggagatgatgtttgaattctaaggtacacactatcctttggcagaggcagaggaagttgaaattaattgctgaagctatgaaatgttaaatcattcaagggatattaaataatgtggaaaacaacaatattgtgaggggttctacgtatttggaatagtgttcagctttctgaacacatcatgtggcttttgaagttacactcatattaattttgagtgagcatggcaaaatataaccatgacatttttctagggtgactttttcaaactacaattaaaatttaaaacatttgctcacctatctttcttgtgaataaaataaactcagggttaacagttgcaatatcttcattaatgagaaattttgcacgtttagtactctaaattcttggttatccagcaaggtttgatattaaattaactggatggaagagttgcagaattgttagaatgagagttttactatcagaacaacctgtaaaatgtagattaattcatctaacaaatcagttttgagcatctgctatgtgaatacatactgaggctacaatacagtggtgagtaaaaacaattatgctacttattcttatgggtcttacagttcagttgataaagcaggggatggtaataaattatatgtaaatttacaattgtatttactattgcaatggagaggttcatggagctattttatgctatgcaagtatgtactaacgggaactaacctggtctgggaaggctgacagcatagcactgggaaggagtaagaatagctttgcaatgcttatcaagaaaacctaaaaatccatacccttgggaccagcatttccacactgaggcatttttcataaaggaatagttcaggttgtgctaagcattttagctattaagacaaggcattgtttttattaccaaaatattggaaacagcttatatattcaaatgtaaatgattagttacatttatattataaatattaagctatatggactatcagaaatcttttttaaagaacataaaagtttttattgtcataagagatgtatagtggaaaagattaggttacaaaatagtgaacattagaaaggcctttaccttcatcctgaccctacccttcctagttactcaatttattctatttgatttcaaatgtataaatgagagtaaaagttatagcggttactactagctaccatttagcgcatgccagccctatgctaaacattttacatctgttatttcagttgatttcatataaaccagtgaaataggtattattacatttatttctttttctgtatggaatttttaaatgtatcaatacagatgtgtattccctatgcaacaaagaaagaattgcttcagtgctcctgctgtttaccgtgaatttatctattgcattttatctaagataaatactttgttctcttgcaacagctttctgtgaagagggctgcagatacggtggaacgtgtgtggctcccaacaaatgtgtctgtccatctggattcacaggaagccactgcgagaaaggtaatctagcttgttttatgggggatagggacaaagattggtagaaagattgattcagaaagaataacagctctttctttagaaataatactgtgggttgacttgatacattgtgttgtgacggtggatggagctctcccaaagtgggtaccttgcttaaaagcctcccactctctgaaaatagagcttcattcgccttccctccaacgatttaattttagcaaggtcaagtattttctctgctatagctcagtgtgcatttttagtgctaattagagataaagcctgatgaactgacctgcctcacttatcatctactgggtagcatcacacacagttattagaattataacaatctgctgtgtcaacggaatctaaattagcagcacatgctccttgcgtaaaaccacattaaataattccagcagcaggtttattggtgtgcttgagattttattctaatattggtttattaggaacattatcattcatagacctgataatataagccaattagcgtaagtaagattacattatgtgcaactttctatttgcaataaatgttgtgtttacatttggcactgtttggtgaaatccaactcttattgattggagaagccctcctatttgtgtataagtgaaatttgatgttcaatgccaatgtatgtgtcagtgcaaacaaggggtttatgacacgtaaaagtgaatatttcagtttgttcttccatgtgttttgttagggtaaaatcactgcattgtgtttttgttctggctctggaatgtcacacttactgcttttcatatcatagcacagaaaaatggaaataggatgtcgcatttattatccttactattacatgacgggggaggtgtcttcatctggtgccagagatataagcaaagttcttgtttcctttccttcatgtttagaagcttctgaatttagataacatttttttatgtgcccatttattatttctcaccctgaccaacctgttatattgcactgcctgtatatttatgaggcagtctaatccttttaaagacatgccaaaaggtaactaaaattgttcagtaaggaagtcagtgaacaatatttgcaccactgtttctatattttgtgacattatcaacaaataaaaatataacaaataataactgttttttcttaaaaaaaacatatgaaagaaccatgtactacctttgcgcagcgcaagagaattaccacatagagctaaagaattcttgctaaaagcaaagaaacttaagggtagcttaggacacatgtctttactgaactacatttaattttaagtaggttttttaaaatgaaaaaaaaaacaaaaactaaaagattcttactgcttcctgtagaactgctgtatttccctaaactgaatacacagaattaatggggaaagaatggtaataatgatgccaataatcatgaatactactactaatgatatgtcatttatttgcaataattgttaggatttttaaatgaatattttaagattaaacaaaggagttagatattattactcttatatgtaatcaaactaaaatttagctggtgtaagtaacttatgcaattattagaactgagaataaaacacagttgtatctcacaaagcctgtgttatcaaaccttgcatgggtttttcaaggatactagatggattttttattaaaatacatattcttgggccacctctccaaactagatggaatatcagggggtggtttcacgaatctgcattttcaccaagcacctcaggatatttaaccatagcaactactgtaacattcttatttttttacattagaaataactggagggaaacattaccttagaccagggcctgtgatcagtagcagaccaggaggaattgattatggtgtctcatgccttcttgatttgtcctttgtccttttctctgctgagtaagtgggtgattgcatcagtgcttacagtctggtttgtaatgtgaagtcagaaaaatataaaggagaaaatcaagaccagggaaaaagttagacagagataggcaagcatgggtccctatgtaaatattaaagttgacatggagaattgcatattcttgaactcttgcacagtcatcataaagggaaaaaatacaataaaacaagatttctctgcatttaatgctatacttcatctgtagcaaagtcattccacttaatattggccaatactcaaattctatcagatttttcatggaatgaatagagtacatagttttcagtcagttgtgtgcaagggatctaaataaattataggctaaacactgaaaatctgtgccattatcttgtctgagttattttgtcatgttgatcattagcaataaacattaaataagtctatttgccttcaaatagttgtgctagatgccttgagactcatagtgccaaaggaaaaatgcaaatgaattgtgaatgtcttgtggcatgattacactaaatctttcatttgatttgttttaattttaagactaagtaaatggtcccatttgagctatatagaatccacttatgtttagtctgaagcatgttctcttatccccctagttactggttttattcattgcttgcaatattcagcctttcaaaattcaagtacacttagtaaaatcagttaaataatttgttaaagaaaattcctgtctgatgttaataatcccacttgtgtttggtatgtaacacacagatgaacaactctgcatttactttccattgatgacatttcagtaaccttaaacttttcataaccccccttaagcaaacactttgcctcctttggtttctaaacaacgtataattctagttcttctcctacccttcaacttccttctctgtgtgcttagtttgatttggttttacaattagcatggagatgtgtaaagagaaagatgagtgaagaatcagtaagaggagtagttttgccactcttaggatggaaaagggctgctggtgaatgctctcttctcaacctggctaagaactaaaaggacagaatgccacacggatgtaatgtagccacctacaaaacagcatgaaacaacacaaagtcctcctagagaattttcacatgtaaaatcaaagagctacactaaatccagagatatgttaactgccacaaaacagcagaaaatcaccctctaagaagtatgtaagactaagttttctatttggtacttttttctatttttttttagtggctttaaacaacaaatgtttattatctcatagtttctatggtttgaaatttgagagcagcttagctgagtggttctagctcagggacttttatgagattgcagtcaagatgttgactgggccagtgattgtctgaaggttggggagtctgtttccaagatggctcactcatgtggcgattggcaggaggcctcagtttttcattttgtgggcctctccacaggctacgtgagaggccttataacatggccactggaatcctgcacgtcaagtgatgagaaagagagtgaaagcaaggaggaagctgtaatgctttttgtgactcaatcaaatgctgttcacgttggccacgttctgttccttagaggagactcactctagcccacactcaaggagagaggaatgaggcaccacctcttaaaaaaacgattgtcaaagtatttgtgggcatattttaaaaccaccacactgtgaaccctgttacttattctcaaaccttggctctgattttaaactccttgctttggaaccttttccatacctctcaaacttcccttgaaattttctggttttagtctttgactccctacatcttgtactcttgatcatggaacaggatatattgtttacttatctgacgttgaacagccacaaactgggattcagctaccaggctgtgtggaactgactgtgtgtgtctgtgtgtgtgtgtgtgtgtgtgtgtgtgtgtgtgtgtgtgtatggtcttctgtgtgtgcacatgcaggtgtggacttgcacatccaaacagagaagaaggaagaaggcaggagtttatggatgtgaatgtaggttgatcctaatgtgtgttcttaatccttttttcaacttttattttagattcaggagttacatgaacaggtttctcacctgtgtatactgcatgatgcaataaaatcctagatataggatgagtaatcctgtcacttaggtactgagaacagtactcaatagttagtttttcagcctttgccccctcctttcccactctagtcgttcccagtttctatcatcgccatctttatgtccatatttacctaatgcttcgctcccacttattagtgagaacatgaggtacttggttttctgttcctgtgttaattgacttaaaataatggcttccaatttcatccatgtgtctgcaaaggacatgatttcattcttttattactgtttagtattccatggtgtatatgtaccatattttctttatccactccactattgagcacttagattgattctatatatttgtgaatgtctactgtgaatagtgctgcaacgaacatgtgagtgcatgtgtctttttggtagaaagatttgttttattttgggtatatatacagtaatgggattgctggatcaaatagtagttttaagttctttgagatatctccaaactgctttacacagtagctaaactaatttacattcccaccaacaatgtataagtgttcccttttctctgcagcctcaccagcatctgttgttttttgactttttaataatagccattctgactggtgtgagatggtatttcactgtgattttgatttttatttctccaatgattagtaatgttgagcattattttatatatttgttggctgcttgtatgtctgtcatcttttgagaagtgtttgttcatgtctcttgtcaatggagttatctgtttttgcttgttgaattgcttatgttccttatatattctgaatattaggcctttgttggaagcatagtttgtgaagattttctcccattctgtaggttgtctgcttactctgttgatagtttattttgctgtgaagaagctctttagttgaattaagtcctacttgtcaatttttgtttttgttgcaattgcttatgaagagttaggcataaattctttcctaaggctgatgtccatagtggtgttttctagatttttttataggattctacagtttgaggtcttatatttaattctttaatccatcttgagttaattttttgtatatggtgaaaggtaggagtccagttttattcttgtgcatatggctagccagctatctcagcaccatttattgaatagggagtctttttcccactgcttatttttgtcaactttattgaagatcagatggctgtgggtgtgcagctttatttctgggttctctgttctgttccattggtctctctgtctttttttacaagtaccatgctgttttggttattgtagccatataatatagtttgttgtcaggtagtgtgtgatgcctctagctttgttccttatgcttagcattgctttgctatgcagtctttttgtttcggttccaaatgaattttagaatatttttttctggttcagtgaaaacttgtatcagcagtttgataggaaaaacactgaattttgtaggttgctttgggcagtatggccattttaatgatattgattcttccaatccatgagcatggaatgtttttccatttgtttgtgtcatctatgatttattatagcagtgctttgtagttctccttgtagaagtatttcacctccttggttagatgtatttcgaggtatatttttgtgtggctattgtaaatggaattgtgttcttgatttggctgtcagtttgaacgttattggtgtatagaaatgatactaatttttatacattgattttctatcctgaaactttactgaagtcatttatcaactccagaagccttttggtagtctttaggactttctagatataggattgtattgtgcatggagagagacagtttgacttcttcttttcctaataggttgccttttatttcttcctcttgccatattgctctggttagcacctccaatactatgttgaataggagtggtgagagtgaatatctttgtcttgttccagttctcaaggggaatgcttccagtttttgcccattcagtatgatgttggctgtggatttgtcatagatggctcctattattttgaggtgtgttcctacaatggctagtctgttgagagttttcatcatgaagagatattggattttatcaaaagcattttctgcatctatggagataatcatatggttttcatttttaattctgtttatgtattgaataacatttattgatttgtatttgttgaaccaacttcacatcccaggaatgaagcttatctcatcatggtgagttaactttttcatatcctgttgaatgcagtttgctagtattttattgagaatttttgcagctatgttcatcaggcacaatggcctttagttttcttttatcattgtacctttgtcaggttttgctattagggtgatgctgtctttgtagaatgagttagggaagagtccctttttttgattttttggaatagttttagtagaattggtcagctctttgtatgtctagtagaatttgactgtgaatccatctggtccagggcatttttgcatggtagaattttattataaattcagttttggaacttgatattggtctattcagcatttcaatttctctctgattcagtattgggagataatgtgtttccaggaattcatccatttcctctagatttgctagtttgtgtatgtagtggtgttcataatagcctgtgcggatcttttgtatttctgtgggatctggttgtaatgtcatagatcaggatttcttaacctagaagacactattgacattttagttcagataattctttattgtggagggctgtcttatgcattgtaggatgtttaacatcatccctggactttatccatgaaatgtaattagcagtacacctccagctgtgaccatcaaaaatgttttcatacctatcaccttaaacctttgtcgtttctttgtggtgagagcattcaaaattaaataaagcttttaaaaagtctctagtaaaattaaggaaaaattctccagacgttgccaaatatcccctgggagacaaaatttcatcccattaagaactcgtggtctagatgtagcattttaaaaagtctttttaaaaaatatgcatatatatgtatatatatatatatatatattatagataatcatgtctcagtgttatttgataataatatgaaaattataagctttttttgacaagaaaaacacttaataatctcttgaacatttttagaagtacttagggtttactgtgattagaaaatgcttaaccattcaagagccagagactggatgatatccatcatgtgctatgagaggcacaccttcttacagtcttaggaaccaggttggtatggaaactcagcctactctatgttcaccctctctcaatggtggaataaacatgattctccaactccacccaaggaacatgtgactccaaaccttgtgttctcctaaaggaagatagtatacttatcctctttcttagaagaaaaatttaaatgtatgtaataatgaaagaatttctcttatggtgtaagacttagacacacacacttgtacattttttttttttttttttgagacagagtctcactccatcgccctggctggagtgcagtgatgtgatcttggctcacagcatcctccacctcctgggttcaagcgattcttgtgcctcagcctcccgagtagctgggattacagatgttctccaccacacccagctaatttttgtatttttagtagagatggggttttgccatgttggtcaggagggtctcaaactcctggcctaatgagatccacctgcctcagcctcccaaagtgtgcccggccaacacttgtacattttaaggagaatttgcactgaaatgctttctgtattacaaagccactcaattaatcagtttttttggtaggaaattggactgggctgtaaatcaagttatttatttatagtggtacagacaagcctgccaattatactacatttccacattgtatattatatgaattatagagtgtataaatacaattgtgtagatatcaggtatctataaccagtgatttgtgaatcagactgagaactggacacaactacccaagttgtaggctagaacacagtctagtataaaataattggaaaaaatatgctgatgctataaaaatagcagaccttgactttctcctccacatttgttcagaaataggttcatttactgtaactattattaaataaactctcataagctttgaacctctcacagtatccaagtgtttttgaaatatagtaagtatctgatcaagaatatttagggatatcggtaaaaagcaaacaactttgaacagctttgttcattcacaatataattttgagtgattttctcctgttttgcttatatgattttccaattttcaaaataatacatttaaattatgtttgtaataacaaatgatttttaaaagcttaaaataaagagaacataacagtcaaaatttttcttagttacttgtgattttttgaaccttttctaaaggaaaaattttgcagaaaaatttattctactctcttttctgtgccccgcggacttgcaggtatgtagacagagagtaatagtttgcctgaagtatattgtcaatttaccaggtaaaaagaatgatcagaaacaaagacttctgtgctctttcatattttatatcttgcctgtattttgagagatccctatcagcatccatctattggtaactgctttacccatccctgttactgggggagattttaagaatttttaagaaggtgaatacttattcccctcccataacagagaatacaatatttattctatttcctctccagttatcacaggactgtggcaagggcatctggggggagaatgaatgcaaaagtacatctttacatccatagcagacaggagaattatttaacttttctcaatttgagctttctcaggttgtctggcacatgattacttgctcagtaaatggcaacttctatcatcaacgttgcttcttttcttgtgcctgatgctcagaaaggagtaagcagggcttctatggcatcattgaaaaagagaaatatgaggatttgaggtttctctgcattgcccatttagttaaacccactagtaaaaggagggttgcaaatgctcttttaaaattctattaaagtcaggtaaatgtgaatatggtttgaagaatttcctgtcctggatgtttccagaaattaagaatggcagaagagaggcatcaaactagaagatgagaggagcttaaacctgctaagactgagagaatgtgatcatgtttggagcagctgagaagtcttgccctgttcagtaacccctttcatctcttcagttctacccactcaatgtttttcttctttcttgaatgacatctctgctaaagatccagcatacttcccttggatgaaaaatggggttgacacacagttcttagagtcacttgaagctatttcacaaccctgtccttgatcctgcaaggattttcatctttccaggttgcagacatatggaaaaatatctccagctgtttttactctcattgtccagacaaacagcacattttcaagtcatttcaattaactggaaacatcaatgcctttttttcacaaacaagaatttggacgagaaaataaagatgcagtctagtatactgaaaagagtactgtattgatgatcagaggcctgagttttgatactaaatctgcctctgtgaagtgaaatttacattaatctactatacatctattgtaagccccaaattttgcatttattatttcctgtgagggagttacttttatccttttggacatatatgaggacatgtataagtgtcattcagccagtcagtagtcaagttgagattctaacccgtgtattgctgaatccaaatttcatacactttgctttataatctgctacctcgtgatcattttgtctgtgcccaagggcaattaaacttaacagattatacaggaggtaaagtaaattatgttttcctgtgagtaatgagccataatctcttatttgatcatttgcattgttttacatattcctttcaacatttttgtgcctaagacaggaaaagagtaaacaaaaaaggggtgaagagcacaatctctgaagtcacactaccttagttttagttaagctgccactatttacccagctctgtaacactggatcagatttacttaacgtttctaagtgtcggtttgccactaaaaaaagaaaagagatgttgatattacttacttcataattttattgtgagattaaatgagatattgtacttaaaatacctggtagaaagcctggaacacagtgtctagaaattgtagctagtgataactttaattaaccaggggataaaattgagactcagaaataataggctgcttgcccaaggatactcagcaggtaaacagtaaagccatgtcttatatttatcttttgctactgaagtctctctcattcttctatcagttcttacaacctctcactgtacaattcaagtgtaaagtgattttatttgtatcatctttccagctctattctctctgttcccacaaacattttatgtaacatcttatcaagctaacaaaagttaatttatgcaacagagttctgctctggggaaagactgagctgattcagcacctggaatagtggcatgtttaacttgggtatggtccctggaagggattttttttttttttttttttttttttttttgctattgtttacttctcatctcttggagttaaaattgaagatttaacagcaagttctcactgtattattgatagcatgggtgactctgtacataggaagagttgagatctcattcaaaaggctacccacttatccttctacaaatattttcttagttcttcgttgattcctcaaattgaagaaaggcaaacattctaattctcaatttggcatcaggaaacctggattctattctccgattccactactcatcagcaatgtgaatagggacaacctcagcttttccatgtaaaatgggagtaatcatccaaatatgtggaaggtgactaatggttaatgcaggcacaactgatttttacaagtgttgcaaacatagtttagtacccaactttgggacgtagaaatccttaacaactattacattattgtctatcaaaactctggcatgggaaaaatcagatttttatatcttgttacattacatttgaattcagtaaacatttgataaatgaataaatgaataagtatagacaaggaccctcaatttcacatggtccattcttttgattttatagatctcaagttgtaatcacttcaattcaaaccttattgaaaagacacctaagttaaagtatattatatcaagaatgggggaagaaatgtcattaacaagaatagaatagaaattttggtctatttcaaatagctttgtcagtccacctttccatagggccctttgtaactttaccattaatgaagggagctagtcttttaaatagattggcattctctgtcaaataaataaaagctgttagagattaccttgcctatttagtaatgcagaaaataattcttgactaaatgacaagcagatcctgcttctcaccaagcaagcacacactactgaactgtgaaagtcaagagtttggttcatatcctcatttttaatcctatatcctgggaaatacaaacaccactgtaactttaaacacaaaggataaataggaagaaaatctagctttctgtgaaaccgtgagcaactggagcccagaagttacaaactttccctagtaactagccataagtctttgtatccaagaatatgcactgcactgtaaatcatgtggaaaaaggctaattgaagccaatagcctaactcagaaggaatgtaactcttatgatttgcatcatttgctcctagtaggactgactgaatgatcagaaaaagtagttcctgaaaatattcacttagatacaaagtatgatgaattgattaatcaaacagcaaggtctatgcatttattatggtagtgtctgaaacgataagcagtattcggtttttttgggctaacgtggttttaaagcattttccagtttaagagagaccttgaagttatctatgggtggcagcaatttcagctaaataggttgagtccatgaggggagatcctggaagattattttattaaagaatatcttactaagaaaaacacttcaggacctcctcagtgcttaaaagataaagtccaacttacataatatctaaagacttccataattgggcctcttcctacctctccagctttatctcctacttctccttaaagaaatcttaaactgcagcccattctaaactacttcaagtcactgaaatgcaccttaatttttcaaacctctgagcttttgtttggaatactctttctgactattacacacctacagatttatatatgtatatatatatataaatatatctgtatatatatttatacataagtatgatattaataaaaagaatagaaaaattagttattgagtgtttccagtaatccagaatagtcctgattttcccccctcaaaatgctttttttacaatacccaatattactaactaatcagtaccaaccaggcccgaccctttggcttctcaagatcagacaagatcgggcatgttaagggtggtatggccatagactcatattgcttcttctaagtcttctttcattatatttgatggcaaactataatctttcacattctctgggctgaggtcttgaaatcatctgtgatttctttattttgcactgcacattcaaattctttggcttaacttttaaaatatatcttaaatcccaacttcatatgatctccactgctatcacccttttacatgacaacatcatcatctctaatctagatgatggcataaaacctctaactcatcctccttccactgttatgcacctgtagtctctttttaacatagtagccaaggggacattattgaaacctaagttatatcttgtcattcctctgcttcacattctttatagctccccattttcactgcgtaaaagtcaaaattattacaatggcctataaggccctagttactctgggcccacctgcctattaaatttgtttgtcctcaccattcactgtgctctccctcactttttatcccctttttctggccataattgtcttcttgattttcttttttttttacatttatttatttattattatactttaagttttagggtacatgtgcaaaatgtgcaggttagttacataggtatacatgtgccatgctggtgcgctgcacccactaactcgtcatctagcattaggtatatctcccagtgctatccctcccgcctctccccaccccacaacagtccccagagtgtgatgttccccttcctgtgtccttgtgttttcattgttcaattcccacctatgagtgagaatatgcggtgtttggttttttgttcttgcgatagtttactgagaatgatgatttccattttcatccatgtccctacaaaggacatgaactcatcattttttatggctgcatagtattccatggtgtatatgtgacacattttcttaatccagtctatcattgttggacatttgggttggttccaatgtcttcttcattttcataaaacatgtcagttatgttttccttactttttaaaaattattttattacaattttttaatgtatttactttcaactaactcacatcatattttccttactgctttgtttgcttggaatgttcttccctcagatattttcactgtcgcctccctcctatgaaaaacgtttctgcacaagcattacctcctcagacaggccctgacccctatctaaaataatacatttcctccttcccattgctgtgttattgttcttcggagcctttatcactctctgacacaatagtacttttcgtatggcttcactgcccagccagaaaataaactccagaagggcaggggttctgtctttgccattatatttccggagaccagggtagtacctagcacataggaactgtgtgaaacatttactgaaaaagcagacaatttaacaagaagaagctcttttagtttcgtattagtctctaaagccacaatactgttatgatacgtcttgggaaggataaaaaaatattgtcgtcaatcacatgcctgcattcctgatatttttggatcatatgtagccagagttatccttgatgtctccttctccctcacttttccattcaatcaatcactacagtgcatcttttttttcccctccatcctacctcctagtataaaccactcatatttgttttacgcctgaaatgatttcagaacacaagtcttcaagtccccagtcttactcctccctcacagaaatgttcttccggcattgcagccggtataatccttataaaatataaatataatcaaatgttttctctgctgaaaaaacttaaatggtttccagtgctttcattataaacaccaaccttcttacagtagcatcaatgactcgctccgagtagcttttccattttaacttttaatcaatattcctcctgcactaaacattgtcagattttatcaaagcaacaatctgcctctgtccatggtattgctctagctggaactctttggattttctttctctagtttccttctccttcccataatatccagtccccatcttttcctattttctcacatagattgtaagcttttcttccaagatacttttcagactccttgctcaagattaggttccctccagtgcactccatatcaacttggtttttccttcataaaatgtattacatttaatttcatgtttacttgttttctcttccatctcttcttaccacccatccctgtattacaaccaacatttgtttaacttccctttctaatcacccccacccccgccaaaaaaaaacccttcaaagtattactaaatctatgtagtaattattaacccagagtgtctccaaactgaaacactatttttcttttgttcctttcctgctggtgccattcttcccattccaaggtgttaattataggaaacataaatgaggacatgttggatttgcgtatcatgttctgaatgacagaagcattaacatctttttttaaaaaaaccttgatattcataaactagatggttcatttcaggaagataagtgagtccccacttccttccatagacaaagctgcaggctttcatagaacattcctgatcagataagcatggccagatatagtattttcctggttcttaaattgcccagcagtttcttttggagcagaccatctgattggaatggttaaagaactgcggactgcactattaagcacttttaaatctactgtcagcaaattattatggtactctgtttcagtaaaatgatgctaacactgaagggcaaggctgacatttttccagatgcttggtctccagctatgtggaaatactgcattcacttgtatgttctccataaattctatgccttcgccttttggagatgtttacatttatttttgtacatatatttttcccagtgtctttcacagtaccaatacttccctagtctctgaaaattagagtcagaatggtgaaggaaccatttaaacgacatagctcttatttaatgtttaggctagaccttcatttaagctagactttgtgctacaggattgatgtatgccacttaatcttcataatccagaaggtgagcattgaccaacatccttcaccccacattgctcgtctaatttcaccacatatttttacatcccttcccccgaccatgttttaaacatatcagcaatacctcagggcgtttgcacctagtgttctctctttctggggtgtttttcctccatatatatccaggattcatttcttaacctgcttttaggtctctatttaaatgtcactcattagtaaggcattttctaccattccattaaaattgcaatactgaatcttctcccagataatagcacctaatttccctgctgttcattttttctattgcacttttcaccattaaagacactaaaagtatcactaatctatcttgtgtattgtctcttcctcccacttgatggtcacccaccatgaatgcagagatttttttgtcagtgtttgctgctacagcccagctcttggaacagtccctggaactcagtttgcactcaagaaatatttattgaatgaatgaatcaatgattattctaatttattgggtaaactgagattatgtactggtaaggtagtacggacaagattataggattaggaggtgtcagagctgtgatttgaacagctctttgtgcctcaaagctcaggcttttaaaaacttcctttaccactcttctcacaaaagcaaggctgaatacaacaaaagttttgacaactgcaagagctcatatcttctgtgttttttctcaattgaactctgaattctgagtgtgttactatagtaaccctatataccatctacaccacatcgatattctgagagactttcttcatcattcttaggttaatacactcttccttgtaagggattgctataatagtaatattttatattagtgcagatctttaaagtgtctagtgcatttttccaggcactatattatctttttaaaaaatctcataacaatttaatgaggattatattactgtcatcatcctgattttacagatgagaaaattgaggctaagaggttaaagaaattgcttatgtttgtaaagctaagaacaaggggacagctggaacttaaattcttgtctggtgtttaaaattctatgtttttttttttttctggtatgccatactgccttcagccttccttctacagaggtgttcatttttcttgggccaaatcattaatatggaggttttatattgaaagtgtcagaaagatgacattgtaatacctgtagccacagggcatttctacatcggggcagtggggtcacaatatgcctttttgagctgggcattttttgccactcaccatgtgaccttgatcaagttatataacttctcaatctgtatctcccaatattgttataaaaattagagaaagtctaattagcaaacagtaggtaatataaattagtaggtagtgaagagtcatagggtacaaactgttatctagagcttctgtatttgagaacaagaacaattttatcagtcatagctaatatttctatagttctttatagtcacagacactttcaaagacattttctctttgcagcatctcaacaaaacagtgtcaagtaagtttaattcccgtattacccacaaagaaatacattcatataggttaaataattcatgtaagttcattctaatatgaatcattcagttccactgctccaagctttgaacttgaagtagaatgaaagcaacatgagcttctcaatgatgcctctttcttcaacagggatgaataattatgcattatcctaaaaaatccccacatgttaaggtatggtgtaatacatccccagagaaatacaattttaaaacccagagggaaataacatttccggaaagatgttctcagatatctactgtaccaacagtttggaaatttctgaataggcatctaaaattagtttcatgtatacctatagatccttccctggttgaacactgtcatctttctttttttcaaggaaaacttatttttaagtcaagtaagtacattccaatgacaggaacactacactcgtattttcatgttttaatagttactagtcccccatttgctggttatctaagcagagaaccttatcatactcttcagtctatcaatatatcaatagctagtatttttcagatgggtctgtgccagccaccattgtagtacttaaatggattataggatctatgcccttattattctctcttataggtgaggaaactgaggcttgaaagaggtaacatgttaataatcacacagctgtttgttaggtttgagactgggatgtccatctatggcaaaataggcagtttctggttttctaagttattaaatatctgcattgttgaaagtattcctgaaaaataatttatgcttttaaatttaagtcactctgtctttctctcctcaattcttataacctttagcagaatcattattcagtaaaactttggattagtaaatgtcacattctgctctcccttccttaaggctgctctcaagccttgaaataattctaagagtacagaaagagggaaaagcaggtctggaaaactcacaaaaagttaacaaacttttgaaaactatgatatgtatatagaaaagcacaccaagaggaaccactctcctggcttccaacactccaggtcagttttcctgtttttaaatgttgtacaaatcgaatcagactataaggcctgtttgtgtccagatccttttgttcaacattaaatttgtaagatttattcatgctgtgaattggttgtaatttgttatttctcactgtggaatagtattttattttgtggatatcccaaaatgtattaatccatttcattgttggacatatgggttgtttccagtttgggctattttgctgcaataactattcttgtatatgtccttgggtgaccatatgtatgtatttctatatacctatatatctaggaatagaattgctgggcatgcttaggtgtagttttagtagatactgcccagtttcccaaagttgttatacccatttatattcctaataacaataaatgagaattccaattgcattgtaattttgtcagtacttacttattacctgcctttttcattttagccatactggtagtgtggtaattacattatagttttaacttgtacttcactgaatgacttacctagtggaacatatatgcttattgatcatttggttatactggcttgtaaagtacctatttaagaatttggcccttttatttattgtgctacctgttctttttgaaagcacaaagttttaaaaagtcaaatagttctataagattggctatagctccttgctcctattctattccagagtcaaacattttctttcccatctctataataacaatgataataataataataataataaataatatatttacattactatttctagagttttttcagttttagatgttacctattgacttcccaccatggaagatgaggagttcttttttcgaccgctcatccacagtgtgtgtggatgaacacacacacacacacacacacacacacgtgcgcacgcacccaaacacttcccatttctctattctgtatattagatcagtattcagtgtttaccttattatgtatatgtaagcaatatttataggtgagctatgaagttggctattattacttctttattacacaaatgtttgctttctctggatttaatgattacctaattttgttattgctgtttgttcagtttttcattcactcaatgttgggtcaacctcagattctctgctaataataatgtcctcccaatacatttacatgtatttgatattttataatgttaattccatgaaataaatttttccagaacattctgcccacttcattctatactggaagctctttctgtctacaacacaactgtttccatgaggttttttttcaacatcatctcttttttgttgttgaatctcctgttcctgaatcctttgtatttatccttttctggattatacccctatctttatagaacagattttcaattaacttcttgaggaagggtgcatagaaactaagttgttcaaatgttgcacatctgaaaatgtttttattcttcctttctacttaattgatagtttgaacgggtatagaattctaggttatataaaacatttttcatcagaatattgtaggattaagtgtgttgtcacattttttagtacaacttttgagaaacttaatattgtcctattcttgttaatttatataaactctacctttctctctctgagaaactgtggccgttttttcatcctcaggaaatttgatgatgatgtggctttgtgagcatctattgttaaatcagtgggctggagactttgaaaaacctttcaacttaaaaatccctggtttcatttctgggacttaaaaaaatgtcccctacatcttctctgttctttatttttggaactcttattatttgggtgtcaaacctttcagatttcttttctaattgtgttattacttctgccttacttttcatatttttctttttattattatttttttctttttgtggggtgatggaggagacatttcatcaacattatcttccaaattaattgagttattcattcaatgtagctaccctgtttcattattgctttctgaatgtttttgagacagggtctcaccctacccagtctggagtgcggtaatgcagtaatggctcactgcagccgggctcacgtgatcttctcacctcaacctctggagaaactgggactacatacaggtgcatgcatttttcccttatcttcaccttttcttaaacattcagtagtccttggttatctgctgatttttcagagtgccacttatgaaaagttgatttaaagctcagtttacctatgtgggatgctgatgtcaatgattttaggttcattcttttgaaccattcagatcttgtagggaagagtctttctgtttcctagaaatcaatcctataaattaattaaatttctggagcaattaaacttgattgctagcattctgagagtcaggtcggaagaataagacaaaagattgtaaaattcagtttgtaaatttttaattaatacccctgtctcagtatagtatttctgctctcaactatgttctgacctttgtggtaccctctgctgagactaaatctctagtgtttgctggggcaaaagaaaggcagtagcctggctggggtaaggaaacagctctgaggaatctaactgctttttaatctagcttccaattaattttcctattttagcttcactgttccccatagtttcagagatacttgatgccaccaattactgagtcctatgcaataagttgcttcttggctttctccactccaggctatgagtcattttctcctgtcttctaagtgagttatcattcatccacctcttttctagattccaaaattatgttacttttatcatttctcctgtgtgctttacccaagagggtttatatcctttataatttgtctttagtattatctcgttagagtttgaggggaaaagtaggggtaaatatgattatttaagccagtatctttaaccaaaagctagccccttagttctgaaactgtttctttcccatagataaaaagtcacaagaagtcctggtcattgtgataacttatatacaataataatataactgaccataaagatagtcatatgatataaaatgtcatccactttcaaagaaaaaaggttaatggaatgaatacaattttattttatactgcatgacatttactctttacaaaaatttatcaacagagactttctgcaaagatagacatttcccctttggaagtagagtatttatctaatttcaaagaccaatagagcattatttaagatattaaatgtttgaattattcttttaaatttgcaggatgttatgggaaattgggactataaactgccattccactaaagatagttaagtcagaatttttttttttttaagcaagagctatttcacatgaaattttatgtgaaatataatttcaagtgatttggacgtgagctttcaatggtttaaaatacgaccaatggaatgtaaataaggggaaatgggaaatggtaaagggaaatatagtgcataattggggttgaaggaccatcaagatgccacagagatgagctctgagatcagtcttatttaacaacttcattaatgatctggaaagagaattcaacaagttaattaaatctgcagatggtcctttgtggaagttacaaataccagggagaactgagaaatagtgtagaaagaccagggggtcaaaagctttgatagctgtgggcacagaagagcaaaattaaatttgggaagggtaattacaattaaatacactttgttcaatgaaaaaagtagttaaactgcaaacaacgctgaatagaaaacagtaaagctaaaaaaaattctgtggctgatgagcaatttatttagataagagcaaagctttctgactatagaaataaagttatttttaaataaaatgtactttataatgtatttgttctgtgcctaatagtcaaaaaacagggatttagtgacctgcatttggctagtgttaaaaagacaggaaagcattgctctaactctcagatgtgcttattttctagtacagtagatagattagaaactcatgaaaatactctaatatatcctgagattaagattgggaaatgatgggtagagcagtagagcatgaggggaacttttgaaagatgactgactatgaaatagttgacttccacttttaaatatgggtggttagtgttaacgtgctaggtggttgagaagattggcaggtacttttatatccttttctggtagtacctttgactatgggaagtcctctcaggtctgggtattggaagagcttctttaattttgaaaatgtgatcagtagttagaattctaccaaggcctgggggcagtagagcagactggatgaagttataatggtaattattagaaacggaaatcagatatacgcaagggcacacataggcaaaaggtcaatcacttactgagtatattgcctgtgccaggatggctccaagtacttcacataagttaactcctttacttcttacactcatcctataggattagacattattcttatctccaatttgctatttaaaaaatcctgaaacctagaaaatgtaagaaaattacataactttaagtgctaataagcacaggacagtaggattcaaacccagggagcctgcttctaagatttatatgtttattttccccagctatgttatagtatctctcatagaatattaccataaataatatatacagaactcatgtaaggtatatatacacataaatgtatacatatatatgtatgtatatagccctatatatgtgtgtatatatatggccgtgtgtgtgtgtgttccattctttagagttctaggggcttgtccaagacagactggacccagaggcatgttttatatgcagctcttattagcagaattgtccttgtatataaagtatgtgaacagaatttgttgtctacagtttccaaaaaaaacattatcttaaggaggtgtgtattgtatctgggttaattgatgatgggtctctggaagggagacacattagctaataaacacatagctgaaattacataatttcataatgtcagtctctactagtgtcactaagggtagaatcctgagtcatcatgttttaaaatttaaatattaacatcttcaagagttaacacttatgcatgctagaatattcagatattctataagcttagttaaggatatacattgaaaatctttatatttgtccacgagctacaagttctcctacccagaaggagccagaatcactagtttcttatatgtaggttaataggctaccaattgtagtgggactcagatagtatgtgattgtttagattgatgaggatatcttggagaggtatatacaagggatattaaatggatttgagagactgaaagtaaatttcacagttctatttgttaatagctagcatggacaaattacctatgaaaagtgtacagaaaaccattaagaaatagaaaaatgattaaaaaggacagctgtattggaaagcaacaagttaggaaggagaaatctagaagattaatactgagaagagctgcctggggtgactgacagctttagcctcaccatatctgccctctctttgaaactagtcagaatttctcaagcttctccaaatgagatcctgagttaagaagaattctgtgtttgtaataaggtgaggtggtttgaactgaaacttaatcacatttaggaaagtcaagtatcccttctgggagagatcaagcagattatgaaatgattttagagaactcataacaagtttcttctaacttttacatctatatttggccaaataaaacacatggaaagaaagtcctgttttggtccctggggcaaaagacttaagaaatatttctaacttctgtttaaatgattcagtttccaaggctcacttcacccactaaaatggcattggtgatcataaagaaatttcttcatgatacagtggaatcgcttctattattctagtaatagtaatttctctattatttactagtatacaggaaataacacaagttatgccacagagtgtagaaccttgagaaacattaaatattaaaagcataattctactttttgacatcagtggaaattacattggcctctctgaaaaaaactcctcgattgtgtctcaaagatggagcctgaaaaaaacaacaaaaaagcaacatcaatccaaaaaaaatcaaccaagtgtgagaatttattgattagaaaaataaaacaaacaaaaaaacaaaaaaagatcaacattagctgggatgacatgtaacctagagagaccaagtcaattcatgcagacttaaaatgtcaataccttcttcaattccagtagcaagtggttgcaacttctggctgaggcagttttcacttctatatacctggcaatggaacttccttcatcaaataaatgaatttttgccccaatgccttgtcatcaaagcatcaataattgagtaaaccataccctgtgaacttgctcatcacttacattgttacctttctcctaaagtaaaaaatctacagggcactaatctcgtaggacaggagctttgaaggcaagcattttctaattttccagtgccagcaactgaattcacccacatttatatgatttcttaattcattcacatataaaataatatgttgaagctcaggaaactcgtggcaaaaaatataaaagaatctatggttaatttagtgaataacaaatggtttcagaatgctagacacaagagcagacacaggttttatctcagcaagacagaagattgataaaggaaggactaaggaaatacaagatctggccacagggccatttatgaattgcagaacccacatgtattcgtttgtcacgtcaatggtttctgagtacttgccaagtacaaagataatttaaaacaagtgcatattaggagcattaggggagataagagaggcacataaataattattaatgcatgatttaaaagtgataaactctgtatgagaggtttagatctttggtagggttttagaaaaagtattgcttctgtttctgaggattggagaaaggatcaggaaaattgtcatgaatgaaaggcatgtgtacggaacattaaggaatgatttagacatatctaactcaaactggagaagtgacattccagacagagagaatgccataaaaaaaaaattgcagcatgagactgtacgtaacactgtggtaaagctgactaatttggtttgaaagctaggtgggattgtacttatttgtattaacatcagatgtagagggatgagttcctatcttttccctgatgattttaaggagtatatatgagaaaaatattaaatagtagcagagttgaggacattatcatctttctatcatgaaataatgtgtcaaaagtttcttcttaactatgtttgtagtaagtttttaatgtatcactttctttacaaaaagttctcttctttccagggctgtagcattttataagacacacgaggaatcatatagctgtaaagactatgctaactttttattgccatgcaaagtacatcaatgatttattgttctttaaataattagcatattaatatataacatgtgaagactgagcatcaggcatgaatagattcataattttttggtacctcttaaagcttccattgatttttgtcatttaaaaaattaatttaaaaagtagtatatttttattgtaaaaaatgggaaaatatggaaaagcaaaaaagaaaattaaaattactcagtctttatactaaaagaggaaatatgtatattactctatttacttccacctagtatttccgtgtacgtacacttctaaatttttgtcagtgaaaaatacatattgtattattttaagtcatataaaacacatataaattatatcacaaacatgtatctatattaaatattttataattacacaaataggttttatagccatgtgtgctctatcacattttaaatcatttaaaattataccttgatatggtttgaatgtttatgtttccctaaaatgtatgtgtttaaattttcaccctcaaagggatagtactagaagataaggcctctgggaagtgaataggtcacttttggatatgattagtgcctttctaaaaagacctttgaaattgtgacaactgcccttatattagaggcccaagggagacttcttttccttccaccatgtgaggttagagtgagaagacaaagctctcaccagataccgaatctgcttgaaccttgatcttggactcttctgtcgccagaattgtgagaaataagctacctagtctacgatattttgttatatcaggctaaatgaactaagatctacatattaaaaatagtatatttatatattatataaatttaaaatatgtatttgcaattaccaagaatcaacctgtattttttaactttgttaatgaatcataaaccatttttaatttatgaacgagattatactagtgaaaataaaggactttttggcttactcacctgagggtggtgtcctccactggcatgcccataggtggctttatagatgggcaccatagttccaagcatcattctctgaacgttggtacaaagtgtgtcccctgaggctctctgtatctttaaatgttcattaaaaaatatgacacgtattgttcctcctattctggcaatctgaaaaccttgtgtgattcactccgtcagctcttctgttgggtgattcataaatgtgcatgagtccagctttatagaaagtttctggagccatgggagtagacacttttgtcttggtgagaaaaaagatccaagagggagcataaattaggtttggaaagaatgaagtcaggaggaggatcaaagtagactcttcccaggcaaaaaagcaagggcccagataagacctcagagagtttgagtgaggagggcagttagaaggagcacaagatctcattagaacagagattctgttcctaccaatgatcagctggtctttacaatgtctggcagatgctcagtaaatggcctctgaacagaattgaattttaagttcctttgtataatgcttaaaaatctacttttgtttttacttcatattaatatcttcctgatttaaaaggttatttctattccattcctgcctcatgtggccatttccctatttctctttgcttccagttctttacacttttaagtgaatttaaagccagtcaatgattttcatagaactaattgaaactaacaattcccaggtaatccagttattcagtggcagttagtgacagtactcagaatggttgttacaatattcagatttgtcttttggtggtaagaacagccatgtctcttctgaagaaagaaaaaaaaaatattagacgagctcagcagatgtaacccactgtatctccaaacacttctcttgacgtttagctgcaaagggccaaggaaaataaagcattacaagggtggtaatggaatatggtaatggaatataaaatatcaatttaaggtcagttgtatatctacaagtagattcaactttgtgactgatgagtagggaggaagcaatgaattgggtgtttgggttcattactagtatctaggcattttgtcaagttgtgtcggtggttgacaatcgcttcagttgctatttaggtattgcaatgtgttagcttaaattaagtagccaagaaatgcataagatttaggaccagacacaggaacacctttgaattgttatttcaacattaatgtgtatcattaagcaactttcataacatgtttggttcttagcttcttcacctgtcaagttagggaatcattgctaaataattttttaaaatataaataaaaataatagccaaaatgtattgaacattatataccagatgcagatttaagtgctttcacatgtgtttgctgatttaagcatatattactaatttctccattttacagataagggaactaaaacaaagagagactaagtaatttaacccaagtttatatgggtggaatacggcagacctagggcttgaatttaagcaatctagctgcagagcctgtactctactgtcttttactgtgcaatacatctctcatttgtgaaagctatgataccgatgatggaaaataacggcgatgctgctgatggaagataatgatgatgttgataatggaagttgataagaacgctgatgttaactcaagaaaataacattactgacaccctgacctgggaaagtcgatttttcctcctagctactttaatgtagcattactaactagtttaggatctatagatgggatgtgtatgcaaatataaaagattatttctgtatactatgcattattggtgaactactctatgattgtataccactttaaaataacttttaattctgtttttcccttaattttcactcttcaagaaagtcaaccgtcacaaaaccatagtttgtgtcacagaatccttcccagaatctcagaattgaagatgaatattagatcctctctgatgcgtttcctaccccatccccactctcctcaaaagcttgttttcttatcaattcattctagtctgttgttgttgtttgcattctatgaaaagaattaactgtcacagaagcatccaattttattaaatgtttataatcatttcttattttctgatgaaatctgcctttttataattcagctattggtcctaggtctctattttagagccaattaggaaacgctatgtgacagcttctcaggaagtgaggaacattacatttattcccatttaacttccacttttgaatttgacccacaactccaggctgccagggtcataattctaccatcttgtatattcacgttctcctacctgtttaacgtaatcttgaaagttgataaacatgtgatgttctcaatgtctttacccatttcttgagcctagagaaactttcatttctgctctgcccaagccagactacattaaaaagataaatcagcatgcgcttatgtcttgtctgtgccacaaataaaagagaatttcagtttcacgaatacgtcaccctttggcataattcatcctatatgattgtactgaatttggctcttctccctctgtatgcccacctgcttcatagttagtgatccttgtccacagctcattgccagggtgccagggcacagcactaggcttagaaggcataggaggacagggaatggaagagaggagccagggaagggggatactctgatctggcctgtgtcagttacacagaaaataacacatttcatacaccagtgatggcagcaaagacaaatttcacagtatgtatttgaatgtcacagagctatagaaagaatgtggcaaagagaagcaccccatttaggctctattcctttcttgctactttaaattatacaaccctttctgtaatgttggctgttaaagctgaaataccacgtgctataaaacaatcttaatagaacatacaaagtgtcttttctatgaaaacataagattttttttattgaattatggtataagttcttcagcctaagttccttgggaagaaaaatatatatcttggtgatataagtctcctggaaaccataaagctatccaggtacaatgtaagaaacagataattaaaaggagcaattgggaagactttatttgttactttgagaaatatgaaatggcatttttctctaaattcttaaatgaaaatcgcttacttgacaaactaaagcccacgtgagaactgtgaagggcatttggtatttgtcctgcatcctactaacatcagcaatttagttaagttataacacgtttcctgtagtgacactagccaaaaagtgcaaactgacacaaaaatgaggcagggttggttcatcatctcagatctgctccaaggatcagtgagactgtatctggcaggtggaaacatgtatcactgaaacttaatggttagagaaagtaaggcagactcattagcatttctggcttaagctattcataggataagaaagcatgtttgaccttgcagtaggtaacatgaggaagcaccaggaatatgagtttcaagccaggcatcctggatatgaatcctgtctctgcctgccaatgactgtgatgtttgcaaactcatgtgatttttctgagcctaaggtatgaaatgagataataacctctactttacaaaattgtagtgaggagtaaatgcaacaatgtagatatagaactgtgcttgaacagagaatatttttaaatacagtttccacccctctcctttgatttaatttattaaaaacaggaaaagccgctttcatttaaatcttagaaaagtcttcaaatctggatatcagcatgaaatatttatagctggagtctcaaggaacagatgcacacttaggtaattcagcttgccttctagtccgtccttgcagttgtcaagaagcagccattgtaactcctggtttcgcatctaactttcctggcgtcaacccattttacaatttttatccagatgaagtttgacaattacactctagaatgattctactttgatctctttctatactttgagtacacccttttcctcacactcttctcaacttgggaaagaaagtaacctgaaattatcatctgtaggaaaacattgaagatttaaagcaagagacccacccataatatttgcgttttacagaggaaatttagagatgacaattttggcatgaaatgctggttttccaatggtgaaatttcaggcagtttcacaaatttatgctgtgtcagccattgcttgagtagccagatgtttttataaaatggccattcatcatcactccataaccagattgccaagtatgatcataaggaaagaaaagcagagttaagaaagaaaattagaactgtggagtattctaactaatgcttggtagaaatctagatccttttctttttttttttttttaaacaaaattcaccttttgttcaagaacaagtccttggtaccttagtctctaccattctattcgagtaaataagctttatctcctatgatgtgaaaggtagtttgaagtacagtccttaacctaagagaaagaaagatcttagtcttctattaggagcatatgaagcctattgaagtgtctgaacacttcccatttgctgctaaagtagccctgaaacagagctgaatattgccattctcttttaattgggtaaccttgcaaaggtgagagcagctaagagctagctgacctccttgatattggtcagtacctgaagaactgggctgtgactcttgtcaataactgtagggaagccacaaaaaccatcaagtaaaaggtagctgacctcctatggagggcactgtttgctgctgaggtggatgttacattgtataaaattgttttgaatgtacaggaaaagccacatactctattttcattatcttagattataaccctatgcagagcccctattttagagactggtaggaattcaatctttactgtattgaagggggttcttttctggagttttattaatatctgaggtctcatggggcacaaagcaattaagcatgtcatatagtctacctgtgtcagtgctgggaagctcatagaccaaaccttcagggactcttaaatctgaaggctttacaagtgacagaaatccaatccaacctatcttaaacaaaaatagtaactatttttcacattattgaaaagtcctggatagtagcctgatcttaggacacagctagataaaggtgctcaaacaacgttatgaccctgtctttcatatctggatgagtttcatgccccatggtgaaatgttggctgcctgccatcccaggcacccatccttacatcctggttcttctagtgaatataaaagacctctgtagctcttcaaaaaaaaaaaaaaatgtgcctttaattggctctcactgcactaattggattaaacagcagtaatagataattctgtatgaacaacaggaagtgaaggagagagcagtctttgatggaaagtcaagaatgttatcagaaaaaaaaggaagaatggatgttgggcatgcagaaacaacagcatctacctggacacagaaagtgggagtctttacaaagctgggatccccatttctgagtcctgtctcctgaagcacactatttagctatctccatcaattccagctctgtccttttttgggatgttaagaatgagcagctagagcgttccgtgacttatggactgtatcctcctctaacccttgatcaatgtggcggaaaatatctctgtcattcctgaacccccccccccgcaatcaaaaccactggatattccccccgccaccacgcacaccgattcataaattcaatctcattgttgaacttcagtctcacaaaacacatgtgacagtcaagcaactttgtgtctcaggcctgcactttagaaacagcctggctatttttggaagaagtaaagggggaaatataaggaagattgcaaacaatatctcagtacattcattttcctaccacatttgcctatacttatattttccttttactggacccacagtaggtcacacactcaaaatgaactggctgagtgattttattcttgctgtccttcagtcagttgcttttatatggaatttaggggcagactaatacagttcaaaggcattagaaggaactttagagtatgtggcccataagaaagcaattaaagtaagactgaattttctgatttaccttctccagttttgcttcatagatttctagattttgatttgggttcacctagtcctgatttctcaaaatacaagaaaactgaagcctaaagatattgtgacttgctcaaggagtaagaggaattataacttcccctttccaaagggcttactgtgatgctaggcactgtaaaatgatactttttgctactgaatcatcataataatcccatgtaacatagaaataataatcatgaaaattagaaattttaggcactcaacatgtaactaatatggtccagaactgggattaaaatttgttttacttgtacaacaaattgaagctggttatctgaagctcagcattactgctaggatctgtacctaggtctcctgaatatcagccctgggggctttcctcagtggtcccaaggggatcagactctcagtgtttttaatttctgcttctcagagaagtccccttactattcacttagggtgagatactaggacagattacctattctaggtcctccactcccacttcagcatagctgctctgtcttttcatatctgtaataaaggcaaggcaagtaagcctgtgtttgaagaaaggtttggggttaaaattctatgaagattcctagctttatgatctctaagggcacttttggttatggcttccgatggctgggtggttccacttgtagaccacctgggcccaccaagctctttttcaatcacataagccactttgatgcactaggttttgttgctgctccttggcttcattctttcctcttagctttgacactgtgcatttcaatgatggcttgttcagcatcccagcaatgacaaaaatgcatgactccaccaattttgtaaagaatataagagtattttggctttggttcatctgttttgcagttttgttttacctgttgtaaaaagaaacaggattccaattttttctgttgtgtttattatttcagatttgtcactgtgttctgtgctaacagaatacaaatggctgtgccctgaggtaactgaggtcaatggaaatgtttcctatgaagttaatacgagaaatcagattctgggccataagaaagttggccaaaacaaacagttctgttcttgtactatttccttctgtagcattttcattagctcctctgcagcatcaattatcacctcctaagcagatgactcaccagtctatattcttggaactaatcctttccaaactctagctccacatgctgctttaaaattgatttctcaatgtgttgaaagacccttgacctggtgaaagatggacacatcatctttcctcatcctacattaattccttctactaaaaatggccattattttccttcccccaacctttcctttctttgcaagcctgccccttgcaatatccaggaatggtgaacttttaactacattagtcctgatacctgggaagatgcttgctaggccagaatggacactggacacatgttggggaaactgaattctgatttccagggatttaaaaccacaattcatagactgagccaataaggttgtattggcccctccatttgtaagtccatacacagataggaacagagtggattccagacaaacaaaattcatagagaaacagaaataaaaactttgtaaaggaagctaatcttcaacaggagaagggagaagacaatgaaagagagagagagataaaaaatttctttatgattgtttagttcctaggcagattagcaatactgggctgaatgattttattcttgctgttcttcagtcacttgcttttatatagaatttagggggcagtcattgggcttgttgaaagttctgtacgtgtttttgattaatcatactgtctcttgaatttttaagtggtattttattctttacaaccaaattatccccaattgagggattgcttttcctgaattttccaataataataattaccagaagaagtagattactgaatgattattgtctcccagttatgatactacctagtgctttaccttaactttcaatctcaaaacataaaatgaaataaggattatattctttgtacaggtgatataatgcagttaagataaattgagcttcttgtccaaggtaatttagaactacatctaacttcagaattagacatttagccatcctacaaatgtatctcctatttctgttagtgctagtttttatcattcaggctcaaaagctgagtctctattcctatttatttttattgatacataataaagatttctggggtacatgtgatattctgacacatgcatacagtgtgtaataatcatatcagagtatttagggtatccctcacctcaaatatgtttcctatctttgtgtggagaatatttcaaaatcttctagttattttgaaatatacagtaaattattgttaactatagtcactctactgtgctgtgaaacaccagaacttattccttctacccaactgtatgtttatattcattaaccaacctctcttcaccctcctatccttcctagcctctgaaaactacttttatgaaatcaatgtttttagcttccacgtatgagtgagaatttgagtgaagctgtagtttaacttatttatgtttgattgttagtatccaataaattatctgaattctgtcttgaaatactatctttctggcaggtcatggtggctcatacctgtaatcccagcactttgggaggccaaagtgggcagatcacttgagcccaggagctcaagaccagcctgggcaacatggtgaaaccctgtctctaccaaaaataccaaagttagccaggcatgatggcgcatgcctgtagtcctaactactcaggaggctgaggtggaagtatcacttgagcctgggaggttgaggcttcagtaagccttgattgcacaactgcactccagcctgggcaccagagtgagaccctgtctcaaaaaacaaacaaacaaaaagaaatattatctttctaacattagctcacctctcagtacccctaggttatagtcatttggccagtctccctattgcctgtaaacacaactccttcaaatttagtatatgaattatttaccaagtttattccacagcccaactctagttacttaactctactccttataattattcaatgtctctctattacctaccaagaccagtaatatgtttttataccagccgtcaataccttatctagtatctctccaaattaccttttttttttttttacctcatctctcatccctctcacccacttcccttgccctctgatgaaacaaagttactaattatttcttcgaatagtcctcaaacattgctgcttctatggttttgtttctacagtatcctttatctaaaaaaaattttccttttctttgccaactgagatcctatcaactctctatggtccatttcaaatactctcatactccataaagtatttcctgattcttccagctgaatggcatctctttctccttggaacccctataatatgcttcttatatgtttctaatagagcttccctttcttttattgtgatatggagatttgtcagttgcacatagaggggtggcaagtgcttggtgtgtatatgattattgtgctcatggagagcagcatgagttgatcatagctctctttcttgagatcccaggtacttgcccagaatgcttcctcacttaacatgaagtcaaggaagccactcccaagtgattggagttaccatgcaaaatgaaattcaactggcattctcattatagtagctcccatctcataggagcttctaactactcccactcttcctaccagataccttgcctgggactcagcataactcttccattacagctgtagagagagttccagagtttttgctgagatcttcctgtctcctgattctccattttcttaggccagggcactgcttcagactacaaagaaaaggaggccaattgctttagggctttgagttcttttgctatagttttcctagaagctctacttacagacatatagatactggatcattaaaaattgcaattacctgaaaatttgtttgagttcattgtagattctggatattagccctttgtcagatgagtaggttgcgaaaattttctcccattttgtaggttgcctgttcactctgatggtagtttcttttgctgtgcagaagctctttagtttaattagatcccatttgtcaattttggcttttgttgccattgcttttggtgttttagacatgaagtctttgcccatgcctatgtccaaaaaagtgggcaaaggacatgaacagacacttctcagaagaagacatttatgcagccaaaaaacacatgaaaaaatgctcaccatcactggccatcagagaaatgcaaatcaaaaccacaatgagataccatctcacaccaattagaatggcaatcattaaaaagtcaggaaacaacaggtgctggagaggatgtggagaaataggaacacatttacactgttggtgggactgcaaactagttcaaccattgtggaagtcagtgtggcgattcctcagggatctagaactagaaataccatttgacccagccatcccattactgggcatatacccaaaggactataaatcatgctgctataaagaaacatgcacacgtatgtttattgcggcactattatcaatagcaaagacttggaaccaacccaaatgtccaacaatgatagattggattaagaaaatgtggcacatatacaccatggaatactatatagccataaaaaatgatgagttcatgtcctttgtagggacatggatgaaattggaaatcatcattctcagtaaactatcacaatgacaaaaaaccaaacactgcatgttctcactcataggtgggaattgaacaatgagaacacatggacacaggaaggggaacatcacactctgaggactgttgtggggttgggggagcggggagggatagcattaggagatatacctaatgctaaatgacgagttaatgggtgcagcacaccagtatggcacatgtatacatatgtaactatcctgcatattgtgcacatgtaccctaaaacttaaagtataataataataaaataaaaaataaataaaaattaaaaaataaaaattgcaattaccctgttaaagaacctaaaattcaggctatcacacctgttttaacgtgagtatagattttccgtctcgaaattataaggctattacattgacatcacatttattccccatataaactggtcagattttaccttaggtgagcagacactggtctagatgcaatctgtcgccttcttacagatcatagcttgacatttggaatactatattgtttgccactctctcacacacaaacatatgcatgacgatgagaaaacaaaaaatgaaagaatgcaagaaataattaatgaaaggcaggaagaaagagaaacaatacaaaaatgagtttaaatttttttaatttaggatattgtttcattaagattttatttatgttaaaaataattttcacaataatcacacatttcagaagaatatttgaaaaacaaaacaatcttgccttttcaatgttcttaactattttctgcattgcagtgttttcccccttcttttttaagtgggacattgtttttcctgacacagtggaaatgtaaattactttccctttttcactgttccatcatgtagacacaaaaaaacaaacctgtttgagagaccaagatgattaatgtctacagtgcatcaagtattcactacctgtgccattcatttcatttccactctactgtaaactgagaaacctttagttatttcgaaagtacattgccaactgagggaatacattctgagtaaatttcaagttccatcaggttttgcttaaaactctctgaggaggaaggcgagtagggaaagcagaggagagaagagaaaaagatggagaggagaggattgtttttccccatcttttatattttttattcttttttacatttccttttctgggctcctttccagcaccatattcacacaattcaataatttataacctaacataaatcagataccaaccacagttaaatgtgatttgttatatgtgtggatttctgtttatggtatctttattgagattttcagcaataagatgtaatatgtaatctctacctatttaaaagcttcctgctgtttgatcacaaaaatgatttgcgtctccttatctcagtggagagaatatttgatacaaggttgcctgccatgaagtctctgtggtgtagtgtgcctggtgaactgcctactctgcactggagcatacggcgtgtgccgtttctgtggaattagacgctatggctggtggctgataaatggcaatttaggtgtgaagggaattagcttaatataaactcagaatttcttcccccacccccaacagatggttcatatggtgatatcttctgaagagaatatagcctggccagtttgtttcccttaatataccagatgtgatagaagtagcaccaatttgggagtcagattccacaagttcaaatactggtaaccacacaattttgaatcataacctcaagggagatatagcacttttgactcctcattttcctcatctggaagtaaagaagtagtatctaattttcaaggttgggagaattaagtgagatacttataaagttctctagtgtaatgtccatcatagagtaggcattcaagaaaaaggaagtgttggaatcctgccatatatagaaagagaatgagagaaaacaccactttgtggtttcactggggctctgcaaacatgcctgtgggttttactttgttgtacagttctctggaaatcctgtgttgaaactacaacctggaggagtgtttgttttcatgcaatggcttaagtggtcacacctctatattaatgtgtgtctatcaataacaataatggcaataataataaataatacactctaacgaaaggctggaggagtaaaaatatttagtgggtgtttgtgtgaaaaagttatttgaggtctgcagttgcactgaaactacagtgagatgagtgagacccttacctcaggtaaaatctaagaggttgccaaaaaaactcagtgatcaagataaatgattttctaatgcagtatttttcaaaagagaaaattaatgcaagcatatctacaatggacaaatattactttttttaaaaagacgagattcaatgaggtatgattcaggtgagataaatgattcaggtgaggtgaatgattcagtagatttgattcagtagatcaaatcatggcacaactatgaggttcaatgaaggtgtgaataagtcagacagtgccttgttaggactttaagtgttggctgtgagatttttactgaaaagcagtttgatagaccttgctgaatgatttggaggtttgtactgatgacctttctcatcctgttgctttgtcaataatacatggtatcctagacttttgtgtgtgagttctgttcaccccaggccatagtaggagacataaatttgtgatgacagagtttgaagtacagtgctggcaagtttgcaataaagtatcaaatgtttaggcattctcaaattcaaggaaaatatcactctttgttttcaaaacagattaattgatggaaaaataataggatattttcctcatttagttattttctctgaaattatagttataaaaaattctgttagagatattttttcctgtttttaactcagtctggaaattagaaacatgataatgattttgtttggggtgaatttagcaaatttatagataggacataaatgattttgtaattaaataataggagctataatttataaatgcctactaaatgccaggcagtgaaccaagagttttcatccctatctgcttcaatactcagatgagcttcctaggatttgtcattttataggcaaagaaactgaaacttacagaaactgaattatgcaaaatcacccagttaataaatgacagaaccaagatttgaacccatgtttttctaatcatgatgtccatgcttagtgcattaagaccagagttagatgttgaacatttgtactttttgtttagagggaagtgtgtctacggaacatgaagtatcaggaagaaaatttacatcagtctcagagaagtttacctcctttgaagttttgggctgtgaaaattccagaaatagagaaatgagaataacctactataaactcagtggatagaatctaaccccttaagtataactcctggcctggggaagggagggtgacatggtggcatttgggtaaggcagaggcctgcagcttgccagctgcagaaagtctcatgagtcccatttgcaaccctcacattgcaacccttagccaaccagaggtatcccagggtatctgaagaaagcctccagttctgcagtcatcctgggaagtaattctggcccctgattatggcacactctctagtctcaacgacatgtatggaatgtggtgttaggtattccaacactttggctaataggaaattcatacagtagcaaaacatatgagaaactttattaaacaacaacaacaaaaaacccttgattgccaattcagaaggcacctgataccttttctgtggctcactgccacggttctcagtatcagtatcacgatgtgacagatgttcagccctgctgagtcatccagaattctgagggatgatggagatgcgagataaaccataacccaggatgtcaaatctggatggacaatctggacctcctcttatggtagttttgcaactgcatcgtggaaaaatgacactcaagggtgctgggggtgggggggagatatagtaaatgtgggcttcagcatctaccccattatccatcttagatgcttcactttcatggttctagaaataattttgaaaaaaaagtgtggctgctttgaaagacgagcttaaagaaatctctaatcaaatcctattccctcatcttactttcacaaaatctgatttccacagaggttctgtgccttgcctaaggcctcacatgggttactaagaatacggaaataggaacctagaccttctgacacctggcttcaggttctgtccttattttagcctgtgtctgtttgcacacctgttccaaggtggcccaactgcatggtcaccccttctcctcaaatcttacttgtatgtcatctgtgtggaatagcaaagcaatttctctgatgtagaaaaatatttttgagggtatggcaagatctcaacattaatttcaccccatgacctgtcacaatttgaatcaatccttccagaggtaaaatgcaggccatatttcatcagctgtcaggaggcagggggcatcagtggaagcatgtaaacaacattctggtttatattcctcatatagaggaaataatagaatgatcaagatttttttgttgttcacaatggtagtaaaatctttacagccctgcatttaatgacaggctggtatttctgaagccttacaacacaaactcacctagaattaaagactagggagaaaggaattcatgaacttgagctactgtgattattacccagaaaggctaattacatgtctaatgagcttgatacaggtgaaagatgtagtagaggttctctgctgctgggcctggtaagaggtctttggaaatgaaggtaattccaatatttttatggaagaagagtgggggagagggtgggtcaagaaagaaagaactgatggaactgatggtacttatagcaacatgatgtgctatgcagggtgttttggttttactcttttttattcaaacatacacacagcatttttggaagttaatggaagttgtgaataatatcttcaaaaatatttgcatatgtgtatatacattatgaacattttgagaatgagaaagggatttttagtgaccatagaaagtctcttcattgacttgtgggcattcctggatcacagcctaagagtcactgatacggcaaatggactctccctccggtgtactacctgtattcatgagggtttatattatacctgctaaaccattctcttctcttaagttcttcttgttttaataaaaagaaatcttcagattgttcataattataaaatataatgttttcttctgattatgattttcactgcatcatttgggtttctaagtacattttagggaaggggaatgcggctatgtgcaatgggcatttgataatcaaatctcctaatgtcagttgctttgggtaaggggaacccccagataatcccggaatagtttcaacctgtttcaatgcaggacttcccttcttcccaccttccctcctcaagcttctaataggcaactacatttactaggacaatttctatctcctttgctttgttcaacattagaatgaggcattaaagaataaagagatgcacccccctccctcccaaaaaaagcataagcaggaaaagaagacaactaaagagccacgataatccctgaggcacctcttgaattactcagttaaccataccaagtttatgctattcactcctgcagggctgttaaactacctgaaactagagtgagttggagctttgactgaggaagctgaacttgtctgagaaactcttatctctgaaagcacaaattgagcatcatttccttcaccttcccctgctcttgcacttagcaacttataaaagaaagaccagggccattagagaaagctgggtaactgtgcctttgcttgtcagccgtgtccagaggtgcacagcctgtggtgactaccttgaagccagttgccttggaggaaaactagtgatttaggcagggtagggtaaatgcctcttttccagacttaaaaggattgaatttctcagtatgaggttgataacaccagaccatctcatttttggcagtttgattgacaactttctcttcttgttgatctgtatgcatctagattaaaaatgtagtgatgatgccagtttatagatcattgtttcttgtgtttgtttgttttgcttatcattcatttcctttcatttcccccctattttttctatttttacaggaattgtcctggatagtaactgtcactgtggcgtctctttaattgatgacagctgagtacccaggctggggtttttaatcacttaatttgcaagagaggattacaccatgtttcccttccttttgcttaaacttaagaggttaagcaaaaggagaagggctgggggttttccattctctggcactggtgctagaaagcagaagcaggaaccaggtgtttgaaactcagggatgtatgccaaatgacactttaattgtcattaattaggttccattcatcagggactgttatttccatagtccttaaaattcagcatgttctccatcttcaagaggagttgggagaggacggagggaagcttcttgataaaacaacttttaatgctgtgtgcctgcaaagaaatgatgtctcttgcgacaattgaagtatgcattgttttggtctcctggaggccctgctgctgtaacactctaggaaggaaatatctttcttcagagagaaaatagaacgctacataaggtgttttcaagtgcttgatgattctgtgctgagagcaaagattgttgtctgttttcctacccacctcttgactgtaattgatctactttgctcagacttgggagtaatttaagaaaagacagagtttttaaaaatgatattcatagaagggtgatgtgctaaattaaatactaccttggatgggataatttaatgctgtaaccttgggtgaggctgcctccttaataattagtgaggagactggcttcataaatggtagcctgtaagggcattcatttccccttcaaagacatttagctcctgaacctgtgcttcctgcattaattagtcatcaactaaggaaaatgaggagaaagaaatggggaaatgttggccttcggttgcaaatatcttttccaaattctataaaacaagactagaattctttgaagaaagttgagatgacagataaatagattctctattttcactacttcctctttacttttaatctggaagatgttaatatggtgatttttaaaggatttccaaccactgctaaaacacatgcaaaaaacacatgtaacagcaattgggtcttcagaatcatacatctaatatgatggagctggtgacaggttattctaacagggaatggcactagaagcaacttatgggcagcttgacccatcttcatttgcagtgacacatatggaaaaattctaggtcctttgttttccttcaatatttagttgagtcaggaaaacaattgggtaaattgaattttatttaatttatatcctgtctcaagttcatgatgatgattaacctatgtaatcctcacaaatataagtttattttttttagtggatgagaaaactggaggagtacaaaattaaataatttgcccgaagtccacaactggtgtcagtggggacacaaaccaaggcagcatggctacaacttcatgcacctaaacagtataatatatactattaaatgtgtggacatgtataaaggacttagcacaggacctagaatgtattctgtgttatccgagtgtttgctgctgcttcttgttcttgctcttgtttgtctacctcttctcctctcccttttatttctaccttcttctttactttataataataattattgtcattttcattttgatagtgcagtataccatatcccagtttccattaatgaggtgctgcatttcttacctttttggtggtatttactcagaagttactaggaatctttttattcattattcaaagttgtttatatttttcatgtatttacagatttatgtattaaaaatgtttctgattttttttttcaattcagattcatcgtttaaggggtttccagatttaaagaaggatagcttgtttgtctctcaaacatgaccctgtgggtttttttcctttttactagtaaatcatctgtgatgtacctaatagagatgttatgaatcagaatgattttaccacataaagttgatatggtcaacatttaaaatgcaggaaagtagttaatagattagaaaagtttgattagtgatcttcagcagtagatgattgtcaaaagcaacttccttctcatccccattacctgagcctattctaactcttatatttgattttttactagggtcaggcctccctatgagtcccacttctaaggtgggtcctacttcactccctattagtcgcacctcacatcctttacccatggtgttttctttgaaaaacacaaaatgaaacaaaacaaaacaagtctatcttctccaaatcccatccagctcaacagtatctgcacctggggacttttcttctttttaatcaccattaatttagaggctcaccatgtcccaagcactatgcaaattctttacatacactggctaaatgaatcctcaaaatagtcctatgagctaggcgttattatttttatatatatgagaaatgcttttttcagctttaattagtcagttgaactttcacttattcaacaggggtttactgaacactggcttatgttatactctgtgggatgggttgctagaaatacagtactgagaaaaatagggtttctgcttctggggatggtggtagaagacatgaagctgtcgtgcagatgaatatgtttatgcttcagtaagttatttggatagaagctaagggagctgtggaagaatggcttttgaaaccaggtaggcaacatttcaggccttgatggctatatgatcttggtcaacttatctactgatttgccttagtagtagtaactatagtagtatctactactttgcctatgtagtcactgtaacaattgagggattaattaaaataaataaatcaaaatagaatgtgtagatgtaaatggaatttggggtggcagagttccattcatcaaactgcacatgtgtactgagcacatattagcacagtgctaattgctgttcaaaagttttgccttctcttttttatgggtcttttcctttcaggtctctaaaccaccacttattaatactttcccattgaagaaatatacttcccaccctgataacatcaagcttgcctaatgacttgctttggccaataaaatataagtagaagtaacttgtataatttctgataagaagctttaaagccattgcatagttcagctacctcctttttaaaaatctgtgccttgaagatagcgtgtccaaaatacagaccattccttatgtgtggatttcagagtgaagaggtttagagcacacttgcatccaatcttcatgagcacgtaaagtgaatgagaattatcattgtaaaaagcagagatgttgaggttgtttattactacagcatgactagcctaaaattatcgatgcataatcacaagagcagagagggagggtctctacgctcacccacttctgccacccccttaatgacacttgttcacatttgcctgtttcaggaagtctggatgagtgaagaagaaaattgggggctgtgttcctttggttacttacactgctctgtaatgcacgacctttgaccaagtctcttatacttgagagctagcatttcagcccaaagcataaaacagtggcatcaaatcctggtaaaggtaaaaattagtgagagaagtggggagctatgatgaaaaatcccaaactgatcttttatccttcaagaaaccgttgcaagttctgaaattgccatattaaattggaaaaaaaattctatcaactgtttcctcatcagttattatggaaaccgtcacatttttgtgtaataatgctagcctgcacattaggaaaaagaaacttctaagttgtagatagaagagacttttaggggtcacggaaatagagtccaatcagtcataaattcagcttttctcataaatctttacagcaactgttgtcatcaacggcatgtaccaaaattctctgaggaacatgacactcttctttgaatatttcttattactggtcccaaggagaaacagtttccactgtagcaattagcttaatgcactatttataatatgacttcaaaatataatctttcccaaccatttgagagaaaagccatcagctgtcacttcgatgaagagaaaggtgcaatattcaagtaaaagtacacatagaagatatcaagtatataaatttgaaatatgatagagaaattaattcatacggtttaggagaaatttgtctttcatgaagtacagatcatatcatgtcttttattcctgatacttatacaaagctcttttccactgccatgcatttgccatgctgttccaattatttttaatttctggtcacttattgacaatttgttataatcctatttttttattgcttgctgagttcatcttatctgcctctgtgttcccatattacacttgccatattaatacaatacttagaggtgcgtgtgggtgtgtgtgtgtgtacgtgtgtttgaatggatacaaaaacatattgcacacttggtccattcaagtgcatgttgaataaatcaatgaaatgcatgctattgaaaatgtagttattaagcttatctcaactttgtcgcataacaagtcattaagcctcatagtcttctacaaatgaaggtatatttgcaatattgcactactcacttaatagtacattaaatgagagaagacttaagttaaacatggtagattaaacaaatccacttacttttgcttcctaagtccccataaaaggaacaaaaatgatataaatgatagtaaaggagttgtaaaaatgatgtaaatgtacaaatatgaaaagaagaggaaaggaggtgatagtggctgaaaatggaaaatgcaaaacatgtcaataaatggaaactgacagtagattagagaaaaataaaagttaagtatctgcagagttactgagaaagaaacttggaaagacctgggaattggcaccataaaatacctccaaaaatgagatcaagtataggaacgaaaagaggaagacggcatgaaaatttctctgaagagtaattagactcccaggtcccctttcagacagaagctacatcttccctgtcatcagaagactggaggtttgctcttataaaaaattgtattagagtgggtccagatatggaagcaccagacacaacaaaaagcagggtgagagtatataaggaagtgtaagtgtaagacagtcttcaaaatggcagtatcccattccactcctttatttggcagtctggcacttttcaagagggtgattggaaaattcctccctgaggaaattgatgacttcaaaataaaagacccttaggtactagaatttgaatattcagcaacaaaataatcagtaaaggctacaagataaatgagacaaagcaatcaaaatggataaaagaaactcagaaaaagagagacaatgtagacagaagaaaatgccaaggaaaaggccgtagtatttgcagaaatgaaaacacattgtatttatgaaacaataacaggatgtcatgaaaagaagcattcaaaaaatacagaagaagatttgaagattagaaaaatatggtacacattagcatggtataaggtagtggaataggtagcaccaggaatctgcctcttcacctaaacaatgattacactggccaaatctttctgacgtaactattttgaaactctggagtctattccaaggcttgcagtgtccaggggaagccttgaacaataaaccacccttaattttagccaatttcagctcttatctggaggtagcaacccatcccctacccacctcaactctgtggcacatgcatgtgttcctggagcatattggatgaagcttgcaggagccatgctgggcaataaagatcctgtcctccagatatcagagatttgtgttcagattactatcgctgcttctgattttgcaggtagagatacaaaggcaggaagccattgttgtaagcccttctccaccaccccctcacgtccccaccccacagcattactgtaagctactccttctcccactaaaacaacttccaggagatttaaagagccagctttcacattgtgggagtcccacaagcagacgagagagaaaaaggagcagagagattatttaaagcaataatggccaaaaactccccaagtttgataaaagacatgaataaaactatatccacaaagcttaatgacctctaagtaagatgacctgacatacccaaactgagatacattataatcaaaccgtcaaaaccccaaaacaaagataatctggaaagcggcaagagagaagtgactcatcacatgtgaggaatcctcaacaagattatcagcagatttttcaccaaaactttggaggccattgtgtaggggcctgatatattcaaagtgctaaaagaaaaaaaagtaactgtcaaccaagaattcactgtctggaaaaaaccaaccttcataagtgaggaggaaattaagacatttacacatatgtgtgtgtgtgtgtgtgtgtgtgtgtgtacacacgcacgtgtatgtacacgtgcaagagagagagaagaagagagacaaagagagttcagtaccactagacctaccctgccctgcaggaaatcttaaaggaagtcttacatgatgaaataaaaatatactagaatgtaatgcaaaactccatgaagaaataaagatctcaataaaggtaaatatatgggcaattataaaagctagtattattgtaacaatttgtaactccattttttaattttacatgatttaagagactaatacataaaagaaaaactattataagctaaaaggtagtattataactttggttttagacataatacataattttattttacacaatttaagagactaatgaatttaacaagaacaattattagtatatttattaacacaatgcacaaagatgtaattgaaaaaagtgaggaggaagctgtaaataaaaaagtttttttatgttattggagtgaagctggtgtaaatttaactcagagtgctaaaagtttaggatgttaaatgtaatacttatagtaaccacaaagttgttgtagcatatacacaaaaagaaataagaagggaattaataccctaaactacaaaaagagtaactaaaacaaaacacagtaatatagaatatcagggacaaaaaaaattaaagtcatataggaaacaaataagagaatgaaagaaataagtcccttcttagcagtaattacattgaatgtaactagattaatctctccaatcaagagatagagatgggcagaatgggttttttaaacaaaacatgatccagctatgcactgtctacaagagactcattatagatccaaagataggttaaaagtgaaaatatggaaaaagatattccacgctcatagtaaaaaaaagtgaacatgggttgctatactaatataaaaaatagactctaagtttaaaaattttataaaaggtgcccaagcgcagtggctcacgcctgtaaacccagcactttgggaggccaaggtgggcggttcatgaggtcaagagatggagaccatcctcgccaacatggtgaaaccccatctccactaaaaatacaaaaaaaaaattagctgggtgtggtggtgtgcacctgtagtcccagctactcgggaggctgaggcaggagaatcgcttgaacccaggagatggaggttgcagtgagctgagattgcaccactgcattccagcctggcgacagagagagacttcataaaaaaaattataaaaggtaaagaaagatattatatgttaataaaagtttcaatataacatgaatatataataattacaaacatttaaacaataataaaaaacaaaaataaataaaacaaaagtgacagaattataagaagaaataggtatttctaaaatcatgattggagactttcataccccactctcagtaaaggataataccaccagaatgaagataagtaaggagagagacttgaataacacaataaacacattagacttaaaagacacgtgcacgacactttactcaacaacaaaagaatacacatttttctcaagtgcaaatgagatattctctaggatagaccatatattatgcccaaattaagtctcaacatttaaagagataaatgctatacagtgtatttttcccgtctacaacaggatgaagtcagaaatgaataccagaaggaaaactggaaaaattacaaattggtagaagataaacaggacgttttaaaataatcactggatcaaggaagaaatcacaagggagattagaaaatgcttagagatgaatgaaaacaaaagcataacacacccaaagttacagcatgtgctgaaagctagggggaaaatttagagctataaatttaatatttacacagaaaagtgcgaaagatctcaatccaacaacctaactttataacttcaggagctagaaagagtaactaaaccaaaggctagcaaaaggatgaaaataataaagattagagcaaaaataaaataaagaatagaaaagcaatagaaaaaatcaatgaaatcaaaagttgatttttcagaaagatcaacaaaattgacaaacatttagtaaattgactaagaaaaagatagagtaatcaaattactaaaatcagaattggaagtggggacattactaccaatttaatagaaataaagaggattataggagagtactgtatgccagcgggccaggcacggtgtctcacgcttgtaataccagcactttgggaggctgaggccggcggatcacttgaggtcaggagttcaagaccagcctggccaacatggtgaaaccccatctccactaaaaatacaagaattagccagatgtggtgtcaggcacctgttatcacagctacttgggaggctgaggcagaagaatcgcttgaacctgggagacagaggttgcagtgagctgagacctcaccactgaactccagcctgggcaacagagcaagactctatctcaaaaacaaacaaacaaaaaacagaaaacaaaaacaaaaaaatgagtacggtatgctatctaatttggtaatgaggacaaaatggacaattgctagaaacacaaaacttgcaaagactaaatcatgaagaattagaaaatctgaataaacctataacaaatgagatagaatcagtaatcaaaaatctcccaacaaagtaaagcactggacctgatggcttctctgatgaattctaccaaacatttacagaaataacatgacaaaatcaagcttttccaaaaaattgaaaagaagggataacttcttaacttgttctatgaggccaggagtactttgataccaaagccagaccaagccattacaagacaactacaaaccagtatcacttatgaatgttaatgcaaacatcctcaaaaaaatactagcaaaattaattcaaaagcctattaaaaggattatataacatgaccaagtgggatttattcctggaatacaagcatactacccaaagcaatctacggattcaaagcaaactcaatgactcaataaaatcccaatctacagattcaaagcaatcccaatgactcaacaaattcccaaagtcttttgttgcagaaagaaaagcctatcctaaaattcatatagaatttcaaggtactgtgaatagccaaaaaaaaatacagttccatacctaggtaggtatcaatcagttatgaaaatggttggaggctaatgttcttccccaaatgtcctcaaacctgtgactatattaccttccttagcaaaaataactttgaattaattcaggaccttgagatgagacagtttttctgaattatcagggtggacctaatgtaattttagggtcattataagtgagacacaagagcactggagtcagagaaaatgtgaacacagaagcaaaggtctgagtgatgcctttgctagaaagggtagtgaaccaaggaatgcaggcaggctttcaaagctggaaaaagcaaggaaaccaattgtgctatagagccccgagaagtatcacaggcctgccaatctattttagaattctgacctactgtaaggtgatagatttgtgttgtattaagtttgtagtaatttgctacaaaacaatagaaaactaatacaaagataaagatatttttgaggaacgttatttagagtttgtttgtgataatgttgggacatactagtagcagagaatttaaaaagaagtatcttcattttccaaacaagggagacaatagaaaatgttaaaaaattagaaaaatcaagaaacgagcagtataagaaagctgtttataaatgtggaggtaaatgccaagaaaatgtagctaaaagagtgaaatatgctggcttttagggactggaagtcagaagtgggaagatttgacatttttaaactctgtttatctattgtgtaggattagaaatacacaaaaagaaacaatgagattggagaggagaaaacccttttgtttactggtggaattcattcttccttttttaaatgattctactctataagtttttcactggacttgacacatattaatgttaaatatctgcttatgatattgtttcctgcactagtcccttagcttgacattcacagtacatgctcagtagcatgtggttggcacataatctactggggtttgttctgtgtctcattcatcattatatcccagaccctgatacaatacttgacatacaatatatagtggctgaataaatgaaattctggctgaaaaatgaatgaatgcataatcattattaggacttttatgagcatcataaatcacaggttaatttgagaaagaagatattttaaagactttcatgaaaagtgggtatttgaaatattcttgaggagacatactatgacaaatttcatatctctgcataggcacatacattctcttaccttcaaagcttcaatgtatattatgtaattatgcacacttttaagcaagctccttcctattgcattaggtaggttgattctacagctgaatcactgaattggttatctcagtcacaagtacaacatggtcaagacaaacatcaatagggtgtgtatcaggcagggtgcagtcagaaaaaaatgagctattgtaaatattatggtaataaggattttattataggaaattgatcttgtgcacgtatgggaggggcttggtcaatgaagatctggaagaggggtgtcagaagatccaagagaattacgacatagtccatctggagcactggcatggggtgaataatatggagcttatgggagaatctgaaattgcaagcacagaaggcttcaggagtggaactatgaagacgaagcctctagggtattcctgtgaaagctgttgcccccatgtaattaccacttcagtcagtccacagccaggcagctggtggtgcgtgggcctggagatgctgctgggcagtaggggcagcaggtggaaaacaaagtcagcatgaaacaggggagagtgaggacaagctgttaggcatctctgcattttttcatgtcgctatgtctcatcacaacagccttccaagaataagggttctgcatttctccaccttccaaatcttgcaaaacttcatttttgttttggcaactgtaacataaaacctaacagtaaaggggattctggactatgtaattctcaatctccatcaagttgatgtaacaaaatgtagcacagatgaggacagatgcacttctaacagggaaaggggaaagtctttgttgtatatttgctgaacaataatccagattttttacagcgaacttcaactttgaaaacttgggatattgctatctccctctaaacttcaatcatgaaaacctcagaactatttcactctaagggaatataacaattaaacatacatgaagatattcagctttctctgatatgtatagtaagtgctaaaaaatgttaaggctggacatggtggctcaaacctgtaatcctccaacacttagggagggagaggtgataagatagcttgaacccaggagtttgagacaccttgggcaacatagtgagaccccattctccacacacacaaacatacacacaaaaatgttggtttcttttcctgttgaatggcataattttataggtaaaagaaacccaagaagtaaaataggtcagtttctgactactgatctcagccactcctaacctaatagactttcagtcacacccaaaaactagtgccttgcagaaaaataaaagccactgcaacttcccagtaatgttctgaatacatagtttgcacaatactctgtgtgaggtgctctgtgagggatggcaggtttcactgatgagtctaacttggtttgtgctctcaagcagctgatcctgaagctgaatagacaaggctagtgtgtttgtgcctatgatcaaagacacactaaaagaaactgccccaaagttaaaataatatggatttttcagagaacacgtagggaatgtcaatcagctggctgtggacagattttctagttgaaacttatttaagagggaaggaagggagggttaatagagagctattaattatattctgaggtggagagagaacacaccaaggctaacatctgatggcctccattttcttagagttcttaagcagaataagcagagtgtggtcatctatgaaaagtaaaattaatcagcattagtacaaataattttctggaaaaggagtaaaacaaaagggttttctggtagccttcataactctgaaatcataaatttatttgagatagtgtcgataaagttattattgttacttttatttgagtaaaaggtttggatttggttattgactgatacacattccggggatattcatttcttccacttccctgcaactctcaatttattttttataaaatgtttcagattaatttgaaattattgtcttgctttactcaaaagaaaaacctcaacaaggttttcatttttatagcttatgacttagaatttgtttgtttgcttttctacaggaactataatgaccacctttcacaggtgacttgctgctgtttaggagaggcttggtgattatcatcagaaaagagccaaagaaggaagaaagagaattaaatgtgtctaattctcaaatgataaaatatagccctaaagctattaaagcacatgtattgttaggtgacctaggagttctggaaagtgtgaaaggcagcaacatcaagtgactttcttggttgtaataatctatggataatctaagaattatcacatcgaggtgtgcaggatccatttagcattgctaatggcattttgtatgtgggtagtaatggcctgatagccactttccttttgagcctccatattgcagtgtatgattcatagccaacacttgaggctttaaataatagaccttttcattttgattctctgatcctaaaattcctaatgacatagcatttttaaggcactaatgtgaattctacatttacattcacaggaaatgtttttaatttattcatgtaaaaaatggtttaatagtttgattgctttgttcactgaaatagtaattttaaaacacttgaaattaaactgaaaagtcaaaagtgttttaaaacatctctaagacaattatgtaaaactcatgggcttaaatattaaagtaacattgacaagttgggaggaatgaaatatgattcaaatgttttaactgattttcaatcaatcaagggcttgaacctgaatttcctattttagcttttaaactcattgggggcaaagtttgactttattaaaatctgtgtatgaatttggaagatattctattatagacagaagctatgttgggcaaaggggcttcaatcctgtcttggctgtaaacaccccaccttcaatgcagtgcatgacaaaaatatgacttggtatttcaagcaagtttgctgttccaaacccacacattctgagctgcatcagctttgaaattcaaatgccagatgatttggaaatcacttttgaggagaaaaatatattatggtgcattctcccttgcctggctggattgatgacaaagcctttacatatttacaggttaaaagaggcagtgagcaggaaagtcccttgtctataacataaattgacaaccttagtctctttgagatgtgggttcacaagagttcagagagcatttttttgccaggaacactaaaacctcagagggacatcagctctttaaaggcaggaaaggaccctagcacttatctactttaatcctttggtgtctctatgtaaaatggtataagaatagcctctaaatatcttagagggttgtggtgaagattaaataacaaagacaatttctatacggaacttgaaacatctcagatacttgttatatgttcacctctttcattcatttccacagatattagtcttcctttgtgtttagcagcaaataatgtgaatccataagcaagtacatggaaggccaaagatattaagctattggtattgcaaataaatgtaacacctgtctagctactctgtctgttaatctgacaacactcaatttacctttctaattaaaagcttacttaaaatctaccttttgatattttgtttgcacccctttggttattttatattttgacattttgaatatgttttaagttttatttattttggctaaagactctttctatatgattgtataatatatgtacaatttgtagcatcttctgaataacaaggatcctttgaaatcttataagcatcttttttctagtttatgtaaattggaaagctgagacactttagccattttatctaaaaatctctataccaaatctttaatttgttagtttagtttaatttttataattcagcactaagcaaactggctttagggaactattgtttgtttgtttgatgaagtgctcttgtaccacctcagatacgcatttaatcccctcaaatagaatcttggccttctgagatgtagtgcagggcctcttagatcataggaaatgattcgcagggtgagatggattcaccactcaggcttcaagcactttagacagccagaaatggtaagatagaaaacaccttgatctgtagcataatgcaacaggaatgttgcctaactccaggagtatgtttgtcccaactgcagcaatgtgttcgtatttgtgttttactaactgtcactatgtttttatgaccagccctcccctaccagaccaagcaactttagtatagctctcaaattcttttcatttctgtattctttataattatggtctagaatatagtagatattcaataaattttaaaacaagcaaatgattaggggaaaactgtacaaagaaaaaaaatctttgggtgacttcccaattcaaaacacgtctaacctaattttttgacattatggagctaatcatatcataatttatgatgatattgattcagaaggatgtttgagatacctgctttatttctgctgacatctacttggctgatttactcacttcctcccttctctcacttcatttatggtcccatttcaccttctcaaagaggtctgcactgatgatatatttaataactgtccctctacctcatcccagacacccacgatctgcaagacctttcctttattttcctttttacaaaaatccttttcctttccaaagttctatatcatctatttattgtcattattgtatactgattctctcttgctgtcagcttgtaaatttcactaaggtagatctgttaatttgttttgttcactaatatttcccaagtaccttgaataatgtctagcactttgtaggagctcaataaatgtttattgactatatgaatagaagacactcaaaagtcagctctaattgttaggtttctaagataggagttaaaattttgacattgtatgtagatttgccatgataaggttggaaagtaaggggtctagttttcacaaaattaatgtatccatacactaccattcagatctgctgcagttttcacagagttggaagtagtctccgtttgtgttggccccagtggttcatcccattccttgagtggccacgactgttttgctctttctcctttctgcctttaccattttgcttaacctgcttctacgcttttttttatgctcaactctgttgtgccttgtgctgttagctgtttctcaacaggagtaaagttaagcatgtatgtgcgctctgaattcaaactacttgagtttttatgttgaactcatctttactagctggatgtgtgattcagggctattttccttactgctctgcaactcaatgtactcagctagaaaattgggataatcttgcttcttctgtgtagaaatgtatgaatgaataagatcttatatgaggcaattataacagtgtatagcatatagcaaactctcaagattaaaatgaaagtcattttagttctggctcaagtggaccataaatttctttagagtaaggaccatccaggattcctttttttttctgtgtatcctagagaatataatagcacatactatacatatttactgattgattttttgacttttcagctgtttggtttgttttaatgacagtgaagacaaggtttttatgatgtccctaaagatagctatgaaaataaaaagcaaaatgaatatcacatactaagataatattagttcttattatactagcttttctttgtgaaacctgtagtgaaaatgcttgtcattattgggtcttcaagccattaatttattgattctccaccctaaacctcacaaaatttgactgaaatcctaacaaatgttaatgctcactagctaaaggaccccaggatacacttacagtcaaataaagttgagtttattacttcctgcaaaaagggatattgtacatttttgataatagtaggtactttgataagaaagttttggggtatggattgtcacgggattggatcttgtgttaagtgacctggggagattggaaggaaatagagatctattctgaatttggtaattttatgaggaagggataaatttatgaagtatcttaatatttgtttagttcacacataataattatacttatttatggtatatagagagatattttgatacatgtatacaatgtgtaatgatcaaatcagggtaattagcatatccatgatttcaaacattaatcatttgtgttgtgaacattcaaaattctgtcttctggctttttgaaaatatacactaaatgattgctaactgtattcagcctacagtggtacaacacactagaagttatttctcccatctagctgtaactttgcattcattaaccaacctctgcctatccttccctccctcttccctttcccagcctataatgaccataattttactctctgcttctatgaactcattcttttagctcccatatatgagtgagaacatgtgatgctaatctttccatacctgacttatctttccatgcctgacttatttcacttcatattaatattctctaggctcatccatattgccacaaatgacaggatttcattgttatggctaaatagtattccattgtgtatatatgccacattttctgtatccattcatctgctgatgggcatgtggggttattacgtaatggtggctattgtaaatagtgctgcaataaacatggggttgttggtatctctttgttataatgattttatttcctttggataaatacccagtattgggaatgctgggtcataggtagttttatttttagttttttgagaaatctacatgctgttttcaataatggctgtattaatttacatttgcaccaacagtgtgtatgagttcccttttctctgcaccgtcaacagtatacgttattttttgtgtttttgataacagccattctaactggggtatgatgagaccttattatggttttttgtttttattttggtgatgattagtgatgttgagcatgtttttatatgtctgatggaatttgtttttattttttgttgttgtttttgagacagagttacactcttgttgcccaggctggagtgcaatggcttgatctcggctcaccacaacctccacctcctaggttcaagtgattctcctgcctcagcctccgtagtagttgggattacatgcatgggccaccatgcccagctaattttgaacttttagtagagatggggtttctccatgttgatcaggctggtctcgaactcccggcctcaggtgacctgcccgcctcggcctcccaaagtgctgagattacagttgtgagccaccacgcccagcaggccatttgtatgtcttattttgaaacatgtttactcaaatcatttgcccattttttaatgggattatatggtctttgctgttgagacgtttgtggtccttgtatattctggatattaatctcttgtcaggttaagttttcaaatattttcttttattctacaggttgtgtcttcactctggtgattgttcctttgctatacaggagatttttttgattgatatagccccatttgcctatttttgtttttgttgcctgtacttctaaaatcttacccataaaatctgtaccaagaccaatgttctgaagcatttccttataattcttctagtaggttttatagtttcaggttttacatttaagtctttaattcatttttagttgatttttgcatatggtgagatatggggctctagtttcattgttcttgatgtggatattcagttttcctagctgcatttattgaacagggtgccctttacccaatatatattcttggtgtctttgtctaaaatcagatgattgttaatacatggatttatttctgggttctttattctgtttcattgatctatttttctatttttataataatactgcactgttttgtttactacagctttgtaatatactttgaagtcaggtagtgtgatgcctccaactttgttctttttgctcagcattgctttgactattgtcaagaaaccaaatgttttttggtcccatatgaattttaagattttttttctgctttcataaagaatgttattggtattttgatgggtattgcattgaatttgtagattgctttctgaaatatggttattttaataatattaactgtcctattccatttttttgtgtcctcttcaatttatttcatcaacattttgtagtttttattgcagaagtcttttacttccttggttacatttattcttagttattttaatttttgtagctgtatatttttgtatggaattttttaaaattatgcttttacctagttaattattggtgtatataaatactactaagatttgtgggttgattttctactctgtaactttaccgaatttgttgattacttctaagagggtttttttgtgggtttgtggggttttctatgtataagattatgtcatcagtaaagagggaattctgcttttccagtttccatgcactgtattttttttctctaggctattttctctggataggacttctggtcctatcttattcttatgataaataagagtggtgaaagtgggcattctatcttcttccagcaattagaggaaaggtttttttagcatttccacactcaggatgatactagttgtgggtttgtcatatatggattgtattgtgtttgtgcacattccttcagtagcactttgttgagttttttgtttgtttgtttgttttttaccatgaagagatgttagcttttattgttttttgttttttgttttttttttaccatgaagagatgttagcttttatcgttttttgttttttgttttttgtttttttttaccatgaagagatgttagcttttattgtatgctttttctgtatgaattgagatgattatatgatttttgttcttcattctgttgatgtgatgttcttcattctgttgatcacattattgatttgcataagttgaacccttcttgtattcttgggataaatcccatttgatcatggtgtattatatgttggtgtattgctgggtttggtttgctagtaatttgttgcatgttttgcatgtgttttcatcagaaatattggtctgtactttgtgtgtgtgtgtgtttgtgtgtgtgtgtatgtgtgtccatgtctgatgttggtataatggtaatgctggcttcatagaatgagttaagaaaaattcccttctcttcaatctttagaatagtataagaaaaattgtgttaattcattttttaaattttaatagaattcatagtaaagcaatcagtgccaggcatttctttttttaggagacttttattactgattcaatctcattatgtgttattggtaagttcagattttttctttctttctttcttatgtatttatttatttagacacggagtctcactctgttgccaggctagagtacagtggcatgatcctggctcactgcaacctctgcctcgggttcaagtgattctcctgcctcagcatcccaagtaggtgggactacaggtgtgcgccaccacgtccagctaatttttgtatttttggtagagatggggtttcaccatgttggtcaggatggtctcaaaatcttgacctcgtggtcagcccgcctcagcctcctgaagtgctgggattacaggcatgaaccactgtgctcagccttcttccttatttaatcttgttcagttacacatccaggaatatatatattccccataggttttctaatttgttggcatataggtgttcctaatagtctctaatgatcatttgtttttctatagtatcatttgtaatgtctcttatttcatttctgattttatttatttgggtcttctctctttttttcttagcttaactaatgatttgtcaaatttatcttttcaaaaacacaaattttcattttgtttatttttaaatatattttaagtatctatttagtttatttctgctctgatattcattatttttcctctacctattttgggtcagatttgttcttgcttttctggttccttgaggtgcattgctaggttatttgaaatctttcaacttttataaaatagacagttattgctattagtgctgctttttctgtgtcccattggttttggtatgttatgtttccatttttattgatttcaagaattttttttgcttcttaattttttcactgagccactagttgtttggaagcatattatttaatttccctttatttgcacagttttcagagttactctttcattgatttctagttttattccatgatgatctgagaaggtacttgatatgatttaaattttttaaaaattttaagtcttgttttatgacctaatatatggtctatcatgcataatattccatgtgctgatggaaagaatgtgtattctgtagcttttgggtaaaatgttctgcaaatatctgttaaggccttttgatctatagtgaagttttaattcaatatttcttggatgatttttcatctagatggtctgcccaatgatcaaagtggaatgttgaagtttctaactattgtattgggctctatctttctctttagttctaatgatatttgctttaaatatttatctgcatactccattcttcagttcatatatatttacagttgttatattctcttgctgaattgatcacattttcattgtataatgacttttttttgagatgaagtttcactcttgttacccaggctggagtgcaatggtgcgatctcggctcaccgcaacctccgcctcctgggttcaagtgattctcctgcctcagcctcttgagtagctggaattacaggcctgcaccaccacacctggctaattttgtatttttagtagagatggggtttctccatgttggtcactctggtctcgaactcccgacctcaattgatcccctcaccttggcctcccaaaatgctgggattacaggcatgggccactgtgcctggctgagcttcatctcttttcatgtttattgacatccagtttattttgtctgataaaattgttttttatgcatgattttgttttccatttgtatggtatatctctttctgtttcttccttttcagtctatacttacaagtgaagtgagtttcttgtaggcagcatatttgggtctttttttaaaatcagtttagctagtctatatcttttagttggaaaacttaaattatttgcattcaaggttgttagtgataggtgaaaagttacttctgtcctttcactagttggtttctgaagtgttttgtgtatgttttgttgctttatctcttaatgtttatttttctgatttgggtagtgagcaaaatttataaagttcgattcctttctctttcctatttgtgtatctaacagtgagttttatactttctgtgtgatttatgacggaaaatatcatcctttcaattccagatgcagattttcctttggcatttttctgtagtgccactctattgataataatttccctcagttttgctcatctggaatagagtttatttttcatttctgaaggatagctttactggtgcagtattcttacatgacagtttttttgtttgtttgtttctttgtttcagcactttgaatatattataccatcctctcctggtttctgctgaaaaatacattgttagtctgataggtattgttttctatgtgacttgatggccttcgttgctacttttttctctttgaatgttacagtttgaccgaactgtgactcagagagaactttttgttttgaaactacttggggattgttgagctttctgtatctgaatgtctatatctcttataggaattgggaaattttcaactgttatttcattaaataggttttttatgcctgttcacatttcttctccatcaaggactctcaaaatttgaatatttcttcacttgatcatattgcatatgtcatgcaggctttcttcatttctttatatagttattttttgtctgggttattttaaaatccctggctcaagttcagaatttctttcttctgcttgttttagactactggtaaggctgtcaattgtatttttattttcagacattgaattttacagttctgggatttctgtttttttctatgcctcaataattttgtgtgaggaagttatgactggttgatgcttccttttacttgttccactcaaatttttgttggtaacatcagtgataatgactggattcaaaggaagtcaaaaatgcatttttttgtcctaatataccataggcatgtgaggttgactcatgagaggcaagccacaatgggtgaaattaaaacttagaggtaatcccatcaggtaaagcttagagttgaggtaggacacagaccaaactgcaggtaatagaggtgtgacataaaaggtgaaggtgggtgtttgagaaaacaggaacaatccacaagcagaatactaggctatagacaagtcaactaaaaataactagacctaagagtcagagaaatactaggacacagaaacagaaagtcagtgaatatttacacaggtagtaagatgctaaccaaacttccagtcttcagttatacagatagaatccaaatcttggatgttataaagcacagagaaggacaagacagattttaatctagactgtacccagagaacaaggaaaatgcagggccaagaactgggtgagttggttctgggcattataaaatatttaatgtcttctgattatgcagaagcagattaatctcggatcactgactggaacagtgtctacagatgggagtcatatggcaagagcaaaggcaggtgaactggcttagagggtcaaggataataggtcaagctgtcactgtgatgacttgatcagcattaaatggattaaagcatacaaaattaattcatgacttcagagcctaggcttctgcttttgggatcatttcttactaatacagtgccttcctgtattagtaagtaatacagccaagtcaatgagcatcccagcttcacgccatgtttcaagtttagggttttagatgttgagtgtgatccgcatagagttttcatctatttaattctttaaggaagtacaaattttactagatcttatcttccttctggaatttacctgagaacactcattgatggccatttctagcaccatttttttccaaactcttactatattacattgcttagctgcctcactatctaccaactaataaaatatttagatcacaaagccagacattcttgcagataaagaaaataatgagaaatattacctgccttttgggagcttttattctaccaaggaaaggcatgactaaaataaaggagaataccataaaccatattatctactattacatacagaaaaaccaatatttggccaaggttaatacaaagttaattcatagaattccaggatcagggttctgaatcacaatcttaggcaactgaaaaaaagcttcttatagtagatttacctaaactaacacctgaggaatgaataggcactaactgagtaaagaaggtgattgggtcaatgctctaagttattttaaacatcagcctactttctgtctttattgtagtaagtaaacaaaagtaagttttttttttttgatgacttagggtcagagcaaataactcaaaggtggacttacatcatagcaacctaaaggtatttttattttagttagttaattaaagtatttatctgcatttaaaagtatttatttaggtgatgataaaagtaacacagcaatattttctgggtaaatttatattccgtgaagtcaggctcttgtcaattaaattttcactatatccaagaaagaaacaatgtcaaaataaatttagtgcaggcttatcaatcagtttagccaaggcattaatataacatcatagtgaagatgtactacctactgaaggagcgttgttagtgtctggaaaaaatgggtatgaaaacatttattaattcactggtgagatgtcttggaagctgaagaattcgtgtgctaagaaggaggcagtgacaatcagcacccagtgccacatagtcaaggagaatggggaggaataaaaggccttggtattgggtaggaacaaagatattaattccatttgtgagagtactttttgcagagtgctagaatgccatgattgcaaacctgcctgagaaaagtctgcaacttttatttattgcttatagaccagaattatattaaagacttttacctctaacaactacatttacctgagtatgttattgaatatctgtaaaacgtatgaaaagaaagaaatgtaggtgttatttatatttagttcacaattctacagagcctgctgtgtttttgcaaatgtttgaaactcctttattattaaacctctttaatcttacctcctacatctcaactactgggatcatttctgacaccaacacagaactggggctattctccagaacacaatttgattctccattccaaactttggctgtctttatttcttctatctcaaatgtcctccttgttttgcctttttaaaaagtgtcaacctttgacatcatttctatttataatattttttcaggataattctgaacagccatatattctttactctgaggctgtgacgtgtgtgtgtgtgtgtgtgtgtgtgtgtgtgtgtgtgtgtgtgtgtgtgtgttctatgatatggtatgttccgaactgtcttttgatgggttttatcttcccacttgtattgcacagttctattgtgtagggatcatggcttgtactactttgtacaatattttcacaatattctgtgctaatattatatgcataatcattaaaggctgtatgatattgtaacactttcattagaaagatctagattttaaacaaaactctcaagctatggttttctagctctaaaatgcaggtaaaggtacctgcttcttagggtggcaatgaaaaattgaaaaaaatgtatgttgagagtttgacactttaatttatttataaatgttaattatctttctttataaattgttgggttgataaggtctgacatcagtaggtagtatatcttcactatggtgttatattaaatgccttggctaaacagataatcctgtaccaaatttattttgaccttgtttctttcatggataaggtaaaaatttgattaacaagagcctgacttcatggaatatatatttacccaagaaatattgatatgttacttttatcatcctccagatagatacttttaaatgcagcaaaataacttaatcaaaataactaactaaaataaaaatacttataggttcctatgatgtaagtccacctttgagttctttactctgatcctaagtcatcaaaaaatattaacttttgtttatttagtacaatagagaaatatagtagactgatgtttaaaataatttacagcatttacctaatcaccttctttactcagttaatgcctattcatttctcaggtgtcagtttaggtaaatctattgttaagaagtagatttacctaagattagcaacctcagttgcctaagattgtgattcagaaccctgctcctggaattctatatatcaaccttgtgttaactttggccaaatattggtttgtgtgtatgttaaacggtagaaaatacggcttatggttacgtggtctctgttcatctcaaccactgttaattttccaccacctggcactgcaaattcttcagaggagacacccaagaaatacttgtggatctaaaggataggtcagcaggaaggaagccagactaaattaaccataattaaataataaattcaattattcaaggtagtttacttgtatcaagtatttcaattaaatttagggggcatttagatatagtcaataaaatattcaacatattaagttatttcacttatgttacttgagcacttcttatgtgcatggaactttgctaggttctgtagatgcagctcacattttcagagatatataataaaagtatgctgtcagcacaggaatgaaagagccactatctaatgaagactggaattggagctgaagcactacttaacaataatacagcaccattttggagagtttacctaagtgaggggcaaggccaaaagtgtaaacacaatgaatatgcatcatgacattaacaatttgagaccctgagatggaaattgggtgcaattagctttactattccttgtaaatggaaatgtttgctatctttccttttttttttttttttttttttttgcattcattctacattccctattttattccatgttttgctgctataacagaatactacatacagggtaatttacaaaaaaaggacatttatttggctcacagttctggaggctgagaagtccaagatccaagattgacgggacatatccagtgagggttttcttgctgtgtcttaacatagtaaaagagcaagcaagcttgtaggtcaaagggagaaaaaaaagttagaccaaactcatcgttttatgaggagcccaatttctgaataaccaaccattcctgtgattatggcaaattttcattcaggagggcagaactctcatgacctagtcaactcttgaagatcccacctctgttgcattgaggattagtttccaacacatgaactttaggtggatttatttaaaccatagcactttctttgtgtgcactgactataagttaagtagactggctaaggcttgaatgattttaaatttgtatattattgaatgagtgcaggatgtttagataaagagcttctggtgagaaaaaaaaataatatccataaaattgaggctactttgtctttgcttttatttttttttcaaaatggaaatgggagtttattgtttttattatttcctttaaaatggaagtaggttggctgttgggctcatgcctgtaatcccagcactttgcgatgctgaggcaggtggatcacctgaggtcaggagttcgagatcagcctgaccacttgggtgtggtggtatgtgtgcctgtagtcccagctactcgggaggctgagacaggagaattacttgaacccaggaggcagaggttgcagtaagacgagattacaccctgcactctactgcactctagcctggagacagagcgagactctgtctcaaagaaaaagaaaaaaaaaagaaaagtaggttaattttttttctgattataaaatatgctacagtttcattataaaacaataagatactattacattataagaaggaaaacaataatcactttttccactaactagagataattcaagttaacagtttatatatataactaagacattttctctctgtatgtatgtatacaaactcctctcaatattcttccagtgtgtatacattgacaccacattttaaaattaaaaatgagattatactctaaagagttttaacatttttcacttaacagggtattatgaatgtatattttagacaatagacctacatttgtcattatcctaggcagtgtctcactggtgaacacagaaggataattgggctgattaccactttaagaagaactgccatgatcaaataatgatcaaagatgaaatacatatatttcatctttgcacatttattgactattctcaggtacaatttctggaagtgaaattatttcttgatatgcacaagtttaagggtataattatacatagcaaaactgtttttctcaggatttatacttactgatattcctacccagcctgtttgaacacattatcaactttggatattagcattattttgagtctttgctaatagtacaattgaaattagattagaaattatttttcctggctataaaataatccatcttattgatttttttaaaacatttagtttttgtggatacatagtagggatatatacttacggggtatatggaatattttgattcagacatacaatgtgtgataatcacaccaggataaatggagtattcatcatctcaagcatttatcctttttgttacaaattatccaattatactcttctagttattttaaaatgtacaattattattgattatactcaccctgttgtgctatccagtactagctcttatttgttctttctattatctgtaccttttccctcccttcctgtcttccttttagtgtatgtgattttctctggtagtgtgttttaatttattgctttttaattttaggtatacattgtacatttttagatttgagattaccatgaggtttacaaataataccttataacccattattttaaactgatgacaacttaacactgattacataaagaaacaagcaaaaataaaactaataaatgtctatactttgtctccccattttttaacgtcttattgtttgtattcatatcttattgtactgtctatgtcttctacaaaaactgttctagttattattttataggttcatgtctttatcttttaacttaaaatattagtagtttacacaccacaatagcagtgttataatatcctgtgttttccctgtacttactgctataccagtgagttggttttttttgtttgttttgttttgttttttgtttttgttcttgtttttgtttttgtttttttgggtttttttgagatggaatttcgctcttgctgcccaggctggagtgcaatagcgtgatctcggctcaccacaacctccgcctcccaggttcaagcaattttcctgcttcagcctcccgagtagctgggattacaggcatgcaccaccatgcctggctaattttgtatttttagtatttttagtagatgtgtgttttctccatgttgaggctggtctcgaactcctgacctcaggtgatccacccaccttggcctctgaaagcactgggattataggcgtgagccacagcgcccggcctataccagtgagttctgtacctttaggtgatttcatattgcttattaatatccttttctttcagactgaagtactccctttagcatttcttgtaggacaggtctggtgttgctggtgttttcagcttttgctgtctggaaaacatttatttttccttcatgtttaaaggatatttttgcaggatatactattctaagataaaagtgtcttgttgttttcttcagcactttaaatatgttatgatactttctcctgaatagatttgggaatttctctgttattatctctttgaataaacattctacccctattaatctctctacttcatctttatgtccaatgactcttagatttgcccttttgagactattttctagatcttgtatacttttttctttttaattttttttctttagtctcctctgagtgtgtattttcaaacagcctgtcttcaagctaattctttcttctgcttgaccaattctgctattaagagactctgatgcattcttcagtatgttaattgcatttttcaactccagaatttctgcttgattttttaaaattatttcaatttatttgtttactttatatgattctgaatactttctctgtgttatcctgaatttctttgaatttcctcaaaacaggtattttgaattttctgtcagaaagttcacatatctctgtctctctgggatttttccctggtgccttattcagttcttttggtgaagttatgttttcctggaccattttatgctgtgtgtgttcatcagtgtctagtcatagaagagttaggtacttactgtagtcttcacagtctgggcttgttactacccatcctttttgggaaggcttttgaagtattcacaaggccttgggtattataatctaagttttttgtcaatgtagccatatctgcattagggatcaccccaagtccagtaatgctgtagttcttgtagactcacaaaggaaccacttagttctcttcccttactttctccccacaaaacagggtctgctgagctgactggagctgagttaggggtagccagcaccactgggacttcactgggtcatacctgaagccagcacagcactgggtcttgcccaaggctcactgtaaccactactgggctaccacctatgttggttcaaagccttggggctccacaatcagcacattgtgaggccagccagtcttgttccttcctttcagggtgatgagttctaccatgtcccagcttggtccagagatgccgtctgggagccagggcccagagtcagaaaccccagaattctacttgttgctctattctactgcgtttaagctgaccctgaaaccacaagacagagtttttcctattctttcctcctgtttacccaggcagaagtgtctcttcccatgtctgccaccaatacaggcccacaagtagtattggctgagtactgctgatgctcacttaagacccaagggctcttcagtcagcttatggtgaatactgctatgcctgggattcacccttcagagcagtgggctcccctctggcccagggaatgtccggaaatgtcatcccagagccaaggactggaattggggaaccctagagccccttttgctcttttccactgtggctgagctttttcctaagcttcaggacaaagtcccctttattcttccctcaccttttctcaagcagaaagggtttctctctgtagccactatagctgtgtatgtgctgagtcatacctgaagccagcatgtctcagaatctcactcaaggcccatagcatgtactacctggttacttctgctgattattcagggccatgggctcttaaatcagcaggtgatgaataatgccaggactgggtccacctggaatagggcctacacaactctgcccaatgccctatcctactgaggctgagctggtatccaaattgcaagacaaagtcgacttttctcttccctctcctctcctctagtagaaggaagagatctctttcagagctacgagttacattgcctgtggttgggggaagggtgatgcaagaaaaccccttagccaccctggcttgtgtcttacttgcctggcttgtatcttacttgggaggttgcataccccccaagtcctctggctgtgagtccattacaacactaggacttgcccaggagtttcagtccttgtggcctagacagcacatcaagtatatttaggaccccagagcactgtagcctgcagtgccagtgcttcccagttctgaccactgcaatgagcatttcttctttggctgggctaatctaaatgctctttccatgggtgccatctgagttctgcccagtgttggcagcactgaattctcacaatcgcttttctctccttctcccaaacgcacagattctctctgaaccacgtagccactgccagggagttgatgagtggaggcattagcaattcaaaactgtcttttctaccctcttcagtgcctctttcaacagtactaagttaaaatcaggtactgtgatttctcacttgctttttggttcttatgcaggtgtttttttgtgtgtgggtagttgtcaaatttggtgttcctgtggggaggactatcagtggagacttctattcagccatcttactgcaaccctctcctgatatcttactgatattaaaatttttttatgctactgctgattgcttttcctcatattttctttgtgttttcttcacattttgttctacccagtgattctgtatattttcaacttgctaactacgttaaaattatatcttaagagtttctcattaataaaattaatttttaattattaagtgctgcataatatagattaaatacaggtacaaagttcacctaagtaaacacacatgtggtgtacatatataatatttttagcactttggttaggtctaactgacatagaaaaactgtacccatttcaggtttacaatttgataagtttttatgtgggtatgcacccatgaaaccatcagcacaatcacgatgatgaaaatatcaagcaatcctaaaatttcctcatccatttttataatttgctcgcccactcttccctgtcacttccaaatgacaaacactgatttcctttttctcactacactattttatagtattatataaatggaatcttacaaagtatactcctattttatcagacatttttcatttagaataattattctagattgtatatgttttgcttctatcgatagcttattactttttaataccaaatagtattccattgtatggctatatcaatttgtcaaaatattcacctctaaatagacatttgttgtttccagtttttgtccattactaataaatctgctacgagtattaataactgtttatattgacatgtgcttttattccctctcttgggtacccagtagtgaaatggctacatcatgtatatggcaggtgaatatttaacttttaaaggagcttccaaactgttttcgaaattgattacactattttgcattcccaccagcagtgtatgagttccatttcctccttatctatgtcaacctggggtacagtcagtctttgtaattttagctgttctaagagatacctagtaagatctcattttttgtttgtggctgaaatctacacttttctaatggccaataatgtttgacattcttccatatgcttatttgccatccatatgtctaatattataaagttcctttgcaactcttctcattgttataaaaatggagttgttttctttttattgacttttgagaggttattatagattttgataaaattctgatatttgacatatgaaaatatctgcagattttgtagctttgtggcttgtctttttatttttaacagtttctttgaagagcagaagttttaattttgataaagctatttttattcttttatagattatgtttttgtgttgtatctaagaaatgtttgaccaatccacaatcatgatgagtttctccagtgttttgccttagaaattttagttttaggtttaatgtttaagtctatgattcattttgagttcatttttgcagctggggaaagatatagatcaaagatgttttattgttctgttgcatgtggctaccacttgttctaccaagatttgttgagaagaccaacctttctctattgaactgcctttgcacccttgtcaaacatcacttgtccctatataagtaaatctatttctggattattattttctgttgatctgtttgttcatctttaaactagtaccacatgagtgtatcacagtaggttgataaccttggaataaggtagagttagccctctttgtttttcttgttaaaaattatttcattcttttgaaagttatcaaaacaaattcctagcttgcctagttggtgacctgttaacactaatgaaaatggctagtaatgatgcagctttaggttacttctgaaagattagtagaaaagtagaaatttattgtcattttattattgttcattcatttttacaaaataaaattcatccttccaaataaactcttttaatctgatagcaaaactcagaaagaactgagccatctgtgtcattctcttttttattataatgtcattgtaatcactctggaaatatgtgtgggggattttcaataaattttctgcaaagtcttaaacagcggaaaacagacaacaaaacaatttaaaaggaaagccttctagaatcaggctgctgtagtgtattttgaaaatgtacacacagtttgaagactgatatttatagctgcagctagagttgtgatttatgctgctgaggtataacgttgtataattgatacgccatatgatgatactaattgcaatctggatgaaaattagaaatgatggaatcatgtcttagaaatcttaacaactttgaaagtacaatttaaaaatagaaaatatactgttgcacaaagttattgtacatacagatttcttcctgaaacatcaccacgttcatttgaaatgtatatgatgaatttggaagaaagccgaatctggacagacaggaaaggaagggtggaactgcatacagtatgactcacttctacctctattattgctaataaaatattttgaatagtccctttcttaacattaatataatatttttttctgtttttttaatgagtatatattgcttactgaaatgcatacattttattaaataactgcacatatatttttagaaagaaatggaggggcaggccgggtgcggtggctcacgcctgtaatcccagcactttgggaggccgaggcgggcggatcatgaggtcaggagatggagaccatcctggctaacacggtgaaaccccgtctctactaaaaatacaaaaaagccgggtgtgatggtgggcgcctgtagtcccagctactcaggaggctgaggcaggagaacggcgtgaacccggcaggctgagcttgcagtaagccgagatcgcgccgctgcactccagcctgggcgacagagatagactccgtctaaaaaaaaaaaaaaaaagaaaaaaaaaagaaaaaagaaaaagaaaaaagaaattgagaggcaaggacagaggagaggttttgtgccacacattgtgttaagcacttcattaggctcttctgatttaatcttttgaataacatagcagggctgatgtgttgtttgcagattatggacctgagactgggattggttcagcaattcagaaaactattaagtgttagatttagtctcagaactttacaattccaaaacctgggttttttcctggagacaattatccaaatatatggagtattataaaatacctggagccagattacaaggaggcttttcttctgaggctgcattcaaataattaatttcataatttcatttatgttcagtcccagaaagaaatgaaaaaggttcctgagaaatagaatcaggaatttacattttaaattatatttattaaatgtagactgattaatgtaatataatgattaaatgtagactgaaagagagtgacacatattttgatttaacctgacaaatgctaaaatgtttggaaccaatggaggcttcagagactgcttttcttccctatgaaataaaattattcttaaaagttacttaattacccaagtttggttggtcatggcgagacaatggtcaaagaactttgacttatttagcttaaacaggagggagggagggaagaagagatggaaggatgaacctgggaatctagtacatcattaaaattggaatggctttgtggtgtgtatgtgtgtttaagaaataaggcaacacaatcaaaatattgttttaaatttcgttcagtactagttttagacctgaactattctggggaacactttcgcagtctcacaaataatttagtgcctttaaattattttggcatatgaaagttaattattgtcagaaaagaaaagagaaggagagaggaaggaaacattgattgtggtacctgttatcttagagattttcacatataaaatctcacctcacaatatctctcaggtgagaaatttctttttttgaaagatgaaaaatatcaaagcatacaaactcattatcattcactgtctggtgtctaatgtcttgaaaagcatcctttcatgtattttgcccaggtgttttggttgtggtaggtgggtaaaacatgtcccattactttcttttgataagaagttgaagttttctattttttccctgaatgacttttgtagctatattctttcaaggagtttgttcacttgatcaatgttgtttaatttattgacatacagttttttattatattccctgattattcattttatgtgtctgaaatatgtagttgtaatctgtgtgctctttcttttcttcttataattctgtctagaagtttattaattttatggacattttcaagggagcagattttgaaatcattgatttttgtctattggttattcatttcctatattattgactgctaatcttatctttactatttccttcctacagtgtactttgtgtataagtttttcttctttttaaagctccttaaggtagtagcttagatcattgattaaaatatttcttttttactatattagcactcagtactataaattaccttttaatcactggtctcacaatatcccacagatgtttgtattttatatctttatttttatttaatttgaacaaattttataattttacttgtagctttctcttttattagtgaattatattgtaggatttaaaaatttcttaatatttggaaatattccagttatagttctatttttaattttcattttaatttgcttttgtcatagaacattctctgtatgatttaaatcatttaatatttactgaaaattgtttacatgcacctcaagaaaatttttggaggaagattttctaaatgtcaataaggatattttggtcaatagtgttgttcaagtcttccatattattgctcatttattttctacttgctctaacaactgctgatagaacagtcttaaaatatcctactataattgtagatttgtccatttcttctttaggttttatcagttattgcttcacatactttgaatctttgttatgtacatgtgcatttaggatttttatgacttctttattaattgacctctgataattatctaatacccattcctattccttgtcctgaagtctactttgatattactaaagttactctagccttactttcattactgtatgcatggtatatcttttcacatctagcctctctgctatttttagtatacattttatgtctccatatctttaaacttcgtgtctttgtatttacatggcttacttaaatggcatgtaattaggtcttgtttttttttcttttattccatctcacaatctaggccttttaattggaatggttaggctatttgcatttaataaaattatttatatagttgggtttaaatctaccttattgctgcttaaattttatttacaccatctgttcttcatttctttttcccttttttcccaccttctttagagttgtattttatgattccattttatcttcactattagcttgttagctataactcttttgtgttttctttcccttttttttttttttagattttgtgccagggtttacaatacacatctttagctacctacaaataacattaaactgttttagatttagtgtaagaacttgatcataggttcttttttttttattattatactttactttactttaagttttagggtacatgtgcacattgtgcaggttagttacatatgtatacatgtgccatgctggtgcgctgcacccactaacttgtcatctagcattaggtatatctcccaatgctatccttcccccctccccccaccccaccacagtccccagagggtgatattccccttcctgtgtccatgtgatctcattgttcaattcccacctatgagtgagaatatgcggtgtttggttttttgttcttgcgatagtttactgagaatgatgatttccaatttcatccatgtccctacaaaggacatgaactcatcattttttatggctgcatagtattccatggtgtatatatgccacattttcttaatccagtctatcattgttggacatttgggttggttccaagtctttgctattgtgaataatgccgcaataaacatacgtgtgcatgtggctttatagcagcatgatttataggttctttataaaacagtaaatttatctttcccccattctagcctctctgctgtttttctcatatatttcatttctccatatcttataaactctaacatatattattagttttattttaaatacaagattatcttttaaaagttaaaaatgaaaaagaatacatctcttagctagggctgctgtaacaaaataccatagactgagtggtttaaatgacagacatttatttgtcacaattctagaggctggaaagtccaagatcaagtttaaggcagatttgattactgtaaaggccccattcctcagctgcagcgggtttccttctttctgtgtcctcatatgatagagaaatagctctggtcattgttcctcttcttaaagggacactaatttcaccatggggtcttcaccttcgtgacatcatctaaacctagttacttcccaacaaccccatcttctaataccatcacaatgggagttaaggcttcaacacatgaatttgggagaacacagatatttagtccataacagtgtgttttgtatttactcacatatttactatttctagaactctttaatctttttgtcgtagatccaaatttattctgtgtgaagaacttccataaactttcagtgttctttaagtgtgttgatgactaattttcttagcttttgtttgcttgcaaaggtctttattacacatttcttatgaaaatatattctcactggatgtcaaattatagttttacagtttttctttcagtagtttaaaattttctctcacctttcttgtttaaatattttctatggagaatatcatagtcatttgatcacattttacataatgtgacttttttttatctggtggctatttccttttttttttcttttattctttttttttttttttttaatgagagagagagagacacggccttacctgtcatctaagctggagtgtgttggcatggtcatgactcactgcagccttgaactcctgggagcaagtgatcctcctgcttcagcctcccaagtagctgggactacaggtgcatgtcaccacacttggttaatttttaaaatgtttttgtatagacagagtttagctatgtttctcaggctggtcttgaactcctgggcttaagcaaccctcccaccttggcttcccaaagtttggaattataggcgaggacaaccatgcccagcaaactttttgagattattttgttaatccctggttttcatccattttgattaagatgtgctttgttagggttttctttatggtcttcctcttggaatttgttgagtttcttaggtatatgatgttatggttttgctcatctttggaaagatgccagccataatttagctattgtttcttcaaatgagttgttttttgacccccttttactttttcttttcttttcttactttcttctttcttttctttttttttttttaagttttgttttgtttttgaggtggagtctcgctttgtcgcccatgctggagtgcagtggcatgatctcggctcactacaacctctgcctcccaggtccagcatttctcctgtctcagcctcccgagtgagtagctgggactacaggcacgtgccaccaagcctggctaattatttgtattttttatacagacagggttttgccatgttggctagtctggtctcgaactcctggcctcaggtgatccacctgcctcagcctcccaaagtgctgggattacaggcgatgcctggcccttttactctttcttcttttgcttgggactcaaattatttgtatgttgtattgcttgatattattctatatgtttctgagacttcatttttccctctctttgcttcattgtggtcagattctattgctgtgtctgcactttcactgatctgtcatctgaactgcctaatttcctgcttgggttttcatccattacagagaatataagcagtatgctgtacaaaactgcacgatgtacttcctcatttctcatctcttagggatcactatcatacactgtctgttttctatagcctaaaacagttattttataaattgttggggattttattatttttttgtttagtgaaaaagtatttttttttggatggaatggaaatatttcctcagtagattttgataatagtttcattatattgatcttctgttataatttctaacattcatctttctcaacaaatatttattgagaatctattatgctaggctttaaagaacttgtcctcaaggagccagcctactatacagattaaaaaatactacgaaataaggcagggcttgtagcagaaatgttgaaagggtgcaggtggagaccaaagagaaacatggtggtaatttcaacagaaatatatgtgatgcagacagagatgaacaactattttccatgagatggtgtaaccagaccaaaaaagagaagtttataaatgaggtgttttttttctaagatacaaacacttttaatttgatatgttgatttcagaaagctgagataaattctatatcccttaagaaattccctggaaatacacacacacacacaccaccctgacataatacttccattaaaggtttggcaatatagctgaggaaaatgtgtaaataaataaatttaaagaagtcttctagaactgagtaggaagggatatgtaagtgttgaatttcaagcacagcagaaagaatggccagttctacctgagcaagcaggaaatcttgattagaatattgttcatgtttctgattctaaaaatttaatagttcttggctgggtgggttggtgaaatgtgtggtgttgatggaatattatgggaaaacaaaatgaaaagtcgtagagacatgagtcaggtttctgtgctttgtaatctagaagaaaagttaaatggaaagaattcagagtgttgtggagataagaggtgttgttagagataggactgaaaagtttgcaagaattttttgtgaggtattaaacattattttgtgagattttattgactgttcattaagaacagtgaggtaaatgcattacttctagatttctttctgaaacacaggcagagatagcagtgctcttcaccaaaattgtcaatactagagtagaaggcttggtgggtatggagtaaatttaatttcagaatttttaggcctttaattcctgagaatatccacttagagaaatccagtggacattttacataatttgctacggtttatggaagaagttgtactaaaatagagtttggagatttatcaaccacaggttgttgccaaagtcattaatgcagattaaataatccagaagaaatgtgagaaggaataaaagatggaatactaagtagccttggggaaaaaataaagaagactgagaaaaacaaaaagaaaattgtcataggagccaaagaaagtgagaatttctagaaatatttaacagtgatacatacataaaggtaatgtgtggaaaatgacaagaagaatctgctgggctttgtagttagaaggtcagaggtgacatttgataagtggcgaggtaaaagactaattgagatgacaataggaagatcaggtgatggagaccaaggccaaagactaatcactctccaggaaatctggctgtgaagagaagaaggataagatggtatccgaagagagacactgggagaaaattattgtttttagtaggtaaaacacttaaatatatttttagcctccttgtaagaaccagtagagagggaagagttgaaaatttagcaggaaatattgttaatgacagtgtagatatggtaagactatctctttcatacacagctagtgggtgtataaattggtataatctttctgaaaagcaatttgataatgtgtgtaaagagcctgaaaaatatagtgtttgaccctgtaagtctacatatagaattccaccctgtagatataatcagagatgtagataaagatttatgtacaaagataataatcacagaatcatttataataaggaaaaaaggaaacaatctttatgctgaacaaagaaggcacaattaaataaattatggtgtattcacagagtagtcacaaccattgtaaatgttattttcaaagaaagactttcaaattattggagaaaatgttcttgtaatatattttgagtgaaaaaatgagaaacaaaaaagctgaatgcagagtgtaatctaaatgttgaaaactaaaaaataaagatttaaagaaaagatacagaaattagtagaagaacattagaaaactgagcaatgcctcagccttgacttaagggttctagataactacagtgatcgaagggttagttttaggtgcagtatcatctctacctaaatgaatgaagaaatggaaggatatttgtagatatggggaaaggaatgaagagaatttttttctgttaaatgaacagcaaatccttcatcaccatcaccatcatcattttcaggaactcacaatattaatatttagagataattttgtgtcagtttttattccatgtttttaataatcacagtattttagataagcaaaccaaggcacagcaaagaagaaccatactcaaagttttacacactctagaaaatggtggatgtgagattcatacccaattcacagtccagtcgtgagccttctgctgagagaggagtggagcaacattgggaaggagggacttaaaatgtatagggtagtcactgtggggacattgaggggacttgaccagaaacaggatgaaagagttggtttaatggtactgagggtcttattaacattacttacttgtaggtccaccagttcacaaaaccatgtgctataaatgaagtaacctgccatggttcaggagaaaaaaagagagagggttacattaatgaaaagttacagtgtgttcactagcaaaaaaaaaaaaagtaggatttgaaaactttgaagatgttggcaataaatgaagctgaatggatctaagtttaatatggaacattgggtttttgttttatagggaggtgaagtaaaggataaaaaaaagaatagagggaggaactgcagtacttgctgggtcaggggcatagtgagaaggactgaattggaaagttgatacaatctgttgtcctggaagagattgaggactttgatgttatatatatggtcagatagtaagatgagctatctaaacatctgtgaaaaaatgaatgactaaatcattcctatgatgacagaaaccagaagcagaggaagactgtgaagcatgtttcaaattgcttagtagatgaaaatgaagatcttcttcatctagaaaatctctaaatgatgaaaatgtgaggtagaggagaggtggtaaagtgggatgacttcaacttcaaaggatgaaagggctttgtatgcagaccaatgaactaaagatctacaatcagcaaagggcacagggataatggccatggactttatgacattggagtatagagagaaggattttcttggagaagaagcaggttatattcttatgttcagaacattgtctgatgcacagttaatgctgaatgcccacttatctaacctcatagacaaataaaaggctttattaatgtggccagagcaggagatagagggattctgtgaagaggtggaggatgtgatgggataggggttgtttactttggaacataggttgcagagagtataatggaaagtatttgtaaagaagaccagaaatggacaaaagaacatgatgggaaaatgcacagaaaaaaaataaatggacaagcatcaggtaaatgtttgttgattggaagaactagtgttcagtccagtgaatgagagtgacaggaataaaggatatgactcataatgactatcctaaggtgccctgggacagagctaactaagccctaagcagtctgagaaccctagcaatgttaagagcctgcagccttttctcagcactcaaattgcaaaacatggaaaaagctttatgatgacttttgaagctaattctgccttggttattggaggtgattagctgccacttgccaaagaatcgttggcttgaggtagctatggtgccaggtttcttttctgacatgaattgggtataataaagcagcttggtgtgggggaactactcttaaatagtactccttataaatgcgagagcattgattttaagaataaactggggataaatttggctattttctccaattcttagccctccatggtgtagaggtaggcatctggttgctagaatcctaaagtctcaagttctgtaactagcctatttctattttctgctccaataacttagtaaggccattgaggtggtacaccgtctcttcattagcttgcatgtcagtgagatgtatataaaaatctgaaaatatatattagttctgaggcaaataggtgaacgagataaatcactggggaaaggaaacacccctagctccctcacattgtgattggggtaatataattttctacaggaagaattattgacatgtagtgaaatgtgagatcaatatctgttatttactgaataaatttactagagtcattggtaaacatcttcagtaataaattccccaaattcttggatggatttgtgttttaattaacattcttagctggaaattagaggcagatgggaaggggtgttaataattccataattgataacaatcacttatgaaacagagaagcaactcatagctcactaattatttcagagagtaaaacactccaaattgttaggagaagcgctcagtgatacaagaagtcagtgaatgaggactgggtagaggcaacagccctgggtttgaattttggacccaccacttattagtagtttctaccttgtttctacctcaaggagcagggacaacctattttataagaaaggttctgagcagttcgatattaagaaatcattttgattgactttaacctagcatttcctaacatgctttatgccaggtctttctcccctataaaaaatattaatcccttaagaaattagagtgctgtagaaaactttaggaaacattaacagaaggtctccaaattcccctcccattgttggtcggtcagaattagcaatagcagctgatttttattaagtgctcactatgagttaagttctgtactatagactttaactataaaatctcccttaattcttacaacaactttgaaggccagtattatcatcaacaccattttgaagttaaggaaatgaaggcacagagagtttaagcatcttgcctaagctcacaaggctaagaagcagtggaagatgctgtaaagacaggcagtctggctccacagccagtttctgtagtcacaatgctaactattctagggtttaatcagctagtgtggttcagtgaataccaaatggaaagtaaagacctggaaactacaaaacagcccccatggagtggcatattccaaaggtccaggagccaatgtggaagccagggaatagagttaggaaaccaaagaagcagagccaaatgcaagagcagtgatccgaaaataaactgggagaagtctgaagcatttttctagactgctggatactgtctgtggcttgcttttatctctcattcatggtcttgtgtgtaggtaagcctgctgagtttaaaagaccaataataggatggaccttttggtttaaatgggaaattttcattaaatcaagacatggaaatctattcaaactgtagtctcatacaactagaattaaataaagaagagcatactaggccaaataaatataactaggaaggcagcagacattgctacatttcatttgaaattttaaaattcttatatgtcaagggatatactaactacttcatcatggataccaatgggcagtgcttgctccttagcttagcccaagtagcttttaaatgcaatgtcctattttagcaggatttatggttttgggagtttaaggtaggatggttaaaatagattgttttctttcccccctctacaatgtggcattttctttagggttaagaagtctcccctattgggaggtgggaaccatatgatgttaagcaatgggtttatattttattaaacagaggaaactgtattatctagagaggatatttggatgggaaggcaagccactgtgaaatccatcaccccattttttctccagggttgatttactggcctcatacaggtttctctttgaacccttgttcatcctgcagctccaggatatgggtttctcagtcggaggtgatgacttctgagagtcaaggaggtctattttgctcacaggtttccaagagtctaacgtagaaaaataagcaattgtgcatatttcctgagtccaaaacttgttcaaattttgagtagtctgctggatgcctctcctcttctcctatctccatagaaaaataaattctcaaaagttgccagaagcacctgtgtttgactgtaatggcagtttggataccatttaagcaggacttgtcaaggcaaaaggaacaccaagaaaaaaatgtggccaggaaagcatcgtagtttcaaaataggttccttgaaatattcattaagaataaatttgctgaatcattctctaaaacctatcaaaaatacctaaattttaccacagagactggatccaggagcctctcctctgtcttctgagttatggtgtctctatccagtggtgagactagattagcaatatgccaaaagaggaaaatctgttctcttgtctgggtgattgttggctcccacctccagcactttgtaaaattagagaggtgagctgtcttagatctagtttaaagtatctggtggtgtttggagagttggccatctgatggtttcaatttaaatgaatttatttgtgcaaattaatattcgaccatattgaactatagcctcacctcaggctgcctcatcaatcagggtcaaagaatatgcagatgattgtgggaccactcaatctgtgtttctcagctctagactccttatttaaatctaaaagtatatttgctgttcttcagggactgaattcctagctcatggacaactttgcaaaggttccttgtttccaaaccagatttgtcttctctctgtagtttgacagagtatcccctaataagatttctgcattcctaagctaaaggataagaactacatctgtcactgagagggtacctaatcaagacctcatctggtgtatctggttacctgttttatctattgctgtataacaaaccactcactacttagtggcataagacaatgaccctagaattacgttcacagctcttcgggtaaagaattcagacaaggccaactagaggtggcttgtctcttttccatgagatctagggactcagatggaaagactccagctggaagactctaacctggatgtgacttgaatggctgaagctggaatcctcggaagacttttttactaacacatctgaaaactgggctgggatgatttaagcgctgggctcagctgacactctggaacagagcaaatatccatggtatcctcatgtcatttgggcttcctcaaagcatggtcgcctaagggtatttgaatttattacctggtgggcagggctccaaattcaaatgttccagtgaacaaggtggaagctgtgtggcctttatgacctagctttggaaatcaaatatactcacttctaaccatatttaaacggtcaatgtggtcacagcctgcccagactcaatagtggataaaatatactcccctctttttctggaaagtgtcaaaaaattgtggctatgtttttaaactgccacatttactaacacatttcacaaagtaattaaactacctttttaacaggtcccaatatgtttccaaatatatattgcttctttagtacaatctactttttacttagacaactattctatgaatatgtccgtggcaaaaaaaaaaaaaaaaaaattcagagtaatagcatagagccagttgaggaggctcaggaaataacagtctgtagttattcttttctttggacacaaaatgacattactgagtttcattatctatcttgatcacttaaattctgtgggaaataaatttcatgaggaaaaaatagtttttttgtatctaaaaatgttcaccacaaaatgttggggaccactggaccactttataaaagattattaaatatggatgttgaggctggctgcattgagaccctgccaagtcccatgttaagctagttgtgtccctttaactactagagtggtttcaccatgacctaagttcttcatagacttgcaaaatctgaaattcattattagtcaccatactcttttagtgatgagatcacattagtatcaggagactaatgtataaaccagacaccagtttaataatttatatgaagaaatatgacgttttagaaatactgccattcactggccttcacagtcattttctggaagcactctgctgaaaaagcagataatacttagaaagctatttggtaaatattgcacaaaactttgaaaggcaggtatgatgttatcttgtatacccaatgcctagtagagagtctgatacaatgaggctcccagtaaatgtttggtgagtacacgaaggaataccttggaaagagaccttagggaggatgtaatctgatggtattcaaatatccttaagattcttgaggaggtgatataggggccatcacagaaagcagtgggcaggaagaagcaggggccctagagttgctctccttttatctatttcagatattagactcttaataatatttaaattgggaaaggaattatgatacaaagtattggcagctaaaaataaattatgagctttgcacaaagtcacccaattagtaagagactaacctagaactcaaataggaagcttcttgttttcagctctgggctctttttactatgcaacctgctaataattcactgggagcttggcccctaatttggtgtgaagttctctaatctatttcctgacaatagcatttggcatctttccagaatttactatagcattttcattttctttctgagaagcaacacatggcatatcaatcgtcaccttataaaattctttctgccctagtttttttctctttctctcagaccctcattcattcacctttttaaaaattattattccttgggcaacctcacagacaagttattttctgaagagaaaaggaccaaggaggatgtagtggataagtacacaataaaatccaggcaaaagctcattctaaaacacattttcctgaaagcattgttatcactgctattgttcataccattccattcattcccttgagctgccatctcctgctgatgctttaaagaggtcagaataaccctggtaacttacttgaacattaaaaaaatctaagccatagcaccagagaagtatttcttatgcgtcttcagctggctgtgcaattgaccttgccttgaagctatacacactacctttctaactgcagtcaactgtagggatccaagacatgaagagagccagagatgcaaagcgctcttagaatcctgaaacatagccttctcattttatacatgaaggaactgaaacctagagagggggaggaatttgctgaaggccacatagctaattagtggcagagaattgtgtctcctgactccaagtttaagactctattagcaatagccgacttatttttccttccagcacaatgcattgccctctacctgaagccctggtgacagggcagtctttcagcattgcggaggactagtgaggtctggcgactagacatggcaccctactagctggattcataagggataggtctagagggacatacaggtcgagtgggcatcagtcaggacaaggaaacagctaccagcacaaggagcagagttctctggctaagccagcagtctgtcactccaactctttcttgtgacagatgactggggcattagcagtgtgctcacccagagagaaacaaggtgggagcagatggtaggaagtgcaaacaggtatttccattgtgctcagtggaaagagatgagcaatgaatcctactctggagcaatagttttaaaactttttttaaaaaatagcaaaagcttttatttttccagacaaaatcttgcctgggaccccagtgcataaaatggataaaagcagagtgcctcttgttgaatttgagtatagaataaaatgttctctgaggctccaatcaacagagtttgggtactaatgacagcaggagaacctcccactaggagaagttttggaaagctatggttgtagtgactagtgggggtacaattgtcatttagtggacagtggccagggatgtcaggtatgctgcaatgtgaaggatggtcctagatgcctagatgttgaagacttgtcccgtatctcatatgacggatatgaatatctccccagacattcatgtcagtgaaaaagaaatttgtaaaaatctgagtctagaacccaactctattttatatgtgacatggagtattaatttcacagttttgatatacactgtattttccagacatgcaacaactgggataattgaaggaagagtagactttggttattgttgttgttaggagcttcatcaggacttgtttaccaagagagagaacaaaaaggttaaaagcaaggattctggagtcaggcagcctggctttgaattgcagatcccatacttactaactgtgtatgacttaagacaaggtactcagccactctgtgtctcagtttcctcagctgtaaattggagatagcaatagtacctatctcaaaattttatgggaactcaatgagtcaataatgttttacctaggaaaattatacactgctgacagtgctacttgtgttatttgtggctctaatacaattatatatttattgtcctgcagttgcaggagttgcattcctggtcattacaatatagacatggaagtgcatatttatgtctttaaaaatatcaactgtaagaaaaagtgttggcactatgtcagtttaatgttgtcctattgacttaaatctaaacttgccaagggtaagaatctaactgctttattatgtttttttaaggtagccatgctcagccttttacatactgagtatgcattattttaatataaattcatttccttatatagtttatatttaaggtttatgatgatttttcaagattatgtatataggaagtttatattaaaatgttgtttcagggtgctaaagaaggtattacaaagtgctcgtaacagggagcatggggtgtgattagatggtgaaccgctgcaataggtgaatgagaatcccttggaactcctgaatttgtgggtgatgaaagcatagttgctctgggaaaagctgagaagaaacaagaattttctacaacctactctatttttctctaagaccccttgcaagctttagggcttcagtaaatatggctttgggactgagattctcaaaatatatctgaaccccctcagtgagcttcttagtagactaagaataaaatgactaacaatggaaatattctcagttgcataaaaggccatttgtaattaatgtattaaaatattaaggattactaatatctggcattttaattataaaattcaccaattctcttcaagtttattgaagattcagtttattattccacaggatattttgctaccatcaatggtctggccatgttgaaaaactcagctgacacagacaaaattcttagaatttattcttagaatttggggaaaggatgctttgttacccaaacattaaaagtgttttaagttgcttatggcttttaattactgttattttctattcttaattatgcatccttagttatattaatatcagttttgtttcttgtgcgattgttttctgcctaacgttatgtaatgattctcatttttaatagtattattttgagccaataagttggcaataaaaagactttaaaattattgcattcccattacagtgtgaattatctgtacctctattgttaaaaaaaggtatgagcatgccttgcccaatctccaatttgcttctacagtggcaaatttttgtttgtcatttcaataacaagttattatctgactggaaagtgaaaaaaaatgaagtgggttaggtagaacctatgaccatacctaaagggatcaagattgataaaattcgaaagccctctttagctcagaagttacacctgggaagtggatggggtgtagaggagccaggagccatgatgccttgtaggtaagataaaggaggcatatgttcacccagagacaggttctttattgcctttcatctgaaagcaggtttgcagaacacagtagacaggccacacttaagaatgagccaaggttctcctgaggaactctgcctagcatgacagggaagaggcgagtcagatctgaaatagtgctactctgcctttagacacttgagatatttttctgttggaaattctgggtgttttttttgtttgttttttgttttgttttgttttgttttgccagattcaattcatccatgagcaagaagaacagacatatccttgaaatgccaaggacctctatcctaatagagataggaagacagatccatcagattatttttaaaaatatgaaaatttcaggggcctgcctactttctatgaaaacacatgcatttgtttttcaggactaacataacatctaagtagagtaggacgactgaaagaccaaatcccttgcaatcacaagaccattctagttttgagggacttttttgttttgttttgcttctctggtggattttgtatgagccctagaagtgaataagactgggctgatctccacttgcaagaaaaagtcttgcaggagtacccatccccacctaaacagaaagttctatagcctcagtggaaaattgctcttgggttttcttccagccttagaatttcataatttcaggggaagtcagagagatttttactagcccagttctgctctctataattgtctttgccatagctctttgcagttttggacatagcctatcaaaatggacttccttttttcttctccttcacttgcatttaattaaactcattgaattaataggaattaaagaccatctatatgccacaaattttgctaagtttagggaggcaaagataaggaatgtgatttcaaattgctcaaagtccaggaaaaggtataggcaaatgcaacaatggtgataattcaatagaagcgtattatgtttgagataagcaagggatgctatggagtcgagggtggtgggttgtagtatcttgaatccacaacattgtacaagtataagtagcactacgtgtttagaaagagattaaatctctatttgtgtactttcagattgctagctttttccccttgttaaattggattgggacacaccaaatgcaaatgttactgctgatgacacttactattttttctttggattctttctctgaaaagtataatgaagaatgaaacttgattaatgatatccaagcttcaatagtaattaacaattactctatgccaggtacttatatatgtagttttctttatgaactcatttaattcttaccactaccttacgaggtgtaggtattctcaaagaattgaggtaaagatatatgcagaaacatgatcaaggttgcaaaattggtacaaagtaatcatgctaagagctcaaactttcttcagaaaatgtatctaaaattcaaatacttttctaattaaaaacatcaatggctccctttgcttagactcgagagagcaaagtctgatatccttagtgtaacattttaggttctctatgatctggtccttacctcttatccaatatcatttcttgccttctcttaccttaaatttgtatttcaccattcaaacatgtttcccaatatactttttcaaaacatttttgtcttcatcattttaaatgcctgatatgtacatgttcccctgctctttgcaaacttagctccaacattaatcacctcttctagaacatttccctgatagctccaagccactgatggtgcctcttctgtatgttcacttggtagtctgtgcatatctgcaaccagagcttaccacattgcactgacattcatgtgtttctctcctgtattaagctgtgaacacctcaaggacagaagccatgccttagtcatcttgatattgccagcatctagcagagtagaacctcaggacatatttgctgcaagttcctgattcataggatgcactgtgcagcagtttggaactcagttctagagctcaggtcctgcactagcatttactgccatgtcctctggacaaaggatttaaactctctgagaatcaattttctcatttgtaaaatggtaaaaatagtggtatcttcaccatggttgttgggtaaacacaacaatggatataaaatagttaataagctattttttacataatagtcacttataaatattgtcatcaatccttatcatcatattttgaaagcattatactcaatccttttaagaccacagcatgtctgcttaaggctgcaaaagccttcaaaggacttctttccagatttatccctttgccattttttagggtttgtcaatccttgtggtcataaaacgacaagaagaaatggtcccatacatgaatcatattgttttccactcactcttttgccctcttttcagcagtctttctctatttggaaaaaaaaataggcttggaaataaagtgaggaggttaagaaaaagtagcttggaggatgggaataaaatttagcccaagataaaattattaggcttgccacattttctgtcttgaccactagaacatgctttaataaaactatttagaaatatgttcttttctgattcatcctaacaagccatcttttctagctgatgaactggaaatttttgtaaataaatgtcagcagcatgatattttctttaaatgatagagactttaaataactgaaaatagtttcaaagattaagtgaattatataacaatataattataaaagctaacatttattgtttgtttactgtgataagcactttaaatttcttaccccatttagtaattataacaattcagtgatgaagtagtgccacttctatttccattaaagaaatgaagaaagtaaggcttggagagtttaggacttgtccaaggtcaaaagacataaagatgcaaacatgagatactaaataagttctgttgactcctaagttcatgctctttatcaattcactgaacaaatacatgcacatacagacatgcttattatgcatacatgcatgcatacacatgtgaaaagccagtatattttggcttctaattgtgtacagaaagctgcaactgatatataaaaatgaaattatttgtttcacattacatattgactctgatcaacaaataaaaaagaaacaaggtacagtacattattttagcctgtttctgaagatcatgaagttcaattgagttcaatttcaggagggactttagtattagagtcaatatggagcaagaatggcatttttctttttcctggtgacctttgagctgtctaagctcccagaagaaagacacaagatttgctttctgttttgttttgtttgtttgtttgtttgtttgtttgttttaaacttctctacccagctgtggctcactgttcagcaaatacctccagtctctggaaaaattaaattcattcttcttttctaatgagcaaaccctcctctgcctccagctcagttcatcatttgtttgattgtacatccagatacccgagatgctgtttgcttgctttctcttaacctgagttgttgaactttaaagatttggagcactacaacattattttaactcatgccactaagcacattactcattctattgttattgagtcatgaatcactccctggcctttacccgctaccaggtttgcagttaactactgagagcatgttctaagatgcctcttggaaaataaaacctttttctacttgttacgtgtcttgttatctcattatgctgagggagaaagaaggattagtctaatatttgaatcaaatcaagtaggctagtatgaaaatactaattagggagcaattcctagaaaaaaactacatacttatttttttcttttctttccttggccagcctgggaaatctatgctgttgatatctgctgagatgacacaagtgtctaggtagaaacaatcaaataggaaatgttcctaataattcactcactcgtccccttccctccccttgccttcccttcccttccctttccttcccttcctcttctttccttccttctttccttctatttaagccatctatgtgattatcagttattggatgcctaccataggtaaaacattatttaaagtgcccagatttagagaatggagacacaaagattaatcatacctagtctctacctcaagctatttttataatattaggggagagaaaacaggaaagtaggaactaaaatccaaggtgggaagtgctcagtgctataaaagatgcacagataagcctatagaagatcagaaaatatattcttcctgctagagaatcagggaagcttcatgactgtagcagcatttgtactccacctttaaaaagataggagtgttggaggggtgagggcaacattccaggtagaagaatgcagaggcaaataaagatgagaaatcttgtgtttctgtcatttcctttatttcctctacaagcctctggatctctaggccagcaacccttaaacctcttgagattcttttttcatctattttcccaaatcaaactcatttgttctgtattgaatggatcttaaccaccatctaggtgaacaactggccaatctattgatttgtccacacacaaaaatgtcattcttatattatttcattcatttaagattacctgttcatattttaacgaggagtttctaagaagtgaccctaattctacacagacaatttcaatgatgagggcacctgtttttgtttgagggaaggaagggatacttcaaatattccctcagaacagagataactgtccccatagctaacttggcattcccttagtgaaatgttactgggcacaataaaatctaggtaggatcaagctattgtgggcaagataatttgtatgcgatcagttcagttttttggaagatgaataatataggaggaaattctaaggcttacgtgggacaccccgtagtatattgcaatattggagtcacaccagggaattgcataactccactacctctctgtgttaaagagaacaaaatatccgttaaaatttccacaagtctttaggttccaacagattcatgcttcaaggtgtctgttcagataatctaaaataatgtactactttaccataagaggaataagagaaggaaaagttaatatttcctaagtactgttacgtacgaggtactatttctaagatatttctcctgcacaaaactgtcttctggtttatcatttcactgacactaagatgtgatctcaatctgggcctatgagattctgcataatctgacctctgcttgctttcctctttcccctcatctcctgtgactgtcctcattccttaaattattttactcacattaactttctttacttaaaataacacctttattccttcctcaaagtttttggatttcccgtattttctgattggggaattcatcccccagagagccctgtggttctcactctcttttaatagagtcttcactcagagagcccttcccttattacctggtttaatgtagatctcccaccactgattttagctgtctgtgttccctttataagataaaaatcaagagaacagggacttttatcttgcttgctgctgaattcccaaagccaagaacaatattcagcacatagtaggcatttaataaatatttattaaaatagaggaaaatattgttatctccattttacagaggagcatattatattcaagagaggttgaaaatttatgcaaggttgccagtctaataactgaagcagctgaggatttgtacccctgtccctttcactgcaccaaaattactttgaagagcatgctctagtaaatgcttcccttgtattgtagagagttttacataagcacaatctttttttccacaatgcctctgttataattaggtatttgtttttctcacttcccatttcagtaaaacctaatctgtgttgtcatcttctgtagactaattgcagggagtctactacacatagtaatcattaatgcataaaatatactaactttaactggtataaataatactagcaatggttctctgtctttctgtctgtctctctcttcctagttatttgaccaagcttttgttgcatcgcttatcttagttcaatgcgtatcagaactggaaggcatcttagagagagacccagagtggaaagggatcctttcaatgtcacataaatccctatagtgagtctccatactctttctgatattttcatcagccttatatcctgcatatgcgaaaaacaaaaggaaaaaaaagctaaaagcaaaatctaacttaatgccctaaatttttcctttgccttatgttaacattggttataacacaacttccatgaaagaacttttatttattttatctatgctttttttaattatgtggaggcatgacagagctttatctcagtgtcattttaattggaagtattgatgtctgaagttgcaccctgctgagaaaatgttatttatgtgccacatgtccccagcctaaacggttctgtagtatattgtaatgttgttcatagctcttgttttcctttccactcctataggaggattaaacagccacattccttgtcacataacttatagtgccccctgtaggcatcattgtcaggactggccatgtgacttgctctggccaatcccctatgagtgaacaagatataggttgcatccaaaaaggagctttgagtttgattcctccctgcttcaagaagcagtgcattgtacaaaggggctgctctctcatcgtgaggttatgaatgggtcatgtagagcagatttacagtggatctggagcaaagaatgagattacttgaagccttcacataatatgtgcaagaacaaatgttttgttgttactggtgaaatccattgaaaaatgttggatttgtttgttagcatagcaaaagttgagtagttgataagacagctttttgtaagtggaaatgtctaagctgtggcttgtagctgtttggtatgattttgggtagaatccagaatttcatactggatagaagccaggattcagtgacctcttacggatcttcaactttgagattttatgattctttgctttactttcttagtacttctattactcaagtatttatgaaatttattcaaatgataccttaaaatcctgatacattcatgacatcatctgagttgtacatgtacagttaattactcataatttttcttcaattgaactctacctttgtacttaaattaacttacttaaccaggatacttgttatcattaccaaaaaatagaaaaccaatatcatttgcattaaacagaaggttattctgtaaaaatatatatactatagaaaataaacttattaattttagctgtgcctgatttattcctattaatatgggcctttctcattgtctttcttaacaaggattattaagaagtgttagagaactgagatattctcttcattaccagaaagatgaaaaggaaaatcaatagagggtagcatactcactgaatgatttggcactgctcaatctgtgcctgtcctttcatggacctctagaaagacacaccagaaaatagactggatggagtacaaggaatgtcacttctctaaaagataattatctttttatgataatatgttgatatcatgggcactgactttgattttaaaaatgatagagaaatggagcaagatagccgaatagaagcctccaccaataatcatccctgcaagaatagcaaattgaacaaaaggaggaaccttcataagaaccaaaaatcactgtgagtgatcacagtacctagttttaacttcatattactgaaaaaggcactgaaagaggaagagtgtaggaaagacagtcttgaattgctaatgccacccgtccctcatccccaggtggtagcggcatagtgcaaagagagaatttgaatgtacttagggaagggagagcacaatgattgtgggactttgcactaaaacacagtgctgccctgtcacagcagcaggcaacactaggcagaacacagctggtgttcatggagggaacacttggtgcagctctagcgagaggggaaacgtccatcccagcagtcagaacctgagttctggcaaggctccccaccacaggctaaagatctctggtgtcctaaataaacttgaaatgcaatctaggctacaaggactgcaattccagggcaacttcttgtgctttgctaggctcagagcaagtggactagtgggacatgtgatgtagtgagacaccagcttggtggccaagggagtgcttgcaccacccctcccccaagcccagacagtacaactcacagctccaggagagactctttgcctttgcttgaggaaaggagagggaaaggtaaagaggactttgccttgtaatgtggatactggttcagccacagtaagatagggcaccaagcagagtcctgatgcccacattccagctcctgggagcttagcacagagagagagagagactcaatttatttgggacaaagtaagggaagagaataagagtctctgccttataattcaggaaattttttcagatcttatccaaggcaagcaaggtggtacctctatgaatctgcaagagccatagcattactgggtttagagtgcctaccattgcaaatataggtgcagttaccaaaaacttagaccacaacaccccagtcccttcaaatacctggaaagccttctcaggaaggatgggtacaaataagcctaaactatgaagaatataataaatacctaactctgcccaaaaacaatgaacatccacaagcatcaagactatccaggaaaacatgacctcaccacacaaactaagtaaggcaccaggaacaaatcctaagatacgtgacctttcagatagagatttcaaaatagctgttttgaggaaactcagtgaaattcaagataatacagagagtgaattaagattcctatcagataaattatataaataaaaattataataaagttatttataataataaataaattataataaataaaattataaaaattataagaaattataataaaaagaagcagaaattctggagttgaaaaatgtaattgacatatagaaaaatgcatctgtattagtccattttcacactgctataaagatactaccagaaaatgggtaacttataaaagaaagaggtttaattgactcagttcctcattgctggggaggccccaggaaaattctaagcatggtggaaggtgaaggaaaagcaagcactttcttcacaaggtggcaggagaaagagtgcagggaaaactgccacttttaaaccatcagatctcctgataaatccctcactatcaagagaacagcatggggaaaatgatccctatgatctaataacctctcaccaggtccctccctcgacacatggggattaaaattcaagatgagatttggatggggacagaaggccaaaccatatcattctgcccctggtctctcccaaatctcatgtccttttcacatttcaaaaccaatcatgccttctcaacagtcccacaaagtcttaacttattccagcattaactcaatagtttaagtacaaagtctcattggagacaaggcaagtcccttctccctgggagcctgtaaaatcaaatgcaggtaataaaatcaacatggattgagggcttaaatctaagacctcaaattatgaaactcctaaaagaaaacattggggaagctttccaggactttggcctgggcaaagatttcttgagtaataccccacaagcacagacaatcaaagtaaaattagagaaatggggtcacaccaagttaaaaaaaaaaaaaggacttttgcacagcaaaggaaacagtcaacaaagtgaatagggaacccacagaactggagaaagtatttacaaactatccatctgacaaaggataaataaatagaatatataggagctcaaacaaccctataagaaaaaaaaaaactgataatctgatttaaaaatggccaaaagatctgaataagtatttctcaaaagaagatgtacaaatagcaaacaggcatgtaaaaaggtgctcaatattgatcatcagaataatgcaaatcaaaactataacgatatatcatctcaccccagttaaatggcttttatccaaaagacagggtataacaactcctggcaaggatgtggagaaaggagaaccttctttctccattagtgggaatgtaaagtagtgcaaccactatgaagaacagtttggaagctcgtcaaaaagtaaaaattgagctaccatattgtctagcaatcccacttctgggtatatactcaaaaggaaggaaatctgtccatcaaagagatatctacactcctatgtttattgtacactattcacaatagccgagatttggaagcaacctaaatgtccatcaacagatgaatggataaagaaaatgtggtacctatatatactgaaatagcattcagccataaaaaaaagtaatatcccatcatttgcaacaacatggatagaactagaggtcattatgttaaatgaaataagccaggcacacaaaggcaaacttctcatattctcacttattttgaggaactacaaatttaaacagttaactaatagagatgaaaagtagaaggatggttaccaggggctgggaaaggtagtgggtaggagggaagtggttaatgggtacaaaaatacatttagataaaattaataagatctataatttgatagcataaaagggtgactaaagtcaacagtaattcacagtacatttaaaaataactaaaagtgtatatttggattgttagttacataaagaaaggagaaatgcttggggtgatgaatatcccatttgtcctgttgtgattattacacatcgtatgtctgtgtcaaaatatctcatgtaccatataaatacacaaaactactatgtacccacaaaaattaaaactttacaaagtgataaacttcaaattctccttccggttttgcaccatcaccagtgtccacagtcttgtctttttttcctcgagataaacagctctaagtcattcatcttttccttatctgatatggtttctgtgactctgctctactttcctttccctgactagtagtcttcttatcaagctctctttctcttgctcagaagtaaacagaatttatattggaacaatataattgatctgaaaacttctcatataaaattctctattattttcgtgtctctcaaatttaactaggacatcataggagactttggaatacaggaaatgtctaatgattgactctctgtttaagtataatgagaagttttcctgatgcttttactattagctttggaatcagtgaacctttaacttgtaatccctggggctagttttgttttcattcttattaaattggggataagggcagattatcccacaaattgtctctctgttcttattcaggtagaaatgaaaatcagccaagtgagaagttacagcagcaggacctggtcaaagtggatagggaagaagggcaatttccctgtctgaaaagaacctgactgtctcacaacctggcagatcctttcagaagtgaagctattaggctgttcattcagcttcacagtgtcggccacggatatgctaaattgtcacacttatctgaccaaaaaaatcctaggcagtaatttctgctttaagctaaaatagctttcagacctctttggctagtgaaaactaactggatttttcttcaatgaatgtttgatttaagctcctctgcatgtgcaatgggaaagcgactgctcttcccaccaccagaaactgctcattagtaagtagatgtgcctaaccagttgtgccagagaggggcaaagaagcctttcaggcagttaataatgttatggcatcctgttcccctcagaatgcttcattttaattttgtgctcaatatgtccctaataaaccaagtggggtggtctgaatggttggggaaatacccctgaactagtttttactgttttgccttttatctctttctcacaacttcttttctggtttatgactatatgtatatagtcttggctaaatcactagtcacttaaccggattactagtcactttacctcagtttattcctcaataaaatggagggctttacaatgcctttctccaaaggccattgtacatatttaatgacaggacatgtgaaagtttcctagaatactgtgtagcacataataagtgctcaataaatgatgtttaatgcagaatcaaactgtattaaatattaaataatgttcctctaatgtgaatgacccacaggtaaagtctctcccgattcaaagagcttatagggcaagcctacaaagacagcttcataaagggctcataaaattattcatcatttctattcatacaaaacttaatgactgtggagagctcagaaaagagcagtgaaatgatgaaagttccatgaggtcattcctctgagaaagggttagaggagatggattctttaatctgggcaagtgaagattgcagcatgacttaataatggtcttcaaggatgattgatgttagtagcagagagagtaatgtaagggttgcattaaagtggaaacacacccttataattctctcaagacctgctagatatttcctaagagcacaagtaaatgaaacagattcctattgctgatgagaatagatattaaagctggagtcaagaagaaaatgcccctgcatgtttacttgtcagagacagcatctggatggctgatggctggacattgttgagactgctgtgcctcgtggactttaggcaatttcacagcatctgctgctgactgtaggattgcctggcaatctgggctagccccacaatgcccaaaacagaactgactcccattgaatgtgtgacaagtatctgaaaaaaagaactcatttacacaaagagtatgccatagctccgctggtagaggtaagaattttacgggtattggcttagttatcttgattggaggcaaagcaggccctgcttttaggttcttataggaatcagaaccaggtttgaattcaatctaccacttactagatgggtgaccttgagcatagtttataattcccctccctgttctttgtatactagtcagagttcattttgataaataatagaaatctactttggataaatttaagcaaaaaggaattaacaagtgagatgactagtttatagaattgacagaaagattaaaaattaagctgtagcagaaaccagagtaggcaaggcaaaggaatgctttgcataaggcatcacaccaattttgctgcaattaaacacttactgctctaatggactgtggactccactgtagtgttgagtaatctccaacagaccccacgcttttatgtcattccccaaaagttctgggtaggagtatctgattagttgttcttaagtcatatgccctacactctaggggccatggtactagagagggaatatctgttcccaacaggctgttagcatgccatacctccacttatcataggatttttcccaaatttggatgctggtcacccagaattacacatgtcgactacatttcactcttagcttttgcaaagcagagataatattctactgctagagttgacgtacatgacatgtactaatagatgacaaatgctagctgtcttaataaaaattacagtagtggtgatggttgttggagaaatttcccagtgggaactgggtgacttctgtttactagacactgaactctttgagggcagattactcactctccagtggtggaactcagtggccctcaatcatggccgtatatgagaatttcctggagagcttaaaaaaaaaaaaaagaaaaaaagaaaaactgtgacagtgcctttccttttgtttgtttgtttgtttgtttttccccccaaggaacatggtatttgtaaatgattagcattaaaattgaaacaaaacaaaataactgtcatagaacatttatatacctgaaaattgatgtgatggatttatggggcccatttgattaatagtggtttactctactattattaccattaggcctctataattttttttttcttttttgagacatagtcttgctctgtcgcccaggctggagtgcggtggagtgatccattaggcctctataatcttaatagtataagagtgcctggcactgcctttccaacattaagtatgttaggcaattccaacaggtacttatagtatagtatagctgctctgtattgatggtgcaagtcaaggccagattatttaagtgtctgaaaataagataaaattatccttttgttaatgcttaagcacttcaattgctcaactacctagagaccgaatcactttaccatgaatatagtcgacagaactgcttccaggtaaagctaatgtgttctgtacacatacaatatactccccaaaaaggatacattttcttgtttgcagtacctgtcaatatatgcttcctgcaaagtacgtcttcaacaagctaactaaatgaactgctacacagggttaaatgtaggtctagatctcccaaatccaatgattttaatattgtcattgtctgaatcaagaatgatgttatctgcagtaattatcctgttcgtttagcaattaaaaatgctagtaaaacagttttgcaatatgtatcaagatttttgaaaatctttacacctttggagtcagtgtaaaagcttaatttaaagaggatgcctagaaaatagtgtgaaatataaacaaatatttttatataaaatatgaattatgctattagtaattagttcaaagagtgaacaaatagaagtaaacaagtatttagcataaggtgtaattaagtaaaataggatacccaaataatggaatattgtgtggttattatacccatccaaaagaaaaatgaaattatatatagtatatatatacatatacaaacacacacacacacacatatatatatatatataaaatattccattatttgggtggttataaccacccaatattccaataaccaaacaatatcccattatttgggtatcctattttacttaacatatatatatatatatatatatatatatatatatatatatatgtcaaatgtgacctcattatataaaatatcctaagtatttagccagcgttaatagtggttgtcttgagtagcggaacttaaggataatttttttcccatgctatatttttttgtataaatttccaaactttccatagtttttgttttataatgaaatgtccctattgctgtttttcctaaaacaaacaaaaaaaaattgctgacacaataaatttaagcaacataaacacctaaggaaaaaggtgaaattcatctccttatgccccgagaaaccaccaccattttggtgaccgttcttatatgcatcatctttttaaaaaatattgacatatactatacacttttacaataaaggtatttacattgctttatggtgctcaactttattcaattttttttctccttacctctccccttacatttattcttccacatcttcatgtaatttaaccaactccccatgtaaccacctaatatataaatttacaaatgcacactcataagaatatatatgtaggcttgtgtttatgtatgtatacatatatggatatgtatatttgtgtatagtagatgatatgcatacatatccatatatacatatatatgtgttatatatacatatgtacattacatatgtacatatatgtatgaataaatataaaattatagaaatcatttgaaattgtcaattttcaactgctttgacttacaaacatctcaatttcataggatatattctccaaatcaacagactgatttgttttgatggtattaaatgatttcagaaatatgactccttacatgcagttagtacacatgtcttccatggagaggaaacaaaaaagcaagtagacagtcacagttcacatagatttcctaggagagaacactggaatataaccaagaagtgaccagaaacactgaaagcaaaggagagggaaataggcaggctggttggccaggactgactaggaactgggagaagctcctggacataaggaaagggtgagtgagtgacgtcagggtttcatatacttgccatgtataatcctagccatggaaaagctcctcaagcctcacagccttgagactaatataggcagctgcctagtgattgtgccaagcttcagaaaaggaattcacacagtcccacagatttccaaaccctgagcagctgcaacatagtgccattctgagagctcagccctcaaagactaccaaggagaaagaggggaagccaggcactttcatccaccctaaagacaaatctcacctctcccactgctgtgagctgttgtgggaccaagatgtgaggaaatcacaggccccatagctgtctgcctattctcctcccactgagagtggcccccatcctcctcagtggcaggcctccaatcctgcaccagtccaagttcacagcccttagaggactgtgtcctccactgggttcaacactgctgttgccactgccagaccaggaagggagaagggaagctaggcaatgtcgtacattccaagtacaaatactaccgcctctgcttgcgagctgctgtaggaccgaggtgggagaaaatcacaagttctacaaatgcctgcttaagctgctcccactgagagtggccccgccctccctggaggccagtctgcagcacagtcaccactgcacccacctgaacattctgccaataatctggggaccatcccattcctgcctattacagacagtgccagaacatcctaccagaaggcctgaggacaagcctgctgtcctggtcccacccccacaatacttaagcatgacatccaggcgcctgcagattgcccagcccaatccacatgtgttggcacctaaacacttttcccagggtttgaggttatgccaacccaactgctgatactgccacagctagtacctacctgtacaagccacttgcaggccacagggatgccctgaccagcccatcacagccaccgccaacatcaccgtggaccactggggttccggtgggttgcctcaccactacttctgccattgcccacaaaatacccatagaccaggggccctaaaacccacccaaatttctggaccattcctgatactaccaacatccaagcaagctacctggaagcccaagaatcaacctgcctggacttacgaacactagactcaccatacaccactctggagctcacagacaggcatgctcagctgactgctgccaccacagggacccgaagactggcccacctggtatcctagtcctcagcaaaacttcaccacagcctccactagtaaccataccctaagccactgaggaaattgcagatatcaccaatgctgcttataggccaggaaatcatacaaagactgaactactgcacaaatccagaatcaaagctgaaggccccacccaccaacaacatatctacatcttcagcaaaaagccttctcctatgaaagcaagttcaaaaaaatagaagtgactgttatacaagctatgcagatgtcagcataaggaaaccaaaaacatggaaaagaaaggaaatatgacacttggaaagagacacagtaattctctggcaatggatcccaatcagaaattcataaaattttggataaagaattcaaaatactgattttaaagaagcccaaatgagacacaagagaattctgaaaaatgatacagagaatataaaaaacaattcaggatatgaatttaaaaattaccaaagggatggatatttttaaaaagaagcagaaatcttggaactgaagaaatcattgaatgaaataaatacatttggaaactttgataatagtctagatcaagcagaagaaagaatctcaatagttgaagacaagtcttttgaaataatctagtcagacaaaaataaaaaggcctagaaaagaatgaacaaagactttgtggtgtttgggacaccataaaccaactgattattgaaattatcaatgtctccatggacaaagagataatgaaggggttccaaaacctattaatgaaataatggatggaaaccacaagtcaggcaaaagatttagatatccagatataggaagatcaaagatcaccaaactgacaaaactccataaaggtcttctctgtgacacattatagtcaaactgtctaaagccaaagaaaaagagagttctaaaaacagcaagagaaaagcatctagtcacctatagaggaaccaccatcagactaactggggatttctcagcacaatgcaggagagaatgagatgacatattcaatgtgctgaaagaataaactgacagagaaggataatatatccagtaaaattacccttcataagtgagggataaagtctttcccagagaagcaaatgcttagggaatttatcaccacaagatgagccctactaaaattgattaagggagccctacacctggaagcaaaaaaacatttaccaacatgaaaactcataaaactgtaatactgacaggtaaaccatacacacaaatgagaaagaggaagggctcaagtggttccactacagaaaatcaccaaatcacaatgacaaataataagataaaaagaaatgaacaaagaacatacaaccagaaaacaatgaacaatatgacaaaaaccctgacagatcattaataacctcgaatttaaatggattaaattctgcacttaaaatatatagattggctgaatggattttaaaaagctataatccaactatatgctacctattagaaatgcactttacctgtaaggacacaagtaaactgaaaataaaaggatcaaaaaagatattccactcaaacagaagctaacaaccgggaggagtagctatacttatttcagataaaacagactttacatcaaaaacaatgtaaaaaagtcagagaatatcattacataatgataaaagaatcaatgcaaaaatagaacataacaattctaaatatatatacatacaacactggaacacccagattcataaagcaaatattactagatctaaagagagaaactgacttcagttcagaaatactttaaaagcctattctcaccattagacagattctctagacagaaaattgacaatgaaatcatggatttaaattggactttagaccaagtggatctgacagacatttacagaacattttattgaacaactacagagtatacattcgtctcattaacaaatagaacattctccaggatagaccgtatgttaggcaacacaaaaattctcaaccaattaaaaaaaaaaagaaataaacttcttctatttttttgaacttgctttcataggagaaggctttttgctgaagatgtagatatgttgttggtgggtggggccttcagctttgattctggatttgtgcagtagttcagtctttgtatgatttcctggcctataagcagcattggtgatatctgcaatttcctcaggggcttagggtatggttactagtggaggctgtggtgaagttttgctgaggactaggataccaggtgggccagtcttcgggtccctgtggtggcagcagtcagcagaccacagtggaagaaaactagaaatcaataccaagaggaactttgaaaagtatacaaatacaaagaaattaaacaacgtattcctaaacaaccattgggtcaatgaagaaattaagatggaaatcaaaaaatgcctttaaaacgtgacaatgggaaaataacataccaaaacctgtgggatacagcaaaggcagtgctaagagaaaattatatagcaataaatgcctacatcaaaaaaaaagaaagatttcaaataataacctaatgatgcaccttaaggaactggaaaagcaagaacacaccaagcacaaaattagcagaaggaaattagatcatttaaataataaagatcagagaagaactaaatgaaatacagacttaaatataaagaatcaatgaatagctcgttctttaaaaaggaacaaaattgaaaaaccactcactagactaaccaagagaagagaaaatccaaagaaaaaaaatcagaaatgaaaaaggagactttacaagtgatagcacagaaatacaaaagatcatcaaagactattgtgaacagttatacactaacaaaccccaaaacatagaggaaatggataaattcctggaaacatacaacctaccaagactgaatgaggaagaaatagaaacctgaacagaccaataatgagtagtcagattgaatcagtaatataaagtctcctaacaaaagcccaggacctggtggattcacagctgaagtctgctaaatgtgtagagaactaacaccaatcttcctgaaagtatttcaaaaaaaaaaaaaaaaaaaaaaaaaaaacagaagaaaagggaactctccctaacttgttatctgaggccaacattaccctgatatcaaaaccagacaaggatacatccaaaaaagaaaactataggccaatatccctgatgaaattagatgtaaaaatcttccacagaataatactagcaagctgaatccaacagtacgtgaaaaggaaaatacaccatgaccaagtgggatttacaccaggactgcaaggatgattcaacatatgcaaatcaataaacatgttacatcacatcagcagaatgaaggacaaaaaccaaatgatcatctcaatagacacagaaaaatcatttgataaaatgtaacatccctttgtgataaaaactctcaacatctaggaatagaaggaacatacctcaaaataatcatgccatatatgacaaacccacagctgacttacatcatagtgagtggggaaaagctgaaaatttttcttccgagatctgtaacaagacaaagatgcccacttacatcaatcctatttatcatagtactgggagccctcagcaaaacaatcagacaagaaaaagaaaaaaaatatccacatcagaagagaggaagtcagattttctctgtctgctgataagatctaacatctagaaaaacctaaagacaccacaaaaaaatctcctacatttgatatattcagtaaagctgtaggagagaaaattaatatacaaaaatcagtagcatttctatacaacaatgatgaactagcagaggaaaaaaatcaagaaagcaattttatttacaatagctccaaaaaatatatactcaggaattaattttaccaatgaggaaaagatatctgtaaggaaaactgcgaaacactgatgaaagaaattgaagaggacacaaacaaattgaaagacattacatgcttatagatcagaagaattaatattattataatggccatactgtccaaagaaatatacagattcaattcaatccctatcgaaataccaatgtcatttttcacagaattcaaaaaatcaattctaaaatgtgtatggaaccaaaaaaaaaaaaaaaaaaagccagaatagccaaagcaatcttgaacaaaaagaacaaagctagaagcatcacactacctaacttcaaaatatattacaaggctatagtaaccaaaacagcatggttttgttgtaaacacagacacataggacaatggaacagaatagaaaggccagaaataaatccatgtatttacagccaactgatttttaataaaggcaccaagaatatatactgaggaaagaacacggtcctcaataaatggtgctgggaaaattggatatccatatgcaaaagaatgaaactagatacccatttcaccccacatacaaaaataaactcaagatcaattaaggacttaaacataagacctgaaactataaaactgctataaaaaacataaggaaaacacatcaaaatgtcagtctaagaaaagatttcatggctaagaccgcaacagcacagacaactataacaaaaatagacaaatgggactatgttaaactgaaaagcttctatacagcaaaagaaacaatcaacagagtgaaagacaatctgttgaatgggagaaactatttgcaaactgtctatccaagggactaacattcagaatattcaaggaactcaaacaactcaacaataatataacaaatagtcccattaaaaagttgcctcccattttgtaggttgcctgttcactctgatggtagtttcttttgctgtgcagaagctctttagtttagttagatcccatttgtcaattttggcttttgttgccattgcttttggtgttttagacatgaagtccttgcccatgcctatgtcctgaatgctaatgcctagattttcttctagggtttctatggttttaggtctaacgtttaagtctttaatccatcttgaattaatttttgtataaggtataaggaagggatccagtttcagctctctacatatggctagccagttttcccagcaccatttattaaatagggaatcctttccccattgcttgtttttctcaggtttgtcaaagatcagatagttgtagataagcggcgctatttctgagggctctgttctgttccattgatctatatctctgttttggtaccagtaccatgctgtttgggttactgtagctttgtagtatagtttgaagtcaggtagcatgatgtctccagctttgttcttttggcttaggattgtcttggcgatgtgggctcttttttggttccatatgaactttaaagtagttttttccaattctctgaagaaagtcattggtagcttgatggggatggcactgaatctataaattaccttgggcagtatggccattttcacgatattgattcttcctacccatgagcatggaatgttcttccatttgtttgtatcctcttttatttcattgagcagtggtttgtagttctccctgaaaaggtccttcacttcccttgtaagttggattcctaggtattttattctctttgaagcaactgtgaatgggagttcactttcgcaacctactcatctgacaaagggctaatatccagaatctacaatgaactcaaactaatttacaaggaaaaaacaaacaatcccatcaaaaagtgggtgaaggaaatgaacagacacttctcaaaagaagacatttatgcaaccaaaaaacacatgaaaaaatgctcaccatcactggccatcagagaaatgcaaatcaaatccacagtgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggtgattcctcagggatctagaactagaaataccatttgacccagccatcccatttactgggtatatacccaaaggactataaatcatgctgctataaggacacatgcacacgtatgtttattgcggcactattcacaatagcaaagacttggaaccaacccaaatgtccaacaatgatagactggattaagaaaatgtggcacatatacaccatggaatactatgcagccataaaaaagatgagttcatgtcctttgtagggacatggatgaaactggaaatcatcattctcagtaaactatcgcaaggacaaaaaaccaaacactgcatgttctcactcataggtgggaattgaacaatgagaacacatggacataggaaggggaacatcacactctggggactgttgtggggtggggggaggggggagggatagcattaggagatatacctaatgttaaatgacgagttaatgggtacagcacaccagcatgacacatgtatacatatgtaactaacgtgcacattgtgcacatgtaccctaaaacttaaagtataataataataataataaaagaagttggctaagcccataatagacatttctcaaaagaagacatacaaatggccaagagatgtatgaaaaaatgctcaatatcactaagcatcatgaaatgaaaatcaaaatcacaataaagtgtcatcttatcttactccagttagaatggctattattaaaaagacaaaaagcaacagatgatagtgagtatgcagagaaaagggaactcatacactgtgggtgggaatgtaaattagtaaaaccactatggagaacagtacactttcctcaaaaacctaaaagcagaaccaccatatgatacagccagcccactacggggtatttatccaaaagaaaataaatcaggatatcaaaaagatacctacatgtgcatatttagcacttaactattcacaatagcaaagatagggaatcaacctaagtgtccattgacagacaaatgaataaagtaaatgtggcatgtatacactatgaagtactatttctccatagaaaagaatgaaatcatgtaatttgaaacaacatggatggaactgtaggtcattatgttaagtgagacaagccaggcacagaaaattagataccacatattctcacttatgtgtaggagctaaaaaaaaaaaaattgatcttctggagatagagtatagaatgatagatactagaggatgtgaagtgtctatgggtgggatgggaagcagattaagaaaggttgattagtgaatacaaacatatagttacgtagaagaaatatgccccaatatttgacagcagatagggtgactatagttagcaagaatgtattatgtatttaaaagaagtttgaagagaggacttgaaatgttaccaacataaagaaatgacaaatagtgtaggtgatagataccacaaatattctaacttgatcattatacattctatgcatgtaacaaacattcactcataccctataaatatgtaaaatattttgtatcagtaaaatattgatatgccgtggtgtggatctatcacaatttactcctttcccttattaataggcattcactttttatttttttctcagcacaaacaacaccccaataatcattattgtacatatatttttcataaccagtgtttctgtagctaagcaatatattttcaggtgtgtgatattgatttttaccaaagccatttacatatagtattaacaaaaatgtatttaataatttttagtaggtaggtcttggcacgttaagtagtgatctaatgtttctattttacaaaaaatttttgtttggaagaattaacaaattttatcaagtgtttcgtaaacatctattgttttataaactgtttaatgtattattctttcaaaagagcacttgtaacgcataaacacatattaggagacataaaaatgaacactcactaacaagtcatccaatttcaaaataaaagaaattactcataattttgaagttatcctagtgctactcccttatttcatccccttttgtcacttatccttggaggcaaaatttttccagaattgcatatttattattccttcacattttaaaatatgtaattttagcacacacatgtgtgtatttcaacaaatatgttataatacattttactattttttgagctttatgaacatggtattatactatatattttgggaaatatatatgtgcgtgactcagcaacttattctactcctaaatgtatactcaaaagatattcatatatatatgaaccaagagacatgaggatgacatgtatcaacagtaatttttataactgcaataatttgaaaataacaaattgtgaaatattcatgcaatgtaatattatacagtattgtaaacaaatcaacagttcaaacaacgtagataaatcttataaacattgttttcattgaaaaaaacaagtcaaaaaagttgttcctattgacttttctcccatcatacatcaatatttattcttttttagaaaaattagtgatgtagagccatctttttcatcacttgatcatcctactaggttacagtatggtttttctcttggtattcttctgtttaaaaactctcatgaatagctttattgagatatatttcaaatatcatacatttaacccatgtaaaacatatgagtaaatcagtttttcaaagatctttgcaaccattgccaatagctaattttaaaacatttcatcacccaccaaagaaactccgtactcattaagcaatcactccgcgtaatccctttcccctaaccacaagcaacactaagctactttctgtcagcatggatttgcctattttgaatattttatattaatgaaacaatacaatctatggccttttgtgtctgacatctttcactgagcgtagtgtttttcaggttcactcatgttatagcatgtatcagtacctgattcctttttatggccgaataatattctattttacaggtacaccacatttgtttaaacagtcatcagtttatagacattagggttgtttctactttttgactattatgagtaaatccactactaatattatgtaccagtatttgtttgaatatatatttgtaattctcttgggtgtgtatacttaggagtgggattgatggatcataccgtaattctatttttaactttctaagaaactaccaaacagttttgcacagtggctgcataattttacacgcccaccagcaatggatgagtattcaagtttctctacatccttacctatacttgttattatctcactttttgattcaagttgtcctggtgggtatgctgtggtacctccttttatttttgatttgcattttcctgatgactaattaagttgaatatctttgtatatgcttattggccatttgtacatcttctttggagaaatgtctgttagattctctgcacattaaaaacgggttgtctcttttcttgatgtttctgcatactatattaatattttatttagaattataaatatattgtcatatatgagctgctctgtgactttgttgtctattatctgtaccaagtgggtccactttaaaaataatttagaacttgttattgctttctattttgaaaatgtgtaagttatattaattgcttttcaaaatttagacttggctataaggtcacgtgaccctgaagaccttgaaaatgatagattaatttttcatttttgagcttttttatgattatgtgtccttctcaaaatttgtacttcttatatgcacagttgtagtaatttatattttttgaaaaactatacatttcccttaggtttagaagccagttaccacatattatcattgcattcccatataattattttaatcttttaatgtctataattatgtttctttttctatttcttgtttaacagatttttgctcctcctttgcatttcttaattattcttataggagtttcttttttcaataggtacaatttaaacatatttttattcttctcttgtttttttttttttttttcttgagaggagtctcactctgtcacccaggctggagtgcagtggcatggtctcagctcattgcaaccttcgcctcttgggttcaagcgattctcctgcctcagcctcccgagtagctgggactacaggcgcgtgccaccacccccagctaattttttgtatttttagtagagacggggtttcaccgtgttagccaggatgatctcgttctcctgacctcgtgatccacttgcctcaccctcccaaagtgctgggttacaggcgtgagccacagcgcccagcctgttcttttctttgtatttctactttatacattttagctttcaaatttattctctccctactttcttgtttcatttcaaattgtttttaacttattaagaagtaaaccattcctgtgtctaagcgttctcattgttcaattcccacctatgagtgaggacatgcagtgtttggtttttttgtccttgcaatagtttgctgagaatgatggtttccagcttcatctatgtccctacaaaggacatgaactcatcattttttatggctgcatagtattccatggtgtatatgtgccacattttcttaatccagtctatcattgttggacattttgggttgcttccaagtctttgctattgtgaatagtgccgcaataagcatacgtgtgcatgtgtctttatagcagcatgatttataatcctttgggtatatacccagtaatgggatggctggggtggggggaggggggagggatagcattaggagatatacctaatgtaaatgacgagttaatgggtgaagcacaccaacatggcacatgtatacatatgtaacaaacctgcacgttgtgcacatgtaccctagaacttgaagtatagttacaaaaaatatttttaaaaaaagtagaccaaatattgtcatttcagtgcagatcttttcctctggtcatatcccagtttttgttataaggtcttcaactttttactattttctggatagcatattatttttgtttgactctcttatgatccagaacttgattaagaaagtctttcttaatttcaggtgaataattgttattaaataattatgaagtcagttatttatcatttaattgcgttagttaatgtaaattatgaaatatctgttttaaaatattttaatattttgtttgtgagcaaaggcaggatcactttcatacccctcaaagaaaaaaaatatgcttggtttataggttataaatataaatcaaatatcatatattatacataaactccagtttttgtgtttttttcttcctatacatttagatctatccagttctgtagggggtataacattttcaacaataatttatgtcagattctacttgaattcatgagtattcactctttgtaattagctgctttgctgtatattgtatacaagtttatacctgtgatatatttgtttcaggccttgacatattatttccattttattataccctgtgtcttttttcctaaatttcaactggtctgatatcaatattactactccttctttgtctgttactttgcattccctgatacattttggctctttattttcaatttgtcttatttcacagttcaatgaaataatacagccaggcagaaaagtacacaggaaaatattacagatgcctttacactagaattattttagtaaatattcaatatttctctacatttgcaccaaaattatttttactaataattggaatattgtagatttgaataaaatctaaattctttttatattctttcttgactctattccttctacattttcctccctggtgataattacataaataattataaaaattgacatgcctccatttcacccatgttttaattattttgctacacatccataaacatattatatatatatatacatatatatatatatacagacacacatataatttttgtttgtatttaaattttataaataagtaatcatgtacttttctaccattggtttttcactcagttgtgtttcttaaagagacacatattgatacatacatagttctgataatttttttaagtactatatagtattctatttgaagaagacaagattgatttagttttcattcttctagtgatcaacgtttaaattgtttccatttttaatacaaataatgtctcaattaatattcttacagaagtttctttgtacatatttgcaggaatttctttagggtatatatcaagaggtgaaattatttcatcacaggataggactatattcaattttattagatatcaaaaaattattctgtgaagagatttacccatttataccattgtaggagagttgcttttctacatattttcactgctgcttggtgcaggctgacgttttacacttttcaacctgacctatgtgaactggcctcttttgtgtttatttgcctttccctaattagtagagaggttaaacatcttttaatttatttattgatcattctgtttatttccagtgcatattttctgcccatatttatactgtatcattcattaacatttttcctgtagaattacagagtttataattagacactgaatattcatttttttatcattcatgcaaatatctttgttacatgtttgttacactattaatgctttttttcctcttttggttaatttttgtgtctgccttatatttcagacatcctttattacatggatcattaagatattatttcacttttttcctgagttttatacaattttttgtatgttattaaactctgtaatacattgtaaaatttacttctatatattgtgtgaaataagaatctatttttgttattattctgtcagaggagctatttgttcaatctatttgactagtccatctttactccactgataatgcttctattattttcacactcatatatatgcctatttttcagattttccacattgctttgttggtttatttgctattcatgcatcaataacacattattttatttactatatttttgaaaaactttgtcatttggtgtttggtaaaattgtccatattatttttcctccaaagtttcttcttggccttttcacagaattaaaattcatcaactggaatgtccagctgcctctgcttctataaccagagatactatgagttgtggcaagttgtaagttttctttccaggaggaaggctctctgtattggtcaactctactataaagataagaattcttctgcccttagggagagaggatttaatccaattcagttttgtcatgactctctgggaaaggaatagcaagtgtgcacaaggtcattttcacaggtttagtaaaggctttcttcttttgagtgccaaggttgccagtaatcactgtgttgcatccttagcccagggctgtctaacaccagtcttattacatttcaaactctggataagagtatatgtcaacaacttaaatttcagctttagatactggcatagcttgctgacatcttctaggacctgtgaagttgccatagccagactttctcaagagaaggaatagatagttggattggagtggaaagaggcagtaaaaaggatacgtttaagctttatctttctggagtcttttattccaaattttctataatgagaatttattattttgatcatctgaaaaatattaagtgaatcaattttttaaaaaactaccatgtcagcatgacagaaaaatcttgtcttccttttgtagcctctagttcaccagataagttcactagcttgattatctgtaactacttagtaaaaacataacactttcaacacttcatagaattaggaatttcatctgtcatgagagttcttatttatgccacaatggattttactgtttggccccaaaaatattttctgtaataaattttataaataatcttagattatttctaaattctctgtaagtactaaatcagtttatgagatctaatgattatgtacctccaggttgttagctctccgtgcaagatgtgagcttgtatttagaaacatccaatttattatttgtcctttatgactttaatattttatttcaccacaatatttataatcagtttgacctacagttcccaacaattcaatttgcttgtctctgagatctgtatacattttattttcagcacccagagctttatacgtgacatggctttttatccaggttgtctctgttataatttatccttattattagcagtgacataatactgtgctttttagtgttgatggaaagtgtagttgagagattgtatttacaaacccttcgtaaagtttgttttacaatctgttttcagatatgttacctcatttgaactttattcctactctgcaaataagtcattgttttctccattgtaagaggaaggaaactgatgtccaacatcatacttgccgttgttaagtgtaagactcaaactcatattttccaacttttatttcagaattgttttttcccctatgctgtgttctgatatccagagtatttaggtattttactgattgtagggggctaccattgccagtgactatcctgatggtggtagagagtgtgttttgtagtacttactgtctgtgaatattatcacataataatatcttaatgtaaattgtccctgaaagtatgactttgccaacatgcataatctacaggtctttaaatgtgtctgtatgtgtgtatgcgcccctaaccatgttaattcagtgaattttattactgctaaagatatctcagaaacttttccatgggatgcaaatcttttgtcttttctgaacaagtaacagatatttgttctcttaccctatcctttttgttcttattcaatctgaaaagcaattgaagatgtgtgagttcatactggtaaattgctggggtaggcgtttcacatgtgacccagtgtttgtcatctgaagcttagctcacactccttggatactgtgtttaagatttcacattagcatgttttttcttggtattgatggggagaacattgtgacaactgttattccatctcatctgcatgtcctatgcagtgagtcaaagtagcaggagacctcattatttgagtcatcaacaatgaactggacaaagaaatgtacaatcaactgtgggcaataatatgtgcattattgggatttaaactggtttatcccatctgttctaattactacaaatatgtcatgaatgacaaaaacgctttgcagcttattactttgcagctgataatgcaatggagtaggttttcttctatatgggcttcattcactattcacaggagtgatctgtttgtgatggggtaagtggaggaactagaacaagcattatttctaaaaaagtatctgggagccaatgtatttgtttatgttgtatagttccttttgctggccttgccccttctctggcattttgcacttttctcccaagttcttaaagtttaatctgttctattaccacccctggccaaagctcatctatacttctgtctctgtctttggcaagtagttaccatagctttgaaatcctctgtccttgctcatatgtattgtcaggaacagaatttgctgaaggcttagaaggcaaatcctagtgacctctgaagatttatggttgactcatttcctacaggtgccactctcttgatagtattataaataatggaggtaaaagattgtatgattaaaatccacacagaatggacaaatgaatgagtgagcagtatagggtagtagactcctaacctggataagtaaataaatagtcttgattgagagacttctgttgagtgcctgacactggtttatgtgggaaaactaaggatttgttgccacatgacaaggtagcaacagagttcaagtaagattttctggctccaaaacccgtgatcttttcattgcaaaatgctgcagaaagtaaaaatttgttttacaattttggtgtttgcatttattacactcctgattgttaggaactttctctgcatgactcagacaactcattaccatcagcatttacccatggccctaaggaagctaagcgctctaggtatttctgattttatcagaatctttttcaactttattcaactttatattgaaagaagttgtgccaaaaatatatctattggacttttagtatgttgttcttcacagttgtcattgtggttgtcctactacctgcctttcagacagtttttagctttaggattcatgtggcaagtagatgtatcacagtggcccattctggttatacacacatcattgtgactactcaaaaaggtaaaacaaatgaagcaattgtgaatggttttcatcctcaggcagatccatggaaagctaattactgtacataaagtttatagaataataatttcctatcttttttattttttaaaaaatttttatttatgtatttacttttttgagatggaattttgttcttgttgcccaggctggagtgcaatggcatgatctaggctcaccacaacttccgcctcccgggttcaagtgattctcctgcctcaacctcccgagtagctgggatacaggcatgtgccaccatgcctggctaattttgtatttttagtagagacggggtttctccatgttggtcaggctggtctcgaactcctgacctcaggtaatctgcctgccttggcctcccaaagtgccgggactacaagcgtgagccactgcacccagcctaataatttcctttgtatactttgttcgcaaagacagaacatacacagtaaatcttgataagtaaatcggatattgaaagaggcaggcataagtatgaaaagaagttcagtgttatgctatctgttaaaagagtaaattgaatctatacatatcaaccagtccagttgtaagctataaatcatgtgactagaccaatgttaagacgcgctaggacaaaaatcaaataagccaaatgtgtttctcattaaataaaagaaccaagaattctgggtttgagtcttgttctgtctcacttttgctatttttcttgggcaagttctcctatctatgtgagcctcaatttcctcatctttgaaatggtaatactaatccttcttggggttgctattaaagtacaatgatatagcatataccaagtacagagaataatatttgtcctgtgtctttcagagcagctctaggtaataggtaattatttacattgcttcccagtttgagtagctgggtcgctgggtataaatccagtcatttagaggctattctcagtcagcaagaccctgcaaataatggctgcatcagactgtgctgcagtgtacctgagtctccatatactattctttgcttgcctagcctagtccctaattatgagctgtttcatagctgcaacacttggctttttttttttaaatacagtaattgatcctcaaaccctcttcacacacaatgtttcattagttccaaccttgatctaataattactatgatatcactgggagaaacctattgcatcccttgtccagtgctagatccaggaactattgagctgattctcaacagagatttttctcttccccaaaccacacaaattagtgaataacttttgattttctttctctctttctagtggtgagaatgctggctccatgaaagaggtctgcgagagcagggaccttgtttgctctccagggcttactgcaacagactggcacataagtgtctaataaatattccgacagaataattggaagctagggtgctttttctgagtgcatttaacttttattgtgacaatacgatcatgataataccttatatttgtcaagggctttgtagtttacaaatccattcacgttcattatctcatttgatcctcacattagcaccatgcagagattataattttatgttcttggatgtacatgtggaagctcagaaaggttagtaaacagtggaggaggagttggaacttaagtcttttgattacaagatctatttactcccctctactcacacagcttttcctatgatctgactcctttttttgtacataattgaataaattcacagggtgcctttgtaattttgtcttaattaacttgatgcttaccacaatttacctataataggctttgggaaacttggtttttaaaatttcttaaggtcttcattcctatcttgctcctgattacatacatttggtaattttcctgcttttcctgtggcttccagggagaatgtatactactctatatttgatttcagtgtatttattttaaactcatccattcactagctcgaagcagagaattcgaaggcatgctcagattttcagtcttgtctcttccccaggctgtcactagatccttgctgccactctaacccctcttctcctgcactctatggatatcacccttggtatctcttcctgtgattatgtcaatatggtggattcagagttaagggtattctagctaaaagtcatgtttaaagctcattgcaacacatcctacacaataaataccccaaacattttcccccttttttattgtttagtttgaatgaagtgaaatatttgttttaaatcatcccctagaaaagttatgtttacttcttcattgctgtgggtatcatgtgaagcccggaatggcatatatcttacaaaagccatgctgctaccacaataaattatgaatccaatttggcatttattttctgttaattcctgattaggtctcagaatgttcccaagatagtgcctcagaaaaccattacttatctatgcagtaatcctacctataagagttaacctaaatataatacaagctactaatctataaatttatcaaaactacatggaatagaggaacacatggactcttgtctccagagtgatcttttcaaaacagaaatgtaattatgccttactgcttctgaaaaaaaacagtgatttcccattatctactggatggtgactaaactttaggaggacttaaatcttaagtcctttcattgagtggtcccactgtactttataaactcatctcttcctcaccctactcctccataagccctgtgctacagctacaccaaatacttcaatgtttcctgaacactgtattttatcctgcatcaaggttttttgcatgtgatatttcctatacctagagtcatcttttagctttgtctgataaaattcgacttgcttttcaaggttcaattgagatatctttcctatggaatttccttaattctcatctttatctaatagtagctccctgctcttctaaagcaactttaatcatcccctctgctataacacttggaatattgttgtaattatttgtctacattttctccagtagactacagagtctcagttgtaggcccatgctttttcttcatatatcttctgtgcccagtttttatttataggagcctctcactaaatgattgatgaatgaatggaagttggaattctgagttttctcctgggtgcatacaccaaaacccaaaatatctgtttagttcagagccaccagcatgtcagagtctcataatatgataccctaatgtggtaaaacaggctgaaaactgatttaaaaaatcattctagtgtgtttgttaaaaacgcattttcacaatttaagtatcctatcttaaaataatgatattgttaaaaggccagcatccaatgtgggttgtattactatcctttaaagaattgtcaatttgactaccattttctgaatttatgagtttattctgacattgtcaagaaacttaagacaaccgatcttggtgatacagacccgcagagtcacagttcagctgctgttcagcacaataatatctcagacctacccaacaatttacaggcttaccactgccccaagtcatggtgctcattcatggttgtaatgatgtgtttatgactttatggcctaattggtcccaaaggcacttaagaaaataatacagtataatgactctgtgctctttagttggagctgtcttttaagaatattgaagtagaatctggaataaaatggccttcattcagttttgacatattctcactgtgtgacttggggcttcagtttcctcatctgaaaatgggacatggggccaacaatttatgtggtttatggtgggaataaataagataacatgtgcaaagcacatataatagttattattactattattatctcaaaatacctaccagcctaaatccactatgttcttaacccctagagagctattaggcccactctaatgtgtctgagcatatgaccctctcctttattgcctagcatggagaagatagtattggttgaataaatatcatggttttagggccatagccagagagacaatagaccttctgggcctttcctcctagaagggacctaggagtcctttcatttctggtctgtcattgtatcttgcctaaggaaaaagtagaaaaataaaggacaggacttattacatcatatattggatgcatattatttcaaggaactctgtgggctcatacttgtatatttaatcatcacactatccatgtaatgtgttctccaaattttagacacaaacaatgaggctcagagtaaaacaagtattagaaacttgctcaagatcacactttggaagaaggaatgtcagaattcaaactcaagactgctgaactccttcaatcaaatcacaatgcctgagacatcctgaacatactttgtgtttcacagttttttcttcttcattgaatatcttcctttcatataaaaatcatattaagaaaataatctttgcatttaccttgcttttgtgacctggaagaacctaaatacgaaaataagtgactttaaggttttagcctcttgtgacatttggcagcaacaaaagcttattcttttaccaactcaggtctcaacaggatcctacagatgtagccccatggaaaacaatctttcatttaaagactttaaataatttgagtggaagaaatataataaatgacaataacatgtccaagcctttagaaaatggaaatgttggattcaaatagatacttcagtaatcaaaatctgttgaatagagcttacattgcttttttgaggtaccttaaatattttgtgagcatagaagaaagactttatttaatgagcaaagcatagaatgtatgcagttaggaaaagaaccactgaataaaacaaactgaataaaaaagaaaaaaataaaggcgataatgaaagtaaagaaaatgagaaataaaaaataaaaatataccagagagttattaaaagcaaaagttttttcttttcttttcttttttttttttgagacggagtctcactctgtcaccaggctggagtgcggcggcgtgatctcagctcagtgcaacctctacctgccgggttccagcgattctcctgcctcagcctcccaagtagctgagactacaggtgtgcaccactacgcctggctaatttttgtatctttagtagagatgagggtttcaccatattgcccaggctggtcttgaactcctgacctcgtgatccacctgcctgcctcagcctcccaaagtgctgggattacaggtgtgagctaccacaactggcctgcagaagttatttctttgaaaatatttataatataaacaaaatcctggtagcactaataggagaaagagacaaggcacaaattatcattattagtagtaacaagggggactaaagtacagatacaacaaatgtttctgaaaataaaataaataatgtatgttaaattttgaaaatttaaggaaatagacaaataactagaaaaatataatttatcaaaaatgagtcaaaaagaaataaaatattgtgtagatacacaacaattaaatttttcaggtagttaaaaatcagtactcacctacacatagctattcaaaactgatgcgcagataagtatgagcaaggtcagtgaaacaatgaggaaatgtatattgatatttacaaaacattgcagaaaataaaaaggggacatatttctcaatttcacttaatgtagttaatataaacagctacgaaactagtcaaagtcaatcggaaaattacagttcaatatatgttatttaaaaacttatctgaacaaatattagcaaaacaacctaaaatgattatttaaaaaaatattgtgaacatgttgcttttatctaaggaattcctagaatgtcttaagagtagctaatgtaccagtgtaattccttatgtttaatgatataagaacaaaatatgaagaatcatctcaaatagaaaaatatttccaaaaaaatcaactatgttaaagaaaaaaaaatgttagatataggacttctaccaaacacctatatcaagcatcatatttagttaaataaaggcttaatctataactgttttgaaaaacatatacaacaaaaaatgatgaaaattattcaacattagcagaaattaccttatgtccctcaaagaaaactgctgccttccaacaaaagtgaaaacagaagctacatgattggagagtatataaaatatacaaatacattttaaaaatctacataaatagtaaaacaaattaagtgggtaaaattacaaacataattacagaaacaagaaaatcaataaatatatagaaagatgttttactagtaatcaggaatatctgaataaaactacatagggttactatctcacacccactgtagtggcaaaaactaaaatttctgacaatagcgactattgacaaagcatggagcaacagaaaaaaatgtatactttttcgttggggcataaattataggcattttgaagaattattttctagtttggtagagttgactgtgcacataatctctgacccaacagttctacttctaggaatatacttgggaaactcttgtgcatgtataaaagaacatatgagcaggattgttcatagctttgttgattgtgattgcaaatatcagaaagctaaatttccatcaaaggtaggataaaataataaacagcactggaaatgaacaaattaggcttactttttttcaagatgggtaaatatcaaaataacaaatgaaataagaaagttacaaagttttgtgtgcagcttgatgctatttatatcattttaaaaggtaaaattacactatatgttatttagggattcatacataaagaaatacacaggaatgataaaactacagtcaaaatactggctaattctaggaagatgtcatcagatagacatgaaaagacgtctttgattacttagtaattatttatctatttaactagatgacagatattgttgcctatattatagtatcctttacacttttttggattgctttaacatttcataaaaatgacaaatatatgtgtaggtgagcaataaagaattactagtattatcattgccctgatgatgattaaaattaatcccaaactgcagaggattccaactattaccatttatatttttaatccttgagttttatctgttaggagaggcagtaggtgcatgtacatggtgataacccacgaactgaaaagctcactgaaatacctgggggctaaggcctaattaacatcttcggcacttgagttgaatggcaagacctcttcaggactgtagggtaggcggggaggactttacatgattctgtaatgttggtgaatgcacgattggccagccacatcttgtttccaagtatagatcataatccataatggatggcttttagaaatcatgtttatgaatgtgcatagaggcagagaatagtggctgtattcaacaaacatcatgaataatcatgctggaggggagcacagaatccaaatgcaatttagaagtgctctgtggaatttgtagagcattttcttaaagcagaactgggcaaatttttatttctgttcactgcttgaattctgtggaagcatgaaggaaagttcagtctagtcctttttcctggtatcagtctttcctctctcatgcattctccggttgggctgaaaaataaacatttgttgagagctgaacctagatacaatgtgggggaacaaatggtaatgtctttgctcctacccaaatcttccaaaatgttatgatccagcctggcagtatatgtttgcactgtgatatgaattcctgtagcatgaaaaggtatacctgtgactgaggtcccttttttcccagattgaggttttgaactctattaagagttccttatccaccactgacatctactctatatttactgtcctttggaccactctgtgcatgatcttcttctataatatgtgacccatcctcttccttagtggtcactcatagttatctcttttagctaagaccaccttggctattctttatctctcctttttaaaagaataacttttatatgtatgttatttcaatgattaaaattgaagttgtagttttatttaagataatggagacagattatcaatgttaaaatctcagctccttcaatttccagctgtatgattttggtcaggttcaaacttctctgagactgtctcctcatctgtaaaataaggctaataatagtagctattccatcaggttgttgagaggattaagtaagctaattcttgtaaagcacttagaagagtgcttggcagagtgtgtgctaggtgttgtgttattgttgttaatcactattattactgagatgttatctccaatatattctagcaaatatataatgtaataatacatttgtaataatctctctttacttcctgtaataatctcatgtttacttcctctaacccatcctagtttcctacaactttcttatttgtacttttcctcgagaaagagttactatttggcttattttatttgcctcagcaaggggtaagtaatgctccagagaagcgccctccactaagcctgccattctcaccaacggcaatctggagtgttatggagacatgatgttggatgagaaagataaggtccctggcctcctgggtttacagtgcagtgaaggaagagagacaataaagatatatgctggatcatctcaaatactggttaatgctaggaagaaaaggaagcaaggtaatggattagggaggctgaaaagataaagctacttcaaaaatggtggtcaaagaaaattttttcagactgtggcatttgaactgcgagctaaataaaagaaggattatatattaagaacacaacacaggtagatgcaaaggctcatgcaaaggctccaacacagatgatggatttgagaaggccagaatgtctggagtgtaatgagctcagggaagaatggtatgggatgagaaaaagcatgaggacagtctagatcttatagggagtcataatattgttcaaagctcctactaaaatctaaacacaatagaacccacatatggacaatacgggactaaaatactgtattgtgtaagatgcaagctgacatcataacaaagaggacataattggaatgagcctgcctacttgagtcagatccagggcccagatccaccccattcttgctgcctatttggtgccacctggtggcgatggtcctcaagcctcaatggcatgttgagaacacctcttgttcctgtcttagctggaacatggcagctgttccagaaatacccttgtgagttggtacctctttagctgaaatgatcccagaagagtgagctaagagaatattgagcacatggggcccattgtctttcctgaagcaggccagcctcctgtttaatgctggccttgccttttcttctctttctatctcccccaaagataaacaccttatcccacctctgttagataattaggacaagacagagtatgagactaactgacactcagaagtcacattataatgaaatcatgttatcagggagtatgtcatccaaggattttattgcatattttattattagggagaatgacaatatagctttgattttatacttacagtgcttgatatatagtgatattataatattttcttatattgtaattatatatgtgcttgtctccctcaaggaaaatgtactactgagagccaggagagggtctaattcaactttgtgcccctagtaagaaagggggaaatgaaaaccaacgtgtatattcacctactacaaatagtagtagaataagtcttatttaatagtcacaaatagtctacaaggcaagatcgattatctttatttcaaagacaagggagacaaggatgaagaatgaaaagccacataggcagtaaagaacagatctataaaatgccatcccaaattgtgtgaaaataaaagctacatgactagaaaaaaaaaaagaaatatgcaacagatataaaccaacgaagcctgttgacattccacctaaccgaacctattaccgccaatgcttgaacatgtttcctggcaggtagctaatgctcagcagatatttgatgggttaaaaatgaaaaatacatttgaccattttggatttaaagagtggggttaatggcacctatttccctaatcaaagccagtagtcaaggtgattggacatcaagtttattcttaagcagcaaggccacagtcagctatggtttgggaccccaggcagccctactgaagttgcacagaagaggtacttgtcaatgccaatcagtctattcctgctgttcaattaggttctgatttgtaattcactaccctccagcaccattttactcagtgaattgtagtcaacaccacaggaaaaattaatgcctgtgaaataatacctgagtaaggggaagaaaagccaaatgcaaactgttcttctcttataagtgtgtttatttttttccaaaaataatatggatttgctcttttgcaaagaagtcattcctcagtgaatgtgtgtatgtgtacatctgtgtgtgtgagagagacacattggtggcttgatatcagaaaaaaatacttttgccagactataataactattatttgtgattctattaacggaaatatatctttttcaaattaaagtatatatatttacatacagatggaaaaggaggaactgcaaaataggcctagttttctcaaagacatgcttgaaactctgagtcagtcagagattgttgttttgttaactaagctaaaatagaatgaaattaataatatttaggataataaaagttgtcaagtattgagcatggactctgaaatctgaaaccaataatcaacttccaggcattatctaatttaagtatcatggagatatagcgattatttctcttattttagtgatgaagaaactgagactgaaatataaaatacatggttccatagccaattaaggaacagagccagaacttgagtttggttcaatttgactcaaaatacgtgtcttagagcctgagcccccctggtgagtatgttagagtgatgatgagacacccacccctgcctgggattccaggcattgtgcctaggactgagcataccaatgctggtattgaaatattagcatttccagctatattggtatttatcttatcaaaagcaaaaacataaaacttgattaatctttaattcaaaacaactcgattgcaaatgattgacctggcagtgtcatttagttagcacagaaaatgttacacaattcaaagcaagattttcagaatctaacatattccatcattttgcaaatatcaaaataatacattaaagaaaatagttttgtaaaattaacaaataacaatttaacattgtcaatttaaattgatttaaaatatttgccttataatttttaattccaaattttgtgtatatttggcatataaaaatgaagatgttggagttccatgctaaacataattataatgttagaggtgtgccagccaaagaatttagaaattttgttgcccttgtcaatatgagggcagatgtcacagattcagaattctaaatctgtcaagtatgagtaaagtgagccagatatggactgctctgcagcggagagtccatgcgccacctaaaggcagcacctgctcctcatgttctgccagttgtacccatgtggcaacatgaattgaaggttgccagattaatctcttttttgttttttttagagatgccaggcatccagattcttaatgttggcatctgattcaatatttaaatatagctcccctgtgccaaacgaaatcacacaatgtgtgtgggctgtttctggccagggggcagactgtttgggtcatctatgctaaggctgtgggaatacatctgtcacaggggtttggacagttttctttgtgacaagaaagccctgccttatggattgagaaactattcttttacagtgtacagtcctgtcctgtattattgaggactggcttccaatgtatttgttcctttgccaatgtcattattgagaagccaggagttgggtggggtaggtgatactaatggtcacagcgatggcaatgggtgatagaatccttcttagaggggtttcttatagcttgcaggtagggcgggtaggtggtaaaattgagggtaaagcaatgaacaaatggcgaaagtatctgaaaatgactttcctatttcttggcacttttgtgttgacacaaagtacttaataattcccttttactatttgcttttaattatatgtaaacatgtgcatgatttttacagtacagaccttcatgtggtcctcaatagaaacaatctgtagacttctctgactgttgtgcttctacttctttctgaaaatctcagtctttggcataagtcatgggaaaatgataggaggggacagatgggagtagcttattgaaaattactgaaagaaaaaagacataggaaaagtaaaagttcagcagatgaagaggaagcagatatcatcaactagaatcaaatcccactgcaacatgtttaactaattctctgtggggggccttcctcttgctacctgccactaactttcttctccatcccccagtacctgaatacctagcatattatgttataaagaacatagagctcagaggcagaagaccccatctggacttctccactttgagccattttctctttgggcctcagtttcataatgtttgaagggagaatttgaaccttaaagtgcctaattcactgtggaatgtgaggatcaataaagatattgtatgatagcacatccattacggttccatgctgcacctgccctaagggatagttgttattgctaagcctccaaggcacagcatttcacatcaaaaagactctcttaaggactccatgatctgactttgattttgaagccagaacattgtctagagattgcaaggaggaagttggcagctgaactttgctcactacaagttgaggaggtagagcaaatgaagctctaatgagctgaacgagtagcttcatgcagagctggccctgggtgtcttctcagcaatgctgttgcttctcagtattattcacactgcatttctcctggagacatacttgtttctacatcttcctcccacagcagactgtgagatccccgagggcagaagccatgtgtggttacttatggtctcacagaagaaggtggaagaaaggggcaactttgcttatagaagaacagagtgtttggcattagacagacctgaacttgaatcccaggtccatcatgcaccattctgtggccttgggagggtgacatatactcctagtgttctaatctataaaatggagaaagtaagttgtacttatcagggttgctatggtgactaaaacatagtatctgagtacttaataggcattgaaaaaactattcatcctcttccttatttataattttagcatctagcagaatatttgagtgggcatatgttaggtgatagatgcctgtacacgtgtgtgtatcttgtgtgtgtgtgtatgtgtagttacccattgcttaacaacagggatacattttaagaaatgcatcattaggccatttcgtccttgtgcaaacatcagagagtacacttacacaaatctagatggtctaccctactacacacgtaggctatgtggtacagcctattgctcctaagctacacacctatacagcatgttactgtactgaatactataggcaattgtaacatgattgtgagtatctgtatatctaaacatatctaaagatagaaaaggtacagtaaaaatatattatactcttataggatcactgttgtatacatggtctgtcaatcacacacacacacacatacacacacacacacacacacagacacacacactcttcttttaaatatatctagcgatttggcattggtatttttttttttttgagacggagtctcgctctgttgcccaggctgaagtgcagtggcatgatctcggcccagtgcaacctccgtctcccagggtcaagcaattcttctacctcagcctcccagggcgcccaccaccacaccaggctaatttttgtatttttagtagagacggggtttcaccatgttggccaggctggtttcaaactcctgacctcaagtgatccacctgcctcagcccccaaagtgctgggattagaggcatgagctaccgcgcccagccaccattgtattctttaaacagctgttgaattgattcatggtatatgctgttaagtatttgtcctattacctaggaaaccttaggcaaatcacctctctcatggggacctcaacttttctacatgtagaagagtggttttgggctcagaatttgcaactgaaagctcaagttcaatgaaaactatgttttatgtgtcctgccctgcacagcgttggtctaaatgacattttcaaacaaataaataaaaccaaccttgtaaccaattagacagacggtgaataaaccttcgactgggtatagtaatgatcttttctgggattccagcaaggcatggtaacatttttggagctacataatagctgttccccttgggcagaacatgtacgctctctagtttaccaacacctgggctacatcactcatttagattgcttgcctggattctgtaatcttcggaatgtatgaccttgaatatggtagcgtatagacatgtcaatcctctgtgcctctatgattcaatgatttctaagcatgtgggatttagacgttcttagtcataaccagtatcactatggctaacccacaccatagaaaagagttgtttttccatgggcactaaaaagggatatacagcaaatggtcatgggcaatgacattatcctttaagtcatttctgattgatctccatcacataatctaccctctcaacagtctttcttctctacatactaaagtggtttttcaagatatatggttaggtttattcagtgagaaatgattcagtccctttgtttccacttgttacttggtcctggctccaaccttttcaagtcgcagatgcttcttcatgagaccagctctgactctggatccatggtgagcagcatgagttctgtaaagatatttttaagccaagtgcatccaggatgctatggagccacaagcagacaaaacggcataaatgctctttgggaatcataaaccctagtgcttctatctgttaagagttcttgaattttctcatcttaatttcttccccaactcactgaagaaaaaaaaaaaaaggtgctgattttccccctttcagaagcacaatgataaaactttgtgaatttgacaaaagctttttttttccaaaataactttttcattatgatggttacttgtctgccctttacacaacatgaaagaatttttctctgggtgtaatcagatgatgacagaaatatggtgaagctctctaaaggattgacttacttaaattcttcagttctcattcagggctgaagcctccttgtttcatttggaggtgaattatcttattgatcatgtctgcataaatacctctaatatgaataatgcagactattggaatactcaaagtaaaaaatgtggacctgtctttaaagggataggtttaacatcatgaagaataaattaaaaatcaaattgtattcctccttttaagccggaaaataaagcatcattcagaatagaattcttaagttcataaagcaactaaggattagatataatggcataagggaagaagtgaaacgtagtccctttgctccctggccaccaccaggcttgtagtttggtgggagtgacagtgtgatctactgagaggtagagtagcctcataaagttttgtattcagagaaaagcaagcctaaaacttagaataccatgtaactagatatgttgccttatggaaattatttaatatctttcagacttgtttcctttagctgtaaaatagagataaaaatattccattggttgaatttattttggctggaagtaatagaaatctcaagtaattgtgacttaataataaagtctttaattctctctcatgacatgaattctggcaatatgtagctccagggttggttcagcagctcaatgacatcaaaggcctagtttggtatttctgtgatttaattggaatttttcccataaactaaagaaggctgtatctctctagtcctcacgttctccagccagctgactacacagaatgaacatagtaggaattctgtcatttaaccatgaaagtcaaccccactgccactccatctccagcagacttctccttacttctcattagcaagaacttggtcacatgcccttatctagacagatcactgggaaaaaggatgaaaattccattattattatagatatgtggttctcaaagtagagttctcagatgattctggcaagcttgtttaaatacagactactgggttctacccccagaatttctaatttagtatgttgtgtgggaccagataattttcatttataatatgtttcctgctgatgttaatggtgctagtctgaggaccactgtttgagaaccactgattgagaccaacagtgatttaccccttgggctaggagataggcttccttttgtttgtttgtttgtttgttttgttttgttttttgtttttttttttagattaagagggcaatactctttatgcaagcaagtcaaggttcttctaattgaaagtgaatgtgtgggaggtggaaggtgtatcactcagggtagagcagaaagacaaaatctgtatggtgcctgcccccaggatgaaggatggggaatgtacagccgctaccactctactggctaaaattgactgaaacgtacctggaagccttcccctggaagttgcaagccttcaaatagactccagagtcctaaaattgttatatcaggcagattctgccagtgtaattatagtccaggttgggagagagattcctggtgctgactcctctgctattttcccagaatcctcagaggtatctttcatacatagttcataagatgacattgacacctttttaatttaccttcttgacaacaataaatacccatatcaatcgctttgggaaaaacaacaacaacaacaactttgatctggcactaataggagaagagagatatggaaggtgccctttagacagaggagcattccaaaggaaaacacacacgctgtcaaagtagcatgatttcttccgccaatacatccatctcacaatatgccgtaggactgacataaaaagaggcctaagggacatctgtggattttgtctcaccagaattcagttcctatcctagtaagggcattccaatagtttctgaggaacaaccccttctaaattctcagtttaagatatctcaagtagtgctgattttacctcttgctctaggggtgggctggtaaccagacatgaacccagtaactacttcaggactcatcatgtaaccaaatcaagatgaatgcggctcaaatcctagatttgtgccagtactattgataagaatctctccctttgacagatttaaaatgatgtttgcctagaacatctggaggccattacatgaagaggttctggcctataggggtggtaatatgatgatgataagagtggagatacagagggagcctaaatcctgataatattgcttagttgcatggatcccatagagtctagagccccaacacttgtacattttgtgagccaatatgtttcttttgggagaggagaggtaagcagggttaaggtgtcacttacaacagagggcccagtgtctaaaggtgcatcagcacccgcttaagattcaagtgctcagccccggcccctccccatgcacctgctccttacctcatgctgacctaatttctattctcccagatctgtattccctgaccactcctccaacatttgtccttgactccttcctttggttttgatgtgcagaaacattttttggtctctcatttgtttctaatttaaaaataaatgcatctggctatcctgcctcagggcaaatttagaaatatttctttcagttcaatagagtcctatggttacccttatgttggtactaatcctatctcacataccctattctgggggtaggaccagatgtagggtaaaaatctatgtacctgacttttactggtttcttacagatctaaagttatggctttatacttttctctcttttgaatgtaagtattacagctacacatttgtttctaggcactgctttaactggttcccacagattgtagcctgttgtttaataatatcattcagtcctaaatattttatattttccttgtagtttcttctttaattcattggcttttggaactggtgtaatttccaaatatttgtaccttttctaaatatcgtattttgatttgatatctgtttaattctgttgggaccagaaaacacactctgtaagatttcaagcttttgaattttggggggattgttttatgaacaaggattttttccatcttggtcaacattccacacgcacttgtaaaaactgtttatgctacagtgattgggtataatgttcaagaaatgccaatattgttcatgtcttctatattggtgattttttttggtgtatcaattgctgaaatagaggttaaaatctctagatttgtatttttttccttttggttcttttattatcatttcatgtgttttgaagttttgccattaaaaattatatatcaattgctggatcaaattgtagttttatttttagttctagtgtttttcatagaggctgttctaatttacattcccatcaacagtgtataagtgttccttttctctgaatccttgccaacatttgttaatttttgtcttattaataatagccattctgattggtgtaaaatgatatcttgtggtttaatttgaatttctctgatgattaatagccatgagcatcttttcatatacttttggtcattcatatgtctacttttgaaaaatgtatattcatatcttttgcctacttattagtgagattgtttgattagttgttgggttgtttgtgttccttataaattccggatattcgtttcctgtcagatccatggcttgcaaatattttcttccattctgcagactgtctcttcactctgttgtgcccaaaggaaaaaagccattatatcaaaaagatacctgcctgtagtcccagctgctggggaggctgaggcaggagaatggcatgaacccgggaggcggagcttgcagtgagccaagatggtgccactgcactccagcctgggtgacagagagagactccgtctcaaaaaaaaaaaaaacaaacaaacctgcaatcatcttttaatttaagtactattcgcaataatgacaatagggaatcaacctaactgtgcatcaacaggtgattagataaagaaaatgtgttagatatacacaatggaatgctatttagccgtaaaaaatgaagtcatatcttttgcagcaacatagatgaaactggaggccattgtcctaagttaaacaagtcagacatagaaagacaaatgccacatgttctcacttgtaagtgggagctaaataatgtgtacacatgaacgtacaatgtgaaatgatagtaaatggagactctgaaggtgtgcggggtgggaggggaggtggatgatgagaaattacttaactgggtacatgtacatcccgtgatggacacacgagaagccctgacttctccactatgtaatattgccaggtaacaaagttatacttgtaccccataaatttatacaaagaaaattttcaaatctatatatttgagtgttatatcttcttggccaattcattctttttatgaaataccttttttatctttgcacattttctttatcttgaatcctatttttttcttttcttttttttttttttttttttttttgagacggagtctcgctctgtcacccaggctggagtgcagtggctcgatcttggctcacttcatgcaagctctgcctcccgggttcacgccattctcctacctcaggctcccgagtagctgggactacaggcgcccaccaccacgcccggctgatttttttgtatatttttagtagaaacggggtttcaccatgttagccaggatgggcttgatctcctgacctcgtgatccgcccgcctcggcatcccaaagagctgggattacaggtgtgagctactgcacccggctgaatcctgtttttttctgaaaccaatatagctattctagttttcttatcatttatgtctacatggaatatctttccccatacttctagtttaacttgtttgtgcttctgtatcaaatacatcgtttgtatccagcaaaaattgggtattgctttttactagtctgacaatctttgcctttaagtgtttaataaatatacatttattgtaaatattgatatggttgggtttgggtctactattttgcatttttttaaatatatattgtagatccaatattatccaatgcctatgagattccccagtctgctttttggaagcatgcactgttcctcttcctgtgtaagcaccaggctctattacctctaatacattttggtggtctttcttcagctttggataatttcatcacacttattttctgattagcactttgctgattacctgactggtattctctgcagaacttcaaaattacctctctgttcagctatctcctctccaatactctgctttataacctctgcttgccttggtcttcctatattcccatctttgtatcctcaaaccaggtagttaactaggctcctcatgggttttcttccttctaccatggcctggacctctctcaaggtagtaaactaggatacttgtagcactcttatcatttgttttatgtctcttggggatcactttcttagttatctaatttccagtatcttgaaaacttttttcatatgtgtgtgtgtgtatatatatatgagaacatatatacatacgtatatgtatatgtatgcatttgttcctgtttgtttcagatgagacaacaaattaaatccctgctactataccttggttggtagcagaaatctgttcactattcaactcagtatgttttttctttacattttgaacatatttttaatagtttcttcaaagtcctatgtattcccccaagtgtacaagaggctgtatagtataatgattaaatgtatgtatttgggagttaagtagaccttggtttaaatccccactctgtcactttccagatgttttactgtgggtatgttatttaaacatgtacacctccattttcagtaaaattagagcaattcaaatgatctcagaggcattctgaagatcaaatggagttgtgaatataaagcacttgtcagagaacctgacacgtagtaaattattaatatatggaagttcaaaaattcttcctatttaatagagaaactgtaagaatcgtagaatattctaaaatagaatgtatgtcagaattaaatggggtggtagaactgttaaacactataggaattcagagaaaagaaagaggacttcttggtggaattaagatttgtgcttggattttaatttaaaaacaatcacttgcagggcgggaagcctcaaattcaatggaatatggaataggtgggtatgtaaagcaaccactcgagagagtgcaaaggttttatgatgaagaattttgagaaataaaggcaaattgatagtcaaagtgaggtcaaattgtttgtgctttgaatgcctgataggagatttttacaataagaatcatttgtaattactagaggagcaggatatttttaaaaatcacagaatcataggattttcagtcttggagtgaataagatttagttccatgtttttaaaatcttcaagtttcatagcagtcaaatttcaatagttttgttcattggttatgaggaatgacagtgaggaaggagtgctggggaggaaaatgaatttggtacatagaaacacatgtgtcatgtaaagctttgggcagaataagtttgaaatgaagagacctatgagatttgcaaatccataggcaatagtaaatgcgtttctgagtttgtgttagaggtcagcttagagatatagatcagagagtttccagaataaaggtgagagttgaaatgttaacagatgggttcttttaggaagaatttgagcacagtttgttagagaaaatacagaaaggcttcagagataaaattagaaggccatatccaggaagaaatggattgttttgtgcagagtcactgaagaaagttagagagctatattgtcaatactactgacttcactgttaatagcaggtacctttcagattaatacacaaaaactagttactaataaggacttacaaagaagaaacagcaataatgacatcaccagatattttatgagacaatcagttgactttgcggagattgttcataccttattggaacttgtttgtgaggcagacaaaatttgtatttttaaaattgccatttgcctaatgaagaacccgaggtacaaagaggttccttaaaccttttagcagtcattcagctggttagcagcagaagaagctatgagcccaaagctaaggtctcccatattctagaatattaaaagtagctgtttttgtttcttctcatgctgctaataaagacatatctgagactgggtaatttagaaaggaaagaggtttaattgactcacagttccacatggctggggaggcctcacaatcatggcagaaggtgaatgagaagaaaagtcaagtctcacatggtggagagaagagagcttgtgcaggggaactcccatttataaaaaccatcagatctcatgagacttattcactaccacaagaacaatatggtaaaactgactccatgattattttatctccacctggccccacccttgatacatggggattactacaatccaaggtgagatttctgcccctatcattctgccctgacccctcccaaatctcatgttctcacatttcaaaaccaatcatgcctttccaacagtcccccaaagtcttaactcatttcagcattaactcagaagtctaaagtccaaagtctcatctgacacaaggcaagcctcttccacctatgagtctgtaaaatccaaagcaagttacttacctcctagatacagtgggagtacaggtagtgggtaaatacactaatgtgggagaaatggccaaaacaaagagactacaggccccacacaagtctgaaatccaatgaggcagtaattaaatcttaaaggtccaaaataatctcctttgactccatgtctcacatccaggtcacactgatggaagaattgggttcccacagccttggacaactccgccactgtggctttgcagggtacacccctctccactagctgctttcaagggttggcattgagtgtctgcaacttttgcagatgtgtgttgcaagctgtcagtggatctaccattctggggtctggaggatggtggccctcttctcacagctagctctactaggcagtacctcagtggggagtctgtatgggggctccaatcccacattttccttttttactgccctagcagaggttcttcatgaaggctctgcccctgtagcaaatttctacctggacatccaggcatttccgtacatcctctgaaatctaggcgatggttcccaaacctcaattcttgacttctgggcacccacaggctcaacaccacattgaagctgttaagggttagagcttgccccctctgaaaccatggcctgagctatacactggccccttttagcctgggatacagcagctgggatgcagggcaccaagtcctgaagctgcacacagcagaggggccctggactcagccccaaaaaccacttttccctcctaggcctccaggcctgtgatgggaggagctgctgggaaggtctctgacatgccccagaaacattttcttcattctcttggtgattagcatttggctcattacttatgcaaatttctgctgcctgcttgaatttcttcccagaaaatggggtcttctcttctactgcaccattaggctgcaaatttttcaaacttttatgctctgcttcctcttgaatactttgctgcttagaaatttcttccaccagataccctaaatcatctctctcaagttcaaagttccacagatctctagggcaggggcaaaaatgctgccagtctctttgtgtagcaaaagtgacctttaatccagttcccaaaagttcctaatctgcatctgagaccacctcagcctggactttattgtccatatcactatcagcattttggtcaaagccctttaatcagtctctaggaagtttcaaactttcccgtatcttcctgtcttctgagcatcccgagtctctagaaagttccaaactttcccacattttcctatcttcttttgagccctccaaagtgttacaacatctgcctgttacccagttccaaaatcatttccacatttctgggcacctttacagcagcaccccactctcagtaccaaaatctgtattagtcagggttctctaaagggacagaactaataggatagatgaatatatgaatgggagtttattaggagaattgactcacatgatcacaagctaaagtcccacaataggccatctgcaaactgaggagccaagaagccagtccaagtctcaaaacctcaaaagtagggaatttgatagtgcagccttcagcctatggctgaaaccctgagagtccctggcaaatctctggtttaggtccaagagtccaaaagctgaagagcttggagtctgatatttgagggcaggaagcatccagcacaggagaaagatggaggccagaagattcaggccagtctagtccttccacgttcctctgcctgcttttatcctagctgctctggaagctgattagatggtgctcacccagattgagggtgggtctgcctctcccagtctattgactcaaatgttaatctcctttggcaacaccctcacagacacacccaggaacaatactttgcatccttcagtccaatcaaattgacactcaatatgaaccatcacactaatagaggccataaatgcacagtcctttcattttacacagaaggaactgaagcctggagatttggactgtcttggaatgtggggattataagttacagaacgataaatatcacttgcctaatgaatgtctacctggatttgtagtttttagattgatctcattcaatctttaaaacaacagcattatggcataggtaattgctgtggtttagatgtgatttgttcccaccaaaattcatgctgattttgatctccagtgtggagtgttaggaggggggccgagtaggaggtgtttgggtcatggaggcatagccctcatgcacagagtgatgccctcccgtgagggtgaatgagttctctctggcaggaatcgattagctcccatggagtctggttcatcagtttctctctcttgtttcctctcttgccatgtgatctctttgcacatacccaccccccccccctttttttttttccacaatgacttgaagcaggctgagaccaccaccaaatgcagctacctaatcttggacttttcagtcaccaggatcatgagcaaaataaatcttttttcttcataaattactcaatctcaggtattctgttatagcaacacagaatggactaagacagttatgttatcatttaaaagccaaagaaagtgaagctcaaaaaagataaataacttgctcaaagtcaaagtcatgtaacagaatcagaattcaaactcaaacatatctaactacaaagctttgtcttgttttatgtgttatcttgactcttgacttttagcaaaaaacttcttccactcctttagctgcctacgtaatctgtgattagtgctgggtttttttccttgtttgcttgtttctgtttttatttttagatattgcatcagtatgagttctaacctgagcacagtcttttccctgaatatggaaaagggtctctcataataattaggaaatgctggctagcaataaaaagcaactccaagcagtaatggctcaataaaatagaaatatatttcttactcacctaaatagcctatgacagtttcaggtctgtggaagggccctggtctacatagccttgcaggaagccaggcagaaaaatgttgtactattttcaatacgtgatttccaaggttttcctggaaattggcctgtagtgagcaggtagaaatattctggaggatcatattaggcatttttatgacccatattgaaattatatcacttctaactctgcaactagagctcagccacatgaccttacatatcttcaaaggaagcatgctccaggcacatccctaagaacccaagagaaacaagagatagaagaactagcctgtttctgcctcagggtctttgcatgttatgttcagtacaattctggcattcagcaaatagcagaaaataagcaggtttgtgtttgctgtacttgtgacaatttatgttgctgattttacttccttaaacttatgtgaagttttttggtgaccaagagaatctaaatctttatgaggcatgtattatagatttatagattctattcctgaatgcttaacaaggttacacttgtctcaaaatccaaatgattatttttaaggttccagaaataatctcttagtcctaaccagtttcctgattgcaagttgatattattatatatatttttattttcagaatcaacttattctgtcttctgttttatagcagtaatatttagtccaaagttaatatccagactgtgcttaagagtctttttttgtttaacagtcacatgatgtttgattttatcattctcaacctacagattagaaaacaaagacttgtgaaatctaaataattattagtgcattattaagcaggaatttgaagtcatgtttgtctctaaagtctatatttataacaacagtttatttttcttttacattctatttgccccctagactctatgtatctggagggcagagaccttatctctctatgtctgcatcagaggatataatacagtgcttagtatatggggcaaatgtactagcacatggtgggtgctcaataaacttttgttgaatgaatgaaaatatcaaagtttttctcatgactcaatatcaccctaaaaactcttaggaaaggtataatctatccacaacctgagccactacttcagtgcaagctttaactattagtatgaaatacgaaagtacctctttgaaaataagctttgagaaaacctttattggttttataaattgtcaaattgcaaatccaataggaaagagattagatggaggaagagatccatccagctcaagagatggattttacaggaattcaaggatttgtttgcaaattgctttctctaggaaattcaccatatgccccaaaaggattaaaggtattgcttaggatacattttatgaaaacaaaccttgggtattcgtctgtttctcattgtaaatgaaaaattcatggcacacgtaggacttttcattgcaacaattatagaaattgttataattattataattataatcatgattaaaattactcctaataacaccattgcaattataacttttttgttacctattttgcccacttaaaatatctaaagattagaggtagaagcaaagtattaaatagaaactacataatgtcttttagaggaaaataacatgtaaatattaaatttactttttctttagttttatgaattgacattgtagtttgtgacttgcaaacaccaggaaatcttggggtattttgaaaatctccattatagccttggttaatttttcctttcattcaatctaccagtcatttattttttcatacattcattcccagggacttgtattgggcactttcaaattgcttggtactcccacttccaggtatccctagcaaggtaaacctgcataaaatgttgtctgttttcttggaaaatttgcatttgagtgatagacactaaaaggaaatcactgtgataggacaagataagtactaaaatagatgtgtgtacagatactgagttactaggggagggagttggtgatattggtggttgtttgaaactttaactattagtatgaaatacaaaacacaaacacacacacacatatacgtatatagttcttccctttgattatgagctcctggatttttggagtcatgtttcatccatttttgcattgaacacaacacaaaaataatccttgcacatatttttagctcaacagatatttacagaattgaataaatgtattatctttctgtaaataatcctttcttgatttgtcaacaagatatgatagttgtgacaaaaactagttctagctagttttgaactgtatttcaccatttgtaagctgtgtgacccaggccatatgttagttattgtgttgtcgacatttgactctgaggatacagaaatgaatactccatagtatctcactcaacaatcccccagcttctcttgtttccttgttcacattttcagctctgtgctggattaaactgagatttaaacaagattttaggactttctgtaggaggaaaggtgactttttgtttgtttcctttgggatggttgacacattgtgagtgcagccagccaggctcacagtaatttatcagaattccttgaatgagagttgattctgtagtgaacttagagcttctgtcttgtttgtttgcctgtagggagtgctgactgggagaaacaaatctttgcctctgaggacaaaggcagccacaacctagcttgggaagaaaccatcatttataatttgtaaattccccaaagtgttgctgaaaagcctccaagtgttttctatatttgggtctgtgatggttgctttatatactactgtgactacctacacagaagaaagccagtgttaggaacacagtgaaaacgtgagcccctctcaagtacaatatggtacataaaaatgaattttctggctttaattatagaccttgcacagagaacagaaatgtacagcctaggcaccagcatgtgatgtgaacctgattatttccagtgagtttctggaatcgtctgtgaaaagtacagttgtcaggcaaaatgggcttctccactactttctcatttcccatgcaagccagggattccctagtgtccctggggaagttgtagatgtgtaactgtctgattgtcttcactgcttttgaaagactcctgtgctatacagataacttctgccctgctgaatcatggaaactccttatcgtttcattttgggaatagaaatatctgtgaattgaaaaagtatttgcacatcattcaacacttctgttcttcctagaaatgttctattgaatttagggctgaaggagttactttatttgatcagataatttatcctccaaactcaggtgttttgagagtaaaagggaagtagatataaactaggacttttccaggcaaaccaggacatatgattgctttggttgagatgcttctatttgtgtatctcctgatttcccaaaacgctaaccatggctattacctaaagtattgtccacagcctgtaggcaacagggtctgtgttaatcatgactggtttttctgagagctttggaaataaatgtcagaggtagaattggttgctgctttgttacagagagttatccttcagcctaacatagagaagtcatctctataatcagccgtctgtttatatgtgtgtctcttgcctggtattcaaaaagcagtgggctgattgtgttatttagaataagccctttccctccaggagccacagcccttagtcatttctctacttgaagttttaaagtttttagtgatccaacatatgtcccagagaacctggacctgtaaaatttgaggtatgacaatctacatggtgattggaaatttattttctgggaatttataataaacacacacagcctaactgcaatatctgaagatcctatacaaatattaggccctagggactgagggcatttagaagtctaagggatgatgtatgtgaaaagatttaatgggctgaacaatacatgctacagaagaagaaggtgaccattgagttggagttgcacagtatgaggaactacaccttttctctctttacttggccagaatgccttgagatgacattacccagtttcaaactaaattaacagcccggtgcacaacatgggacttgtcaagataatagaaccaatggtagctgattgcccctgaactgatgcttcttataggccctgttaaaagaaattgcaaagtacattttgttcattatgggttagattccaatgttaattaaatttatattcatatgagtcccatatttcagatatttccaagacaagtcaaagaagattcccaggcagcagtagctacattctaagaaataattacttggagaaattctgttacaatgaactgaacccggtttaaaaattggcaactctgttttctgcaatggtgtcaatctccttcagtgcagaggcaaggctttgtgctagaaaatctatacatgaaccgggtatttggtgattctaaaaagccagagcctagacaaaaacaaacaaataaacaaaaaaagcctaggagacttcctttcctcaagaatgattgaagaatgagaatctctgatggactagcataatcaatccatagttttaaaagaaatagaacgatagttcccaaactgtgttccccacaacactagttttgcaagatattaaaggtatcccaagaaaaggtaattattagctaaataaatttcggaaacagtgtgtattatcaatcttatctcaaagctttgcaggacatataattatgacaagtctctggggctgtcatttaaaaaaatcagtttaataatatttaatccagagtgtcctgaacttatttgttcataaaaattttcaaaggacacaccataaaatctggaattgccaatttagaaatttttaatccaaaaaaaaagtcatatacacccaataccaaaactgtgccaaacaccctcaacctagttattcagagacaacacagcttttgagttaggatttttttgtgaccataagctctcattcattgttcaatatgagagaaaacatccaagaatgaagctttcaattcatttgaattctggaaaatatgggatttgcttcttccagtgactttcattgtaggtgactaaacagttttaattgatatgttgacatgagcatgttttaggcatttcctgaaaggttagtgtcaaaagaaattaatatcctggtgggcttgtgtttttctctgaggcagatattgatgaatgttcagagggaatcattgagtgccacaaccattcccgctgcgttaacctgccagggtggtaccactgtgagtgcagaagcggtttccatgacgatgggacctattcactgtccggggagtcctgtattggtaagcagctttcaggcatgccctccaactgcttggacctttgcaggaggtgtggcttgctttggtactctgttcagctcccagtgttaaaatatgaccattcattggttaaatgcatcagttttcaaattttctccctctacaattcagggattaggccagggatcatgcaaagtggggtgctagaatttttatatagaaactgtgacagaggaacaaaacctgggtctatatgttatggctttgttctaaggaaaaccttagtcttcttaattctttctaaggaaaaccgtgatgacttgctgaaatttttgacagtttgggaggcaactgtagagatgaggaaatgttaaataatactggatactggatttagattaagaaagtttagtttgaatctcatctcttatactgcaagagtcactatagtctctaatccttcatctgtgtatatgtaaaaatgaggataacaagatacatatattaagattaaacaagaataccacctatttaaaaattgcaagatttgaattgatgcacatatatgatatagttgcattaacattattgttgctattaccgccaccatcatctcttgaaaagtctgctttattgggtctcttcttgtggttctgttaaatactgaacacgggaaattagcagatggagttattcaccttcaagaccttacaactttcatgaaatccgaacaactgatcaaaaacataactgtttccatgagaaccttagccaatccaattctttcatgttgtgtcacctcagttgaattcttaatgctgatttggaccaacctaggggccaagcattctgaccttgggctcccaaagtttagcttgctgaattagaaagtgggaatttgattttgaatatttgttttctctgcttagggtatattgttttttttctaaaggctgctgctgagatatagtcagtgttttttcaacttctccactgatgttgatgtaaagcaaagatgaattacagaacaatggccacgtggcatgaattatcccccatagtcttgacattattgttgagaggcatgcagtatagttactaaaagtatggacttttggaccagatgttggcagtcaaattctagctctgctgcttctaagtcatttaccatgggtacatttttatccagtctgtatttcagctatctcatctgtgaaattgaaataatgtttatatgtttttgagatgagtgttgtgataattgagttaatatctgttaaatgttcaagaaatgttagctattattttaaatgtcactgtgtattcagcattctaccccatactctgttcatatttcttttcctttacatactgccaggtacttctgtacatatgcagctcattgtaaatcaatgttatatgaataggaacaggtcaaatggctattgttgaggaatgaaaatggaatattaacatatgacattaagcatggtggctaaaagaaaattttaatttttacagataatatttgacatcattaaaaggggagactcttagattttttagtgcacaaaggaccttagagaccagctagttaagccaattttatttattattttttctacttttaagttcaagggattcatgtgcaggtttcttccctgggtaaactgcacattgctgaggcttggtgtacagatgatcctgtcaccaaggtagtgagcatagtacacaataggtagccttccaaaccatacccttcccctttcttccctcctcaggcagtcctcagtatcttttgttcctatctttgtgtctatgtgtattcaatatagttaaaccaattttataactgtttggacctgccatgggactgcacacttctctgcctttatatacgttgtccctctggctgggatgaaacatgatgattcacatatgaatttcattttcctaaatttagctcacgtttcaccaagtccccatgaagtattctttgatgccttccaaagacttgtcactcctttcttctgctaactctagatctatctttttccttggtgtatgtttcagtagcttcacttgtacaatatatttgctctctgactagactattgagcagcgaatgggcttttttcttctgtttcttcagtgaggccctttggtggttgttgtttaataaatgtgaaaattcaatcatatcatgtgatcaataaagacactcactctcagaaaggtgacacctcattcccagccacataactggtttggatacaagttgaggatcagacctaggtcaagagaacatgtaggaatagtttcagtttatgcctcttgtttcaatgttacctgtagagccctatcaccctcataaatgtctctggcacctgtcctggtgctcatttctctctaacatgctgagtggcatgtctgaaggatgcggtaaaattcctgcactctcaaggagcgtctttcttcatctacaacctgatccctgttttgcaaaggaaaatgtcagtgaactggactccttggagttggagtcattggattagtggcatttttaatttgggtagtagtctgaatttctttttatttccacacttttgggaaaacatttgtaaatgatccttcatcaggacagaaatctgaccctcacttagttatttctgtggtagttgggagtactctgttggttcagaatatttcttgggcaaacaactatgtaagtcagataatgacactttcttcttatggccttctaatgccttcccaatgagtgtaaaataaatttctaactttatatggccttcatggttttagatgatattgttcctgcctgcttcttggactcatttcctatatatataaggctttttgatcttttcatgccttgaacatgacaaaaagctcattccaatttcagggcctttgcctttactgttctctctgtctggagctctcaacacctctcttgttgtatggctgccatgttattaggtctcagacaaatgttgcttcttcatggagaccctccctggcttttctctgaaataatccttccctactcactttgttataatacttttatatctttttagcatttgtattcacatgcacatgtgtgtaatattctcttgcctcaaacaagttgtttgagggcagagaccttgtttgccttttactactgtactcgcagcccctaagataatatagtcaaagagaaggcattcaatgcatgtatgtcaaatgattgaaggcatggatgttcaaaactgtatcaaatcagatttattttctattttgtttgatataactagttgtgtggtgtagattgtggtgcatgacatgagatgttaaatatcacaaaaccatgagtcttttatttaaaaaaatgtttattgagaacaaccatcataccagcactgccttgagtcttctgggaatatggttatgaacaagttaagatgtcagttcttgaaggattaatgacctgacgtactctggatcttaataacatagcttaatagcactgaaaatgagcacatctgaataaaccctaaataatatcaaccactaatgcttacatttaaaagaaatatcagcatctaaaataacccttacaattttttttaaaagtggtttgtagcatatactcagctatgtttttttcttcagacaatggcatatgttatcatctaaaatgtatcagtttaggcttttagaagaatagtctcatgtcactctatgtcactttttgtcagatgaggataatagcaccttcactactgattttatccattattgtaagcttgaataatattgatatcataaagaacagcatgcttgcaagatttcttattttatgagaagaaatgtttaagatttgcctttttctcttaaagtgtaacatatgattgaagaaatggccagtcctagtattgcagaggcagatagagtcactattcttgaagagcttatcagagttagtctcttctgtctctctctctgtctctctctttgtctgtctctctttaacttgtatatctttataatgccaggagaaaatagtacacaaaaatttgtaaattaatatttgcagaagatgataatgacagtgatttgttggcactgtagggtacaatgcactctgtgttttgatgcagtggtaggagtcagtgattctcagttttaatatagaagttgtgagcaattgcttttttgtctaggcatagttatctgggtcatttagaaatgagaagaactaatatataattaacaatggcatgtataagcagcagtactttgcatattttaaaaataagattcagactcctcggaatgtcaatcagtttccacaatattgctcccacaaatgaaactttattttcctttgttctctcatatactttgcatggatactggagactactcaaattcttattctgctcttcctaaatcctgcattctctttcctctactcctttgcttgtgtgcttttccctgactatccccatagccccatttccattagttaaaatcctgatgaagtcttactctgtaaagcagggattctcaaaactgtgtcatggtagattcactggagtagtgaaacggcagagttccctgacccccttagtaggacttgtgacaaagatgtggcttgtctgatcacctgccatgtgctcccaaactccttatgggagggagagtatacagatgtgcaggagctggggcaagcacttttgggctctggccccacaataatatctagggatgggtgcctgaaactcctaaagcccaagtgggtgtgtgttacactatgttctgttagctttgctgtgtacaggcagtaaatggctcattgtaccctctgccttttcacaaggacagagggccagtgtgacggctttctgtatctcaagctcttgtctggtgtccaggaaaaatcatattacacacggacttgaaggatggtgaatgtgggattttattgagtggtggaggtggctctcagtgggatggatgcggagctggaaaggggatggactgggaagacgatcttcccctggagtttgactgtccagcagccagacactcctctctgagtgtccccagccaaactcctctagacattcagatgctccttctcttctctcctctgctgctcttctgttcgtctgctcatctgcttgtggagcctggggtttggggtttctatgggtacaggatacccatagatagcccatagggtgtacagaatcctgggtacaggataccgatagggtgtggtgggccaaaaggcaacttttggttgcgaaaacaggaatgcctgttcccatttagggccatttagggccatttagcccatttagggctccctttgccagggagctgccctcttctacccagtatttccctgtctcctgtccatatcagtagctttttaaaaatgcctgtgacgggacatcacacatcctgaagattcatattcagttggtctggtgtgggacctagattgacaccattttctaaaatttgtttaagtgtattttttataaattcataatatttttgcatatttatggggtatatgtgatattttgttacaaccacagaatgtgtaatgatcaagtcagggtatttgaggtgtctatcaccttgagtatttatcatttctatgtgttgggaaaaatacgagtcctgttttccagctattttgaaatatatagtacattgttgttaattataatcaccctactctgctctcaaacattgtaacttactccttctatctaactgtatgtttgaacccattgaccaacctctctttaacactcattccccaacctgcacacccttcccagtcgctggtattgatcattttccctacctccatcaaatcaatttttttagctcctacacatgagtgagaacatgaaatatttacctttcggtgcctggctgtattagtctgttctcgcactactataaggaacttcctgagactgggtaatttataaagaaaagagatttaactggttcatggttctacaggctgtacaggaagcatggctggggaggcctcaggaaacttacaatcatgggggaaggtaaaggggaaccagacatgtcctacatggctggagctggaggaagagagtgaaggggggaggtactatgtacttttcaacaaccagatctcatgagaacccactcaccatcatgagaacagccaggggaacatctactcccatgattgaatcacatcctaccaggcccctcctccaacactggagattacaatttgacatgagctttgggtggagacacaaatccaaaccatatcactggcttatttcatgaagtcatttaaaaaaagactacaagtgattattagagagacaatttggccaatgtagagaactactgacattcagttcttctaataataagaataaaaatttctcccctcttatttgtcttcatagccgtttatttgccattcttttatagactttagcagattagacttgtgttcttaattacgtctttatcacctacagtacaatttaggtgttttttgatagatttttatcaattaatgttgaattaaattgtattggttgtgttatttttacctatcatataaaatgtttcattcacaagaaagcccatgttgttgctggagacacactccaagatgacatacagctattcttacgggactgaatacctgttggccttccattgttatctgctttatagcacttagttgggtgaagcagtttcctagactctggagcctgctctcaggccactgtaaatggcacagtgaggatttacttctcagagtactgctgaaaccatggtcaccatgcaaagcaatatgaaacaaccaaaaatgttccgctgaaatcccttgggaaagaaatttccattttatctggtggatgtgtcaggaataattgaaatggcctaagaatgattttgctttgactgcttctgctcagtgcctgtttttcataggagtggcgataaaaaggggtagaacctggaggtgctctatctgtaaaaatgctctcagtgacaaacctcactgaaggggaggggagctatgaagcctttgcaggcaatactgtgatgtaatggagaggggttttaaggacattaagcctagattcagtccgaaatcggcctctttctagctgagcagcatttagaaagatatttaacctttcaaagccttagttttcttagtgtgcattaagataatacttacaatggaactttttctaatatgtgtttttatatgcaaatttcctgacaagtattatatgatagtcaacatttaacctcccttcacctcagttccctcacctgtcacatgaaaacaataacagtaatactaataagagataacatttattgagagttttactttgtgccagacactgctctcagcaatttacaaaagcatcaacctcatacgggttgctgtggagtaatcgtgacaattaagtgagcaaacaagggaaagaagcattcagcacttaggttttaagcaggcaatagatgttattttcattaaccgaacaactacatgatgtgctagacacagaaccaggaaatttcatgtattttctaatttaatttcacaatgaccataggaggaaagccctcttactatccccattgtaaaggtgaagaaaatgtgagctcgaggacgaagagaacttgtcccaaattccgcagctgataaatggcacacagaagccataatccaggtgtgtttgatcccaaagcttctgttcttaatatgttcacactgcactgctttctggaagggaggagaacagtgatgggctcataggtagaggagatgttagccagagcagttggagattgaaaatacaaaaaaagggagcatgagagaaaacagatgagacccagatggacagttacaatattatctctgtgtgatgagcactagggacttattttattcactggactcaagggatgtgttctggggccatccttctgagcgatgggcaggataactacgcgacatgtttttgacagttaatgtgaaagcacctcagccttgataatactactactgggatatccactgatgtcattaccttctttgcatttctggtgatgtaaatccagagaagaaaaaggaaagaaagggtgggtgataaagagaatgagaaaatgatcggcagatttttaaaccaattttttaaatgtacttatttattatgcactgcctcttaaaagcaattagaatagtatatacaaagatcacatgttcaagagttatttaaaatacaaatatttgaaaaataaagaaattatattaaccaatgatagttatcaaagatgttcataaatatcctggcagtcagagcaaaatgggaaacatgagtatataaattattctaatttaaaaggaggtttcattcataatcgtcaagaagtaaagtctcaagtgtgctgttttttctattccagggaagagacatgtcagggtggaaaagcaccttagtggaccagggtatttcagactaagaaagtttaagagacaaggcagagacactaatcccagaacactcatggattttctctctatgctaaacaataagacccaccctacacataagatattttttggttaaatagcatgccacctttctttgataatatttagtgtggtctcattacttcaaaattgttgtttccaaagagctttacacacagttttatcaaagtactaaattctgtattattgaagagccttgcttaaggcagatgccacttaaccatggaactgtaaggaatcaatatgaagtaaatgcaagcatgattttgggaatcagagggcctcagttgcatgacacaaaattgccacatgtcattaaaagtttcagatggacagagagaccaagacccagacaccacctcagtatggaatggatatggaaaaagatcagtattatcagggtgcagaatggagaggttaagaacattttgcaacatctaatagaaaagaaagctcttctgggtcccccagaaaggaccttacagtggacacacagtggcagatgataaatcaggtgagaaatgaatctcatcagaccctctggaagcttgcctgctccttttctagtcctgccatacatagataagcctgaagctatttagcatgtgggctaaattggatacattttagagacttctctgggaagacaagcgcacctcctccgtttcgatgataatcacttcacaaagtaacatcaaaatagagtgcattacactagactcgggcatgaacccaaggttcattcattacccacagcctagctgggctgacagagcaagcctataagttgttttctatgtgtactttctaggagtttctaaacatttctgggagttagtctaacagaacctcagatgagcagtagggtctgtcctgtaagccattatgaacctgtctattatcttttcattctcagtcttttgaatatcttcctaatggcaactatgactagtcataaagaaaaagaaaaaaactacaactttggaccatgacatgaagcaatacaggcatatggggagccaggggaattgcaattctagttcaggtgaagttcacatgggcagtaatgataaggagaaaaattagaaaacttacaaaaaccttcacaagtattgggatgttattataagtattatatccttaaaaatatcctacagtggttttagcactaagctaggtggtaggtaggatgcagaaaatttataccatagggacttttaaattccatgttgaagacaaaaataatcagcttacataaaacaaccaacagccttctgatataggttatactttaaaatatggggtcaatgctataaaatatataggtaattagggaagaaagtgattagagaatatcaaagaacagtcataacagaattcttggggctgattcgacctgaaggatggaagggtttaggtattttataggtataataataaaagtaaatattaatatctaagattaattacttcatgttctaggtgctcttctaagagcttgacatttctttactcactttatcctcaaaacaactccaccaggtagaaatatttatgatctctatttaatggacaaagagcctgtactttatattatgaatgttctaaatgtatttggtcatataaccctttcctctcctgggcatcttatggatttggtttctattattataaaacacactaattgaaaacttgagaatgaatataaattcctattctaggaatttatagaaaaccttatttgctcagtatcattgaataatgagctgtttcagatgaggttttttttttccgttctgtggcaaaaaatgattgcatacactacttgctctataactatcagaatgtttctactatcttaactttggtgtaaggatatccttccaatatatgtctatttgtgtattacttttttaaaatgtggtcactaaaaatgtgaattactcaaaacaactgttgattattgagtgacgttctagtggtttattgaggtatagctggttggtccctaagttaaatgttcccagtcataatgtttttgacaaacatatttcttttttacacagatattttgtcttctttccacattgtcaagctaatctctattttttaaaatgacatttacgaggttgctctcctttccactctgataaactaaagagttggttatgtgatgtctcagacgacaggacctcaaagtcccagaagcctttggggataaaaaaggattgtgaagcaggatttcacaagtgctggatgacaattttgtattctgtgaattggcctggtgggagtgctgagaaaggaagacatgggttggggactttgagactttattggagagctggaacttgaagagtaagagttgggtaatacacaaggaaaagattaatacgttcccctaaaaaggtgctttgtagtgtggttatggttttagggtcctttcctcactgtgaacctgacattttttggaaaacaagcaacaggagaagctttttagttttctgaacaagaccttgaagttgataagcaaattgttcttcataagttttaaatgtcttttttctttcttcctgaatagctggcagtctcaactgagtgaaaacagaatgagagggggcatttctgaaaaataggttttcctcagatcctattacttcctgtgaactcagtgccccttgtagcttcaggcagtaattttagaagtatgatcctcagaccagcatcatgggagtcgcctgggaacttgttagaaatgcaaattctgtaccacactctctagaccttctgaatcagcagctctgtgggtaagggcctagtgatctgtgttttaatgagagctctcattggttgattctgaagctcactgaattttgaaaatactgccttggggttttcactgaaagccctcagaacactctgaaactgtatgcaagcttgtgtatacatctgtgcctacatcttctggaggaaatggaaccatagtttttcctgggatcttggccactaacaatgtgagaaccactgttgaaataccaggatccggcctcaatgtttccagttaccactctgactctgatttaacttataagtattttcttcctgaagatttataattcagtctcaggggagattcactgctttcctttgtcagtttctgagcactccttgatattgaattccatgtagtttcagcttcctgcctttttgaggctcagtgtgagcaattgtttcattacagaaactcctggcttgaatgtgttagagccaaagatcatgtctaaacagcaattcagagatcatcattgatatggtttggccatgtccccacccaaatctcattttgaattgtagcttcaataatccccatgtgtcatgggagggaaccagtgggaggtaactgaatcatgggggagggttttccctgctactctcataatatagaatcagtctcacaagatctgacggttttataaagggcagttcccctgcacacactctattgcctgccgccatgtaagaggtgcctttgctcttcctttgccttcatcatgatggtgaggcctccccagccatgtggaactgtgagtcaattaaacctcttttctttgtaaattacgcagtttcaggtatttctttattagtggcatgaaaatggactaatacaattatctacaatttctttgaaatgaatattgaatagttttttgttcttaccctgagattactcaagctgctgtgaaatatttacctgtgggtttatgagcagggaatattaaactatagtattcagaccaattaaagcagtgtcagcataaaatcactagtcatttgttaaaggaacattcattgagagggtctggtcagtgttagttcctgtactaagtcttaggcatacagagaggaatatgacacagtctttccagtctggagtggggacagtggaagtggacaaggatttggggaggttgtattgtggaccagctacattataaatcagtaaaacataaaagactctaagaaaaaagcaactaacttctcatggagtggggatatttggggatggcaatgtatatggtaatctttcacagaaaatatatttgcaccaggtctattgaatgagaaggattttttccaggcgaactactcattaaaggatctgttccaggacgtgacagcagcctgattatagatgtggtcatgaaaggaatctaattgcgttccaaggatggtgagatttccagtgtagatgaagcacgtgcttcatccacaaaccctatatgggtttgacttaggtgaggaataattagaccacagcctttcaatagaggtggagaccagattgtgaagggtagtgtgttctaagctgaggagttgcaagttttgaattttgtttcataatatcagtgttatataatattgttgtgaaaatgtgatcatttgtaaagaagtcacaatttttaatatgacacataattacgcaaatgtagtagtacttcccataaaatttcagatactctatcataagtctatcaatgtgattttctgcacctgtttctgctgttccttttgcttcaaatgactttcttctgaaaaagtgaggccctcagaattagccagctattgaacataatcattatcaagcaactactatgtgttaaatttgtcctaaaattctcataatgaaccttcaagtttggtatgacttcctgctttatagatagacaaactgaagaacagtgaggtctgaattttctcattgccacgtagtgagtagcaatttctcagctgagaaattgtgaaaatgactgcctaaaactgtttggggacacatgtaagtaagagttggattcaaatacaagtttctaccgattcctaaatatacaatcatggcgcaactgaaactggatcattttcctgctaaaaaaaaatcctcaagataatgagagtagcattatcaaactattcatttagcttctctttgaggaagagaccatggcagagcaaacagtatggtgccattgtaataaatggtccaggtagtggaaatgcagaggagtgaataagtggcattatggggtaaatggcaaagagtctatctactccaataaattgtaatggtttttagatagaggcatgatttaatcattttatcattgccttttataaatattaagtatcattaatatttggagaatcaatgtataggttgtcatgttggagattgtattagtttgttttcacactgctgataaagacatacccaagactggggcaattccaaaagacagaggtttaatggagaactcacagttccacatggctggggaggcctcaaaatcacggtggaaggcagaaggcacatcttacttctcaataggtgagagagagaatgagagagaagtgaaagcggaaaccccttataaaaccatcagttcttgtgagacctattcactaccatgagaacagtctgggggaaaccatctccatgattcatttatctcccacaacatgtgggaattatgggagctacaagacgagatttgggtagggacccagagccaaaccatatcagagatttaccatctagtctttgcataaggttactgtgtttgtattctacagaattgggagtcaaccattggttatgaggtgggacaagcctggctttaagttaggatgcctgcatttgtgtcctgacaaaagaattctagttgtgtggctggcccagggcaagttacttgaccctttgttactctttctatacctcttacactggggtcctagcattgctgaaagcatgctgctgcatacaagataacacaaaagcaggaaaggaattttactgtactccatggtttcaggaaaatatgatttctatataaacaatcctgactatattattaactagaagacaaaaataatttttaaaatagaaatataaaacttcaaatatattctatactaatacataacagggtttatgaatatccaagattccaagtgagtgttcactctttttgccatggagataactttggtagaaatgtttgagaagcagtgatcatttaagtgactctcagtttggttaagtggcaatgatgttgatacaaacattctgagtattttgcaaggacaaattagatcatgagtttgaaatggttttgaaaattctaaagagtataatgtataagagtttactaaggtattgttattatgcataacaaaaagataaatctctgttatatcaaaatgtgttaatcaatcataactcaataaaagtacctagggtggccaggatagcaaaccatctgcaggttcttgaggaagatacatgaaagatacatgattctgttgtttgtttcctcctattgtcttaaccttccaagagaacgaattgtgtctgttttacttgctgtcatattcccaattcctagaacggtgtctgacacagcaaatcaacatttgctgaaaagtgaatttataaagagactctcagtgcagtcatttttcttattaatgagtacattggcccccatctgtaatttatcctaataagctgggctcaaccagggatgaactgccagaatctttttatttgtaatctggcaccctgagtggcattaaagataccagcagtattaaagattttaaaaacgtaatatgaaagattgccaaaggtggacactaaagtgttaagaacagattttaatccctaataaattattgcaatagggaagagggcccaatgtaaacagaaatgaacttcaatttgtgcagaaatgactgggtgttttagagggtgaataaaagagtggaaaaagagtgaggcaggggcttcaacatgagtcaggaaagtggaatttacaaaaagctgaaagggtaggtttttcccatgaagcccatctgaatttgttaagtggcacttagggaagttagactcaactcctccacagagactaggagaggggtcctattttcaagtgttggctgaaataaacagtaaattattttggcagcctttaccttttccaggcagaaacttttggggtttggaattcccatcctagtgatgtgaccttgagtcattagaaaaaatgttagtgtttgagttcattgtagattctggatattagccctttgtcagatgagtaggttgcaaaaattttctcccattttgtaggttgcctgttcactctgatggtagtttcttttgctgtgcagaagctctttattttaattaggtcccgtttgtcaattttggcttttgttgccattgcttttggtgttttagacctgaagtccttgcccgtgcctatgtcctgaatggtaatacctaggttttcttctagggtttttatgcttttaggtctaatgtttaagtctttaatccatcttgaattcatttttgtataaggtgtaaggaagggatccagtttcagctttctacatatggctagccagttttcccagcaccatttattaaatagggaatcctttccccattgcttgtttttcttaggtttgtcaaagatcagatagttgtagatatgaggcattatttctgagggctctgttctgttccattgatctatatgtctgttttggtaccagtaccatgctgttttggttactgtagccttgtagtgtagtttgaagtcaggtagcgtgatgcctccagctttgttcttttggcttaggattgtcttggcaatgcaggctcttttttggttccatatgaactttaaagtagttttttccaattctgtgaagaaagtcattggtagcttgatggggatggcattgaatctataaattaccttgggcagtatggccattttcacgatgttgattcttcctacccatgagcatggaatgttcttccatttggttttatcctcttttatttcatggagcagtggtttgtagttctccttgaacaggtccttcacatcccttgtaagttggattcctaggtattttattctctttgaagcaattgtgaatgggagttcactcatgatttggctctctgtttgtctgttattggtgtataagaatgcttgtgatttttgcacattgattttgtatcctgagactttgctgaagttgcttatcagcttaaggagattttggactgagaccatagggttttctacatatacaatcatgtcatctgcaaacagggacaatttgacttcctcttttcctaattgaataccctttatttcattctcctgcctaattgccttggccagaatttccaacactatgttgaataggaatggtgagagaaggcatccctgtcttgtgccagttttcaaagggaatgcttccagtttttgcccattcagtatgatattggctgtaaggacatgaacagacacttctcaaaagaagacatttatgcagccaaaaaacacatgaaaaaatgctcaccatcactggccatcagagaaatgcaaatcaaaaccgcaatgagataccatctcacaccagttagaatggcaatcattaaaaagtcagcaaacaacaggtgctggaaaggatgtggagaaataggaacacttttacactgttggtgggactgtaaaccagttcaaccattgtggaagtcagtgtggtgattcctcagggatctagaactagaaataccatttgacccagccatcccattactgggtatatacccaaaggaccataaatcatgctgctttaaagacacatgcacacgtatgtttattgcggcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcgcaagaacaaaaaaccaaacactgcatattctcactcataggtgggaattgaacaatgagaacacatggacacaggaaggggaacatcactctctggggactgttgtggggtggggggaggggggagggatagcattaggagatatacctaatgctaaatgacgagttaatgggtacagcacaccagcattgcacatgtatacatatgtaactaacctgcacattgtgcacatgtaccctaaaacttaaagtataataataataataaaaaagttaatgtttgtttgagtcttttaatgagggttggtgaatggagtagacaaaatcatttatcagagagtctgctcagaggagtctgactagtgttcagtcatggataggatctttgttagtgacctactttggttttccttggaaaccaacttagtttggcttatatgattttacctcccttagggtaagaaacacagaaaaaaaagacaaatttaaaataaagagaatttgatcctccaaagtctagagcagtggactcaagtctcctactctgtgcttccttttcccttgtccccagaaaagccttacagatcttttcagagaatcttcctttcaaattagggggcagccccagagctattttaccgaaccagttgtttgtttagcattttatagaagaaatatgaagagaggatcaagattcaaagggataaaatcttccaagaaaagacaccatgagatcaaataaagcttcattaattagcttgtttttcttctctgcagatgctgcccttcttggaatggtggttcaaattactgtccttgatcaatgtcttaactcccctactagggcatagtttttggaaaagccttgacttccccttagaagtttggaactacaatacacagggcagtgaaaggaaataataaataatatgcatgaaaggacttggaattcttagctcctgtaatctgaccctcctttgtttacattaaaacctggtttgagaattgctgtattgacaatgtttttagacctttgacttctgtgtaaattgcagaatgcttcttgtagtgaatgaaattactttgtaacctccctgtgactaagacctttccttggcacagaagagagaagaaataattcctcatctgagaacttgcttgagagaatgatctgtcaaaatagagagttagttttggttttcaccttggctggattccccatgtgtatttgtcaccgaggattacattgccaaggcttcagtgcagacaggaaaaacatacttcttcctttgttgcttcctctcattggcacttgcttgtaaatactcattaagggagagcagaaatgtttcaataattatggaatgtccaagagaactgtttaattctaagaaatgcatttgttatcccaaaactagttctttccttcacctctaacctgctcttattctgtcaccactcatattctaaaacttgaattacaagctcagccttacagaggtgaaaagtaatcatatcaaattggaaatggacaagatcttagaaaacattttatatagctcctaaattttaccaaagagaagcctggggccatccaaaagcaagggttctttttcaaccacagctccaccaaatctaaacttaacaaatgtttatgcatttcttattaggtgaaagacactgtaaaagctgctatgagagacataaagataagaccagaatcttacaaatgtgaatgggtaaggaagatagaaaagatagaatgcttacagctaagcatacaagaaaacataaagccaacataggcagcataaaattaaaatacagggaaagtaattcttttcagcaaaggatgaaattttgttaaagacattaaacaatataatggctataacaatacagtgtgtatagctgggtattagtcatttagtagactgcagcaataatacaaaccaccctcctactcataagcagatatgtaaaaacatataaatcgtgggttgttgacatcaatactgtagcctctgtgcagtaaaactctgtttaaacagcaagtatttcagtatttatggattttttatttattctctctgctggtcagaactgtattgattttaagcagatttaatcactggttaaagaagtatgacttgttcatagcagaaagtaaaccaacttgattaatttagaagaaacttttcttcgtctacagtaaaacacctaaatttgtacatcctataaataaaatgtaattagtgaccaaagcaagttcatggagtgtaagaaaattatgtttttcaacatgtttcacttaacatcagattaaggctcagagaaagcttttaatgttaacatttctgggtatggctagccaatgtactaatcaaaaccatgtgaattcatgtgagaatcagaattcacgtggaaatccttggcaaatcgatgaatgtgtgggctggttgcatcataagagatcaggagtggtggtacagatttgagtatatttgagtatctgtcctgaagagatgggagagtgaaattcattaaatgagattaaatgtatgagagaaaaattatagaaacaataggaacaagaccaacaataatagtgactaatcatttttgagcaattattacatgacaagcatatcgttatgtatttacccaaatgattctatggagtatatttttatctacatttttctacataatgggaccaagactcagagatgttaggtaaatttttagagtcgtacaactaataaattgcagggatggactgggacagagttgactcacttgtccctatggggctggaactttctcagttttagcactgaaagtcagctatctcaggaactccctcagtgccaggcaaactggtatccgcagtttctggattacaaaggttaagctttcaattggtatgctatacttcttccactaaggagaaagagaaacaaggaccagacgtggaaacttaggatatacaaatatttttttaaaatgagagacaactataaagtcaatacttacagggccatatctggcttctttgcccattgtatctccagcacttagcagtgtatctggcatagagtagatgttaatggcatagagtagatgttaaataaatatgcagggaattcatttattcattgatgagtactagtgactagataatgaagagataataggatgaagagggcaatattatattccagaagggtcacagagagagctcttagactgaaataatcaataacaatatttgttataatactttttaagcaagggtgatgattttgcaaactagtggttatgagagacttcaagatttagccttcgagaagagggtcccacggaagcttgcacacattcaggagagaatgaaaatgagtaaatgcggatagttgctaattgtagatactaggaaataaaatctggatcaaggaaatagtgagccaaaacagtgttatatttttcctttgtcaaaagagagtctccttaattaaaagaaaggggaagagtcattgcagagtaagaaaattatacaccaaacaagggaacaccataggaaagggtttcttcctgactcaggaaaggtttggggctggaacagtgagtgaagagttaatgctaaaggggtattgaaaattcttcctaaaagatacatagcagcatctcaaatagatgaagctatctctaacttatctcttcctttagtctttgtcttttcaggctgaacatcctgtgttttgccaaagtgagatgagtttgagctcctcatcacgctaatggatctcttctgatgtgttctaactgtgtcaacctcattcttcatagtctgtgtgctaaagggaacacaatatccaagtgtggtatggccagcacatgatagagcatggctgccaccgcttagcctggatttgaaatttattgtgcaggttaaaatttcattagccttttattttgcaagttacatcagacttcagattcgctacttattttacttattttgctaacgtgtagtgtgtatattttcccccataattttctctctgccactgtaaaaaaagcaatactgctttagatattggagagggatctgttctctagactgtctgtcattaatgaacccccaagctctgttctcatttctgagccactcataatgatttccaggtaggaacacacacacacagctgtatattcaaacgctgggtaaacttttgtttctgacacatcacctgttttgagtttgaaaataagactagatgtgctgtcaaagttattcaagaaagaggaatatggggtaatgaaaaagttcactgctttgacctgttaccaaactgttggtaaaatgtttactttgatttctgaaatcaacctgtagaagtattagctcctgaggcaagtactaatacagtggttatgctattaaaaatttctgcagagccatttggcttgaagggtaggaaaattgtttgcagctagtttaggattggtttgattgctgctgttataaacatctctgaattctattttcttacatgcccaagtaacctaaaaacctcacatcaaagatgaaagcagattgacttggcacaactagattgttttaaagagcaaaactgagtacaataataacagctttcagaaattgtgaaaatgttaatgcaagaaaattagttctaatgcaagcttagccatggaattttattgaaaaaatatttcattcgagcatgaagcatttaaataatgaatttataagaagaaacacagagagatcacagccagccattatttacaataagaaaaacaagtacattctaatgataatagatttgagtacgaaatactcaaatacttcgtgtaatttttctttcattgcctgtttgtcattgggaggcctgtctgatgatttgggtaagtctcacgggtgaataactttgtgtttgctcagcagagaacaacagttgcaatatgtaaatagggtgcctcttcccgttggctgccttgggatatgtataatagattaagttggctttgtgcagagcaaacaggtctgtattactaagaatatgaataatgttggtttccataattgctaacatctggctttccataaatctgctaaattgcatggaaacagaattagatttctgtgtcataagtaaagcaattacatggaactctgtaggcaatatggtcctatattcaactgtgaaatcttttcattctggagaagtgaaagcaaatcctggttttgcgccctgcttttattgtgcacaataggtatgtttatctttatgctcagccttcttaatttatgagagaaaatcactaccaatatatttgcaactttgtaaatgcaaaataaccaaatattttaaaagcataatatagctgggcattagttgtcaatgtagatattttttagagaaagccataaattaccaacccttttgtagccactggtggtggatgggttgaagttatacttccagacaatttctggagccatttgttaatgcttcctctgcccttgttctcaagcatttgacagaaaataaaagttttttcctggggaaggggcagggcattgccccttcttcaatgtggttgctaatttgctgtattttttctactttaaattagacccaagggccttcacagatgagaactcaacaacaaaatgtgttccctgaagggcagggttgtgattatgccttatgcttgttgaacactctaaagaccgagttttggcaaagtaggcattataatagtctcagtctgtggatttcctaagaaagttaaatggaataaatacatcgaatatccatatagtattctgttatactcagcactgggaagagaaagaaaaataaaatttagtgtctgccctcaatgagctcactctctctggaggtagacaagttaaacacgtaactcctgagagaggaatgcaggatagaattgtgtataaggtacagagaaagcaaaaaatctgtagtgactgtcttgccatataagagatggtgaggcttaacctgaatttttaagactgcgtaggagtgaaagtagtacaggaaggaaagtgcttatcaattaattgattgatacctcacctcattccctataggacaagaaaaagtagggaaagagagagagtactctcataataaaagaaagcatgttctaagacacagttgtttcataggaaacaatatggcctctttgtggatctcccgttgctttttaaaaaaaaatcagttgacaaatacattttatatatatttatggtgtacaacatgatgttttgaaataggaatacattctggaatggctaaataatcaagctacataatatatatatatatattaccttatacacttacttttttgtgacaaaaatattctcaattttcaagcatacaataccttgttattaactacagtcatcatgtttgacaatagagcttcttgaatttattccttctatttaactgaaattttgtattcactgcttttgaatgaaaagggaggggacaagagataacaattgcagtattagatggcatttatatgctatgctgggtttaaaatttttggaagaccatacattgagtgggtatagtgtatatagaagataaatgagagaaaaacaaagtaacatgtcaaagaatatataactgttacgtgtaaaatgactaatacatggtaagcactcaactaaaaagtaagagcttggtttcaaacattggtcaccagactcccacatttaaaactccttttagttgagaagaataagagaattgaaagaagattgaagagataagagaggctatatgaaaggagcaccatatgttcaaatagaaatacactgagaatgggatgggcatgactagtaacagtgaggagatatagtgaggcttgattttagttgacttaccatacaggcatcataatttgggatcttttctataattttcaaaggagaaatcattgttcactaatgaaatgtcttgactaaagctaaaattggtaagacaaagccaaaaattagatcttggaaaaaagtaacttctagaaatattattagaatttcttaatgtcatctgctttgtattgcaccatgtgcaaagaaacttgtgcatagcaggtaaaccaaaaccaagtagactagtagacacttattcaatggcctcagacactaagtatcagtacttctacaaatgagtagaagttactcggtagtatatttcatctcaatttaagggagacatttccaaaagagttatccaaaggtggagtcaggtattttgcaaggtaatggattgccttttggggaaggacttaagccagggttggacaggtttgtgtttgagatgttgttaaggtcgctcaagctttaaatgtcagaatcggccgactggatttatgtttttattccattgttggctgtcaataaagagcaggacaatatatttatgtctttcatcagcatccatccatatagcaattattttttatgcacgggcaaatattctgctggccataaggatagtaagactttgactataaaagacacctatcaagaattgttcccacttccttcaactttggtggtaggatctaggagcaatctgattgtctcaaggttgcccaaattgcccacttgttcctactcagtggctaatacattcacatcttttctaaaagactcagatctccatggtggtgtgtgcatactgttaatgaattaacagtgtttatggcctctggatgaaatcgttcttaagaatatcctaaaagaacttgctaactgctactggatattttagtaattagagtctgggagctagctgtagatttgggtctcagatcagccacttactagctctatgacagtggtcatgttatttaagttatgaacctcagcttcattatttgcagaataggaataaggacagatctcccacacagagcagaactgacttgcagtgtaaatgagataatacatgtgaacagcttggcagtacctagcacaaggtaaatggtcgatgatgttagttaatgctactgcaaatgatggttgtttgttctctaagttcccttggctagattctaagcttctgtgcttcctatattgcagacattgatgaatgtgccttaagaactcacacctgttggaacgattctgcctgcatcaacctggcagggggctttgactgtctctgcccctctgggccctcctgctctggtgactgtcctcatgaaggggggctgaagcacaatggccaggtgtggaccttgaaagaagacaggtgttctgtctgctcctgcaaggtgaggctgatgtggtgcagcagaaattgaaactgttctttctcttcttccctcacttttctacctccccagctctctccctcttgctgttgactgtagttcctgaacaggcttctcctgttcttatctacattacagctaatgatgatgctaaggggtagggaagcctgctttgaattgattgtgttcttagtggaaagtgaggtatgagattgagaaggaactgcagggaaggcgaagcagggtagaaaagccaatgatagtcctcccactgaaagcctacagtgcttttaaggttggttgggtgagagttttaatgagccctcatcccacgcttatacaaacttgctgattaaaactactctttgcctaaaataaccacctgcatgaacttgctcactttatgacatcatctagaaaagcaaggccaacagacttgcatccagtgctgagacaggtggattttcattttgaacaaatgataatgatagtatgaggcctcttagaaattgatgtcttctttgttattctcagtgctgggccattccttatattaagttgttggaaagtgagcttaatgcttatgaaaataaaattctgtcatcatttggttttgctttatgctttgcaaaatgggtctattaaactgtttgatctctttgtgctttatttcttcttttattgatcttgcctatttattttcctttgttattgctctactgtagctcttgcctggtatgtctatgtctgttgggatgggactatttaatcttgagctttatgtgcatgggaaccaagataaattacttgcttagtagcctcttagccaagtctcctgataaattcccagtctgctgaaacagagctgaaatgagccttaagaaatcatccagttcatccacttgccttcatctgccacacatccacagacctggggccacctagttaggagggccacattatcaagtgctagatcattacccccaacacctattttttcccctttcacataaacctagtttcccacactccaatctaggtttgttttcccttattggagcacctgctatatttcagccaccctataattcaaaaaagctgcatcatgtttacttcttacagcactactttgaaagacaatgaaactgaatttccatgggataaagtaacttgccctaaatgttaaagatataaatgtctaagctgtgacttgaactccacttgcttggctcaaagttcatagtttttccatcttgtcagatgtcttgtaacactctacgatgatatttattggtatatttaaaaccagttaggtaactggtaatctaacttgactgagctcagactttcaactcagacttttgactttcaactagattccatgtacttccttgtatgtaagtgactggtgagacattccttcaaggggttttgaagttattaagtataatatttaaccacatggtgctgactcaaagggcaaaaatttttaagagaagacaaatctcattgtgggttagaatatttccataattcctcatggaagaggatggtaattaggtctcccattcagccagcagaatgggggtgaattctttgctaggtcatttcaagaaactattgtgttattaaacttttgaggatgatcattacatatcctcacatcctttttgggctttctaggtccccagtccctggaataggcaaaggacattagtggagtcttgattagtatgagagtaaaattcttctttcagtttttgttttatttaagccatgatgaagcagggaacttactaatcattgaaaatttcccagagcttctttaattaactgtattaataatccaagcaacgtatattgatttcttctgttttgaatcctgaagtgtttccaaagtcttatgagaattagactgaaatttccacaggggatgagcaattcttgtaatctaattttgttaatatgatgcaccttcactgcaaagcactgcaatttctgaataaagtacaggcagatttctgtacataaatcttttgtttgtttgtgttctacatgtactcattgcccatttatagcacagtttcccagaggttgtggagggggaagacagcctggtttaggagctgaattaagcatcctaaatcagattctgtaagtcaccattataaaatgaactgtttgtggccctccttgtttctattatttgaagttgaaaatgctctgtttcaattcaatttgataagaaatacctccaatacttacacatccaaatgggtgactataatggcatcatcttggaagctaagtaataaaatcaaggttgggatataaagtactatcttttcaatcatatccttgatgtttcagatttaaatgccgtcaaattatgcaacagcagaattacacaaaccaacaaaaggtcaagacttactgctgaaggaaatagagttaaaatttttaaaaggctactttcccctttgagagtcagtacaccagcttagctgctagtgtttcatggtaattgataaaaaggccttgaaacatgtccacagatgaatagagttcaatgatgaagctaggctagcataaatggatttgggcttttgtttagattctatgtacttccttggcagtgacaatgtttttgtgcatctttagacacctagttaattaggtacagaaagattgctgcacagcttaaaacttatgtccctccagcattatttagaccacaggaacccagatgaaaagtggttgtctctctgggattgatccataaatcttggttacagcccagcgtcttttcatagatacccatctgtggctcttccattcataaatttgtctaggactttaggaagacatctttattttcagcctgtgctacatgggaaggtagagacgtccccagcttattcgtttctaggaaatgtagtattttagtgtgagtagttgtgtttatgttgcagatcatggagatgaagatgaaaatggatacacaaacaactaaccacttgtcatatatggtagagctatgaacaatttgctgtgggaacacagaaaggggaagcatagtctgccctctgtatttgttggttccacattcttggattcaaccaaccccagatcaaaagtatttaaaaaacaaagataatgcaaatttaaattaaaaatataaatatttcatttttaccctattaggtattattagtaatctagagatgatttaaagtatatgggaggatatgcataggtggtttgcaatactatgcagttatatgcaaatactatgccattttataagggacttgaacatctgcagatcctggtatctgtgcagaggtccttgaaccaatcccccagagatactgagggacgactgaatgctctactctgggaagatgcagaagtgaatacggaaagcctttcacagaggaggtgatctttgaaggggcccttaaaggatgaggaatttaatcaagtagagatgtaggggaaggtgaatcccaaacaagagggaactgtaagaacaaagatgaggaagtgtaagaatatatgttgtgttagaaatatgaagtgaatcatgagctcaaaatatcaggaacaaaaagagtataagaagggtatagtcactgatgagccaggagattatgatgagccaggagattaaggctgaagacagagccaggccacgggatttagacttcatcctgtgggcagcaaatgatcgtaagagattttacgtttggaattggcagggcccagtcaaggtctgattgacagcatgatggatgacctgagcagatagaagctaactagaaagaaatcacttaggctgaggtaaaggttcagaggagtaaagatgaaaacctgaaagagggatagagaagtaacatctaatgggagaaaatgcagaagtgaaaaatgggtcctgatgactgatgatgctagagacttagtgtctgtggtaatgtcttccctattctctgggcaaaaaaaagctcctgagtagcatgtttgagacatagctgcccattttctcaggtgaacaggattcaggtgccattacataagagtaagaaccagggtctgcaagttgggcttgtatactactacatctatacctacatgtacacttatacctatactattttgagtagtaactggataatctagtgggaggaagagagcgaactatgaaggccagatagtgtttctatgatttcttgcagttaaaaaatgtgagtagccttcatcgtgaaaacaaagtaatactaaagacttgagcagtgttagttcttgagtttttctggggtttagagatgagtagggaaagggataccataaatagccagtatttatggtataacagtattccatgttataataaagtcagggatgaattaccgtggaaaggaaagtcaaagtgaagaagacctttttcatgagattgtctggaatcatggccatctgatctggtttatgtaaacctattcccagaaactgaagatggtcatgccagcgacactctcaagaactcatgtatctctttctggcaaggaggaaagaatctgatccacaaggagcagtcagcatactggttctgccttcctaagaataggacttactcacaggaagaagccagggaacagtctggtctgtgcctggggccaggatagaagcaaactttctgaattccagcaaactgctcataaaaatgctttgccttgctctttgaacccaactagcagcattataaatattttcctgtctgtggtggttttgatggttggagttagctgtgcaagctgtaagattgtgtttcttttccttggaaagaggaacttattggtaggtttcatttggcactcaaaactctaggggtcctgtaaaggaacagggcgtctctttctatttccctgactctttcccctgtggtagtgttcaaaaccctgttttgaccttgcaggagcttgaacgttacaccatgctacctccccatctgactgggtgatgttttttctccatgattttgaagctttgcaccagaatcacctgcagggcttgtgaaactttgatcactggctctaccctcagtattttctggttcagtagatctggggtggggtgcaagaatttgcatttttcagtagttcccaggagatggtaatgctgctggtttgaggactgccactttgaaaacttttgccccaagaatacttctgatatcactttatctaaaattagtttttcctatcccctagcctcctcacgatacaaaaggtgcatcacagtggaaaatcattgttatgaaagttcaggttagggataagtttctgttttgttattagttttctacatggaaaaggcatttgcctctctgggcttggtttcctcttcattaaaatgagataactggataaaatgactgctaaatgtgtttctaccccaggtgttaggactaagagaccagtttgtgggctgtgacctgaaggcaaaattaatactttgtaaaaagattggaaatcacagctcaatttgtgtgtgagaaagtagaataggtgcgtctagattaccaaccctaatttcatagtctatatcaggcatcagcaaggtttttttctttaaagagtcatgttgtaaatatttcatgttttgtagaccataaagcttctgtcccaaatactcaattctgccattgcagtgtgaaaaagacccacagacaaaatgtaaatgaacaagggaacttgtgttccaataacacttcatttacaaaaacaggcatcaggttgaatttgtaccgtgggcatccgttttccaacccaaagtttatattactgttttacagaaataatctgacctacgtccaccttcttgatttaaaagtttcaaaactctatggcagaaaaaaaatgagtgatattatgtaatctggagtaaatatatcagtatttactgatatattgactgaaatactgaaatattactgaaatactgactattccatattaaaatttgtaattaatagcaaaaaacctataatatttttatggcataagaaaaaatgtattttttttaccagataggaaactttatttccctgctttttaaaattcagaagcaatttaaatattagaataattattaattgcttatcattgaacttgcagtataaaattgcatcaaaacagcttctgtggcagaagattgcaaaaatacatctttggcatataagtagggattgttcaaaccacccaagttaggatagagatcaagctctggaaacagcctcaaagatctctgataaaaggattacttatcatcagtgagctccatactctccccaaatttagtttctagtgtgattgtgctctgtgagctgatgttttataatggcattctcattgtattaatggagtcacctgtgacattttcattattaaaaatgattttcttgacagttaccctgtaattcaaaggcaaagtgaacattgccattgttctgaaacacgttagaagctaagaggggcctatttggcattttcacataattgatgagatatgaaattgctttattttgcactaaccctggaggctatccatttattcttattcattcttttaatcagcacataggaagaaaactgacattcttattgagtctcatagcctgttgtgcagcgaccttttctgaaagaatttatccttttgtttgatgccagccacagacacagacatgctggttcctaaggcatgatccttctacacttgggaagagtgatagtgtgccattggaagctgagctgatcaaatggttttgtgttgtagctatcattactttgcttagtttttgttggttaaagtaagtcttcagggagtcatttggggccatggtgacacaagcaaaatatattactgagttaaaataatggtatatgagctgtaaaccaaaggcctattgttgggaaattcctaggatcaggacacttccttgtcctgactagctggattctctgattgaattcacttgctaaaatatagagtctcttgcttgctctctatatacacatgtttgcatacacatgcaaatgtatatgtgtgtgtgtataatctttcatctcttgatatttttggaacactatgatttcttgttatttgtatagtaaaagagccaatgcacacgatacatttttcaacctgttgttatatatgtagctggcatgtctcctttccattctccttaaagaatataaagcttttaaggtttccactttagctgacacaaaacatctcagcaagtcctgtctgattattcagcgttgttgtggataaagtagataaagaccctgagggcaagtccatcaagttttcagatgtcactaagctgtgaaggacggtgagctatagtaaatgacataaataacatttgcaaagcattgtgacaggaagaagagatgaaatagatctaacaatatgaaatgcaacagagataaacatcaagttgtatacttgctgcccctaaacagccaactgcccaagatgagataaggcttaatgaggttttagtcttcattaagctcaatattagccaacactatggcatagtcaaagaagtaaatacagtcatgcatcacttaatgacagggatacattctaagaaatgagtcattaggctttttcatcactgtatcaacatcatagagtatatttaaacaaacctagatggaatagcttgctacacacctaggctatttggtatagtctattgcttctaggctataaacctggacagcatgatactatatttagtattgtaggcaattgtaacacagtggtgagtatttgtatatccaaacgtagaaaaggtacaataacaatacatataaaagacaaaaaatggtatacctgtatagaacacttaccatgaatggagcttacgggactagcagttatggtaggtgagtcagtgagtgaatgttgggtgcatgtgaaggcctaggatattactgtgcacttctgtacctttatgaaccttgtatacttaggctacactaaattttgaaaaagattttttttcttcaataaattaaccttagcttattgtaactttttactttataaactttttaatttttgtaactttttgactcttgtgtaataacacttagtttaaaacacaaacacattgtacagcagtacaaaatactttctttatattcttattctataagctttttctaattttttaaaacttattaaacatttttttcaaaccggcacacaaaaacacaccttaacctaggtctccacagggtcaggattatcaatatcactgtctttcacctccatattttcctccatgtcttgtcccacttgaaggtcttcagggacaataacacgcacagagctatcatctcttatgataacaatgccttcttctggaatacctcctgaggacttgcctgaggctgttttagttatctcttttttttttttataagtaggaagaatacattctaaaataatgattaaaaaagatagtatactaaatacataaaccagtaacctagccatttattatcattatcaagcagtatgtactataaatgactgtaggtgtatatttttatacaactggcagctcagtaggcttgtttatacaggcatcattacaaacacatgcatgagtaatacagtgcattacataatggctgcgatgtcactaggtgacaggaatttttcagcttcattaaaattatataagaccaccttttgtatgtgtagtatgtcagtgaccaaaatttcattgtgtggcacatgactttattgaaaaaaaagcctgcattaaagaaactacaacacttaaaacaaggtgagcattaaattcaattcactctttcttcaaagaccattgctgaataattctatttagttctctctcagctacctcatttgagaaatagagagatacattcgcattccacaaattatcaggattaaatgtgatcatgcatgtaaatgcctctgcacaatgcatgacacaagataagtattaaatacatggtagaatatgatgatgatgatgatgatgatgatgatgatgatgatatatacttaaaaccattgaaagagaaggcaactatgacagtgaaaggattataaatgatggggactggtcaagaagttagaggtgtttacccagagatgaaacatctcagtgagtacataagagctgtcttctaaaaactgaagaattgaaacatgacaaagtgtttggagttctgttattactgaaggtatggattcgggtcaatggatagaagtaatgagaagtctgattttttacattataacatgtacagagatgcacactgaattctctccatagtgatgaatccaagactgagagcctcaagcacttcagcagttgaatatgacctcaactgtaggtcaggaggcttggttatatgttctttaaggtaacttgcagccctgagactctttggttttttaaaatattcagcaaattagttattagcatgaatggtgatgacagacaggtcttaccttaaattttcagcaatgaagaacattgtttaagaaattactgtaagcaacagacataaaaaaaagacatgctgcaaaatgtttactcttactgcttaagtgctgctgactttcaattttttatagctatgaatcctcaaagacaatacttcaaaaattgtactgtgcttacaatatggggaactgccataaggtggaaagaggcaccttattatacacccctgtagtacacaactttaaggcgatcttgccaaagaatattttgagaccataacaattggtggtgctgcttggagaaccactacctaactatgtcatcttggataagtggtttagcctctctgggtctacgttaattttctgtataaagggcataatcagacttcctttcacggttgggacagggatatagttagatgaatgtatttgaatatgttaagtggtagcatggaaatacaggagcatgattttccactcaaatgacttattgatcatatatgcatttttagctgcttacttataattcttacttagaaatacgatttttaagaacccctttgaaaaagattttcaaaaaacatgttgactttttgttaaacttaaaaatgttcctatttttattttttctgctctgcaagcaaaatcagggaaagaaagggtgtgtttgtgtgaacacacatgtgtgcttcagttttgaacagaatgagaggtggccagggggtgaccaaacatccaagaagttcatttctcttagtgtagctgtccatcatgtcctaaatgatgaaacctccttaacttcatttctaaacaggatggcaagatattctgccgacggacagcttgtgattgccagaatccaagtgctgacctattctgttgcccagaatgtgacaccagagtcacaagtcaatgtttagaccaaaatggtcacaagctgtatcgaagtggagacaattggacccatagctgtcagcagtgtcggtgtctggtatgttggcttcctttataaggtgttgagcctttactctgaaagaggttacaaattcagttgtctgtgggacctagttcccagtttttcataatactatacagggagctctgtggggcctgtggctaagggtcatgttctcttcctaaagatattcaggttgtatttgaaatactgtacaaagtaaaaagcacatatttatgggacagatttgacccaaacaatgacagtttacagctattactaaaaagaaatcaagatcaagaaaaatctctgcaagaaaggaagctttcaaaaccttgactagtgcttgtagtcctgacagagctaaatctctcatttctgtgccataacccttaaagatttcaatataagaggtaacaaaacatagtagaaatatcagagatttaatcatagagacctagaatctaaatgtggtcctcccacatactagcttaaaatgattaccttgggcaagtcctagcattttactgactattctggccctcaagtggacacaggtatgtgagtacctctgagggaaagaatgggctgttacaaagattacaagatatgtaagaaggacaaatacagtacttggcttagagaaggtacttagtgtatggtagtaactattgttaatacttcctaccttgaaaaatcttttcagatactacatgtttaaaaaggaaaaaatgaaggttgttataaatattaatatagggctactaatggtataattagatttgagaaagtccagagaaaaggcttaatttcttgacctggttctttcagtttcaaattatatcacaaagatttctagcagtgggaagacttctaggacacattgtcatggaatgtgatgtcccatatgtaaagtcacaactatggaacattctgagttgattggtaatggaaactattagctgtgtgtccgtaatttaacatttgctgacatgaatgattctcattttatgggtactgtatgaaaacaagtattcagataaattatgctctaaatttccatcagatttttttaaatcttcaggtgaatgtgcagataatcttaacagaatatgtctttcttaatcactcctatgactgagaagcatgactcagataaataaaaattgtagtcattttttaaaactcccacccaaggacaaaaaaagtcaatacaactgtagaattagtttccctatgagactggcaaattgcatttcttttccaagaagctaatcatcaggcatccagaagaattagtattaatttgatgcatgaaattttcatagatagaatttcaaaagtgtatcctcttccatcctagcccctaagatgaatatttctcaggaaaattgaagctgttaaacacataacttatgaattacttgagaatactgtgggtcatacttaataaatattcaagacttttcatgtgccaaactttgtatgacgtaacagtgagcaagataaacatggcctatacctacacaaagcccacagtcttatggagatgactgaacaattaaataagttgccatatattgtaaggtattatgccatagattataattcatgatagcagaggaagaggatgcatagtgaaatagttttattgtgggcagctcaatgaagccacagatgccagatgctgagacacacaaaagctccatttgaactgcaatctagaaagttcagtggtcacatgttatattcaaaaccattctgaaatggttatcttgacattgcccaatcttaactttaaatttgattgaaatattacagtgcttcaggttctgcttttgaacttaagagaaattaattgctctttatatactagacagtaccttataatttatttattagcctttattgaccaaaactgtgctaaacatgatggagagaaagtaacaagcagaaagtctgaaagctcaaaacttaatgtggaattgtgctaattatgatataagtatcatgttaaaataattataggctgtgcttggcacacaaagaagctcacctagctctttctatgtcctgcagtatagatgatcagcaaaagcattctgaaagaagtgagacctgtagtaggtcttcaaggaggaagtgtactttatcctcaatggtgtcaactagaaatattcagtgatgagaattactgtgctctctttccccttctatgactttgggaataaaattatgcataggaacaataatgagacattttttgcttttcctctacaggaaggagaggtagattgctggccactcacttgccccaacttgagctgtgagtatacagctatcttagaaggggaatgttgtccccgctgtgtcagtgacccctgcctagctgataacatcacctatgacatcagaaaaacttgcctggacagctatggtgtttcacggcttagtggctcagtgtggacgatggctggatctccctgcacaacctgtaaatgcaaggtaattggatgttctgcggatattgaagccttgaacaattgccagagaacacttgcaggaggtccactcctgatgtttctgaatacacaggttcaatggacatggtggaaactctggcatacatttacttctcataggaatttaatatgtatgaatattatcatagctgcaccctgtaaaaaggcaaattccaaatgagcatgaaataaaagaattgctcctgcctttgaactacataattttgacaagtgattcttggcttaattatgactaacttaggctcttttgacatgcatattaaataaaaagaaaagaaagaaagggaaagaacaaggaagggaagtagaaagaaaagaaggaaggaagggagggagggaaagagggaggaaggaaggaaaccagtcaacttcctttcatcctggaaaagtttctaagttcttttattaaactgtcaatgttaggggaaaaaagtcctctcaagttgttttgctttgtttaattatcagagtgcctaaggtggggacctgcagctcttgctacagcatttcattaacagtgattatttccctgtctttttggaggggttttcatgagacatcctcatgtgtcattaagactaaaaaactgaccattctctcccttcaaagctcatgaagagctggagtggtagctgatttggaacaatcattagttagtgtcaaatatctgccaaaatatctgtttaagattcccatgattaaacatgttaaaactaggagcctacttggtcccatcaaaccctggctcagcttcaagcatcagtggaagcttcccaacttgcctctttatgctgttataaatgtagattttttttttctgggaaagtatcatcttaagatgtagccccagtagaaaaaggatactatcagacctcatatagaaaaaggtccatggtcccatctgtaccttcagtcccagagaactaaatgaccaggacacagggagacctctgttacttatttgataattatgtggaattataaaggtatatttacattagtacataaaatttttaatgaatttataagtatttatatacctaactatgcactatccccttcatagtcaccatgagagattttatgcaaaccttactggaccccatcttggacttgcctgaagattgttgggggtactttcaaatagcttcttaaatgacaaattgctatcttttagggatttatttttggaaagaatctcgcttggaataagtacagcaaacaggtcatgtgaaaagttggaaatcccagggaggcctcccaagcagggattgagtgcaggtgatgtgtgaaattgaactgctagcagaatcccagtgagcagtaccctggagggtctgtcagtccttcctttctttctactctttctctagtttttttcctagcatttttttctagtcattttttatagccttcttgaagtttgtctcaaaatgctgaaagttgttttgagtataaaaattgcagactgctaatttatattccatgtctcaactggctaacacatgtttctttgatgtacagaatggaagagtctgttgttctgtggattttgagtgtcttcaaaataattgaagtatttacagtggactcaacgcagaagaatggacgaaatgaccatccaacgtgattaaggataggaatcggtagtttggtttttttgtttgttttgtttttttaaccacagataattgccaaagtttccacctgaggacggtgtttggaggttgccttttggacctaccactttgctcattcttgctaacctagtctaggtgacctacagtgccgtgcatttaagtcaatggttgttaaaagaagtttcccgtgttgtaaatcatgtttcccttatcagatcatttgcaaatacatttaaatgatctcatggtaaatgttgatgtattttttggtttattttgtgtactaacataatagagagagactcagctccttttatttattttgttgatttatggatcaaattctaaaataaagttgcctgttgtgacttttgtcccatctactgcatacttagtgctgagatccctgtaaaatgttttgatgaaaatatgtatgtagagtccagtcgcattatacatacatttcatagtgctgaaccttcttaaatgcctactcattcagcttaaacaggctgaagccaagtatgacaaagaggggaagggccaaaaacataatcaaagaataattttaaagagaattcttgtctctcttgcaa

SEQ ID NO: 348 - DNA, 906113 bp, Homo sapiens; identical to SEQ ID NO: 347

SEQ ID NO: 349 - DNA, 24272 bp, Homo sapiens
tacttacacctttctattttttattttttacatcaaacaggtaatgtgatgatgctgtaacaaggtttgagggaagcatatctgacacatgagcatgaaaccaaatcaccatgcttatggactacaaaaggacctaagccttttaaactagactgtctcaactgtgcattaattatgtatttagatataggatatgtgcttgggaaaatgtataactaaactttatgtcttacttctcaaacttaagaaaaacaaaaacatctagcaacatcttacatgagttttccattacctagtgttacatcattgttaaaatcatactctaagcctatattttaccttaatgttatctgcttcatagaatagttattcctttaacacttatttttaagaaataaatttattttacttgtagttacttaaaccctagaaataattttttcaaacagtagaagtacagccttttataataagatagttcatgatttgttctttcgaggattttttttttaataaggttcttctacaattggatggtgacaaagtttgggtttgttaggattatttttcagcagccaatcagctagccaaatctatgggaaaaaaaaaaacaacctaagttaagaaacagttacatatttcctttcaatatatactatatcaattggaaacttaaacagttttcaaaatcactttaagaaaatgaccattaaaaatggaaacatttggatttacattatgcaagattgtcaagaatagatccaaactggcaagaaagaagtaaaactatctcttttcacagatggcataaacctacatgtggaaaaccctaaggaatttacaaggaagccactacagctaataaattcagcgaagatgtaggttacaatacacaaaaatcaactgtatttctatacatcagcaatgacagtccaaaaaaaaattttaaatcactttcatttacagtagcataaagacaaataaaatgccaagggataaatttaacccaagaagcgaaaggcttatacattaagaactgtagaacattgctgaaagaaattaaagaatacctaaataaatgagaagacattatttttcatggatacggagatttgatattgttaagatgtcaatacttcccaaagcaatctacagattcagtgcagctcttgccaaatgtccaacaagtttttttgcagaaatggaaagccaatcctcaaattcatatgaaattgcaaggggctctgaggagccaaaacaatcatgaaaaagaacaaagttggaggactgatttgtactctcaatttcaaaaccttctacaaagctacagtagtcagcacagtgtggtaatgacatccttatgccagacatgcagaccaatagaatggacctgagagtccagtgctctcttcggcagcacatataccaaaactggaatgatacagagagattattagcatggctcctgtgcaaggatgatgcacaatttattaagcatttcatattttaaaaaaagaatgagaatccaggaataaacccacgcatctatggtcaacaaatttttgacaatggtaccaagcccattggtaccactggacttggagaaagaacagtctcttcaacagatggtactaggacaattggatttccacatgcaaatgaataaagttggacccctataccacaccatatacaaaaatgaactcacaatggaccaatgacctaaatataagagcttaaacaataaacatcttaaaagaggccagtgactcacacctgtgatcccaatacttttggaggccgaggtaggaagatcacttgagaccaggagttcaagaccagcctgggcaacatagggagaccccatctctacaaaaaattttaaaaattagctgggtgtggtagtgtgctcctgtggtcccagctacttggcagcctggtgcacaagaatcacttgaactcaggaggcagaggttgaagtgagccgagatggcgccaccagactccagcatggggaacaaagaccctgtctcaaaaaaaaaaaaaaaaaaaaaaggaaagaaaaaaaatcttaaaagaaaacataaaacacaggggtaaattttcatgaccttggatttggatttcacaatggattcttagacatgacatcaaaagcacaagaaataaaagaaaaaataaataaattggatttcatcaaatgaaaaatgtttatacattaaaggacattatcaagaaagtgaaaagacaacctacaaaatggaagacaatatttgcaaatcatatatctaataagggtttaacatctagaaatacaaagaactttaactcaacaaaaagacaacccagtttaaaaatgggcaaaggacttcaatttgaatagacatttcttcaaagaaggtatacaaatggccaagaagctcatgaaaagatgttcaacattagccattagggaaatgcagatcaaaaccaccgtgagaaaccattttgtgttatctactagcatggctacaaaaaaaaagaaagataggtcgggcgcggtggctcacacctgcaatcccagcactttgggaggccaaggcaggtggatcacctgaggtcaggagttcgagaccagcctggccaacatgaagaaaccctgtctctactaaaaatacaaaaattacccgggcgtggtggtgttcgcctgtaaatcccagctactcaggaggctgaggcaggagaatcacttgaacctggggggcggaggttgcagtgagcccagattgcgcctctgcattccagcctgggcaacagagtgagactccgtctcaaaaaataataataataaataaataaaacacagcaagaaaataataagtaatcaataattatacatatctaacatgtatatgaaataccttctagaaatgtttattttaaaaaggttctcaatatttgcagtatttcatttatttacttatttattttttgagatggagtctcgctctgttgcccaggctggagtgcagtggcacaatctcggctcactgcaagctccgcctcctgggttcacgccattctcctgcctcagcctcccaagtagctgggactacaggcacccaccaccacgcccggctaattttttatatttttagtagagatggggtttcaccgtgttagccaggatggtcttgatctcctgacctagtgatccacccacctcggcctcccaaagtgctgggataataggcgtgagccactgcgcccagctatattcgcagtatttcaaagacacaatgtcttaaacgtgaaaactacagacaatttatagaaaaaaaaattttttttttgagatggagtcttgctctgtcacccaggctggagtgcagtggcacaatctcggctcactgcaacctctgcctctgggttcaagtgattctcctgcctcagcctcctgagtagctgggattacaggcacatgccaccacgcccagctaatttttgtatttttagtacagacggggtttcaccatgttagtcaggctggtctcaaactcctgacctcggatccgcccgccttggcctcccaaagtgctgggattacaggcatgagccaccacgcctggtgacaatattcttaagtgtgaataaaaatatttcttaccaaaggatctgctggtttttgcttacaaagctctgtgagtccttcaagcagagttggcattatatgtaaatttaaatagtccttagcagcttgtccaattggaatgggctcaacaatcactgcaaatacaaatgtattctcattgatgcaaacataatgattaaatactatacaatcattaaaaaggttctttttaaagaacttttctctatttttttatatgtttttttgagatggagtcttactctgttgcctgggctggagtgcaatgatgcaatctcagatcactgcaacctcctcctgggttcatgtgattctcccacctcagccttccgagtagctgggactacaggtccgcatcaccacaccctgctaatttttgtatttttatttatttttattttttgagacagagtctcgctttgttgcccaggctggaatgcagtggcacaatctcagctcactgcaacctccaactcctgagttcaagtgattctcctgcctcagcctcctaagtagacaggagtgtgccaccatgcctggctaatttttgtacgttgagtagaggcagggtttcaccatgtcggccaggctggtctcaaactcctgatctaaggtaatcctcctgtctcggcctcccaaagtgctaggattgcgggcatgagccaccatgctcggccctaatttctgtatttttagtagagatggggtttcaccatgttggccaggctggtcttgaactcctaacgtcaaataatctgcctgcctcagcctgccaaagtgctgagattacaggcatgagccactgcaaccagcctgttttctttttcttttcttttctttatttttttttttttgagacagagtttcactcttgtcacccaggctggagtgcagcagcacaatctcagttcactgcaaccccgtctcccaggttgaagcaattctcctgcctcagcctcctgagtagaaccagcctcagttttcagttgggatgtttctcttattatttagacataggagttctttatatattctagttacaagttctttatattatttggtgatattttttcccagtctgttgcctacctatcttttcatatttttaaaaatttaacttctatttttttttttgacacagggtcttgctccgttgcccagtctggagtgtggtggtgtgagcacagctcactgcagcctcgaactcctgggctgaagcatcctctggcttcagccttccaagtagctgggcctgcaagtgtgtgccaccacacccagctttttttttctttaagtgtttagagacagggtgtcactcacgctggtctcaaactcctggcctcaagcaatcctcccacctcagcctcctgaatagctggatttacaggtgcaaaccactgctcccagctcttttttttttttttttttttttgagacagagtctttctctgtcgccaggctggagtgcagtgccgcgatcttggctcactgcaagctccgcctcctgggttcacgccattctcctgcctcagccttctgagtagctgggactacaggtgcccgccactaattagtccggctaatttttttgtattttttagtagagacggggtttcaccatgttagccaggatggtcttgatatcctgaccttgtgagccgcctgcctcggcctcccaaagtgctgggattacaggcatgagccaccgcgcccagcctcttttcacattcttaatgatgtcctttgaagcacaaaagcttttaatttgatttagtccaatttatcaatattttcttttatggatcttgcttttgatgtcattttaagaagtctttgtccaactccagttacaaagattttcttgttttcttttagatgtttttacattgaagtctgtgatccattttgagttaatttttgtgtatgctatgaaacaagggtctaagttctttttgtttttatgtgactatcatgctgtcctagcaccatatacagactttcctcaatttacatgggttacatcccaataaacccatcataagttgaaagtatcagtaagtcaaaaacacatttaatacacctagcctattgaacatcatagcatagcatagcctactttaaatgtgctcagaacacttacattagcctacagttgggcaaaatcatctaacacaaagcaaattttatataaataacattttctatataatatacatatattatgagctgggcacagtggttcacacttgtagtcctagctccttgagaggctgaggcagtaggattacctgaagccatgagtttgagaccatctgggcaacaaagcaagactctgtctcttaaaaaaaaaagatatatatatatatcatttttgggggaggatctcttgaggccaggagttcaataccagcctgggcaatatggcgagactgcctttctacaacaaaaaaattcaaaaagtagccaggcatggtggtctatgcctctagtctcagctactcaggaggctaaggtgggagaatgcttgagcccaggaggtcaggctgtagtgggcaccactgcacttcagcctgggtgacagagagacaccctgtctcaaaaaaaaaggaaaccaaaatagaatggttgtatggatactcgccattaatgtacacagctgaaagcaccatagtaaagtcaaaaaactgtaacttgaaccatggtaagttggggactgtattggcaagaccatccttttctcactgaattgtctaggcacctttgttgaaagtgaattgaccataagtgtaaaagtttacttctagatcctcaattctgttccaataatctatatgtgtatctttatatcactgtcataccgtcttataattgtggctttgcagtaagtttcaaaatcagatagtggaagtcttccaactttgttcttcttttctaaaattgaattatttgcaattttgctaaattttaaactcagcttgtcaatgtctacgtaaaagtatgcatggacttttaaaaggattacattaaaattttctttaaattttttttttcttgtagagatgaggtctcactttgttgcccaggctggtctcctactcctagactgaagcaatccttctgcctcagcctcccaaagtgttgagattacaggaatgagccactgcacccaacccaaaactgttaattaatttagaaagaattgccatcttaacaatattgagtcttccaatccattaatatggaatatctattatttattttaaaatttatctcagcaatgttctttgtttttcagtgtacaagaattgcactttcattaaatttatgcttaaatatggccgggcgtggtggctcacacctgtaatcccagcactttgggaggccaaggcgggtggatcacctgaagtcaggagtttgagaccagcctgcccaacgtggcgaaaccctgtctctactaaaaatacaaaaaattagctgggcgtggtggtgggcgcctgtaatcccagctactcgggaggctgaagcaggagaatcgcttgaacccaggaggcagaggttgcagtgagttgagatcgggccactgcactccagcctgggtgacaagagcgaaactctgtctctaaaaaaaaaaaaaaaaaaaaaaaaaaaattgtgcctaaatattatattatttttaatgtcattgtgaatggaattttcctttttacagctttattgaagtattactcatgtacacaaaattgcacacaattaatgtatacaattttttctcaatatgggcaaatgttttattcatatattatataaagttcattatgccaatttatcaggtactaatcattaaacaaaaatttttttaatttttttttttttttgagacatggtcttgctctgttgcccaggctggagtgcagtggtgcgatctcggttcactgcaacctctgcctcctgggttcaagcaattctcctgcctcagcctcctgagtagctgggattacagatgcatgccactatgccaggctaatttttttttatttttagcagagatggggtttcactatgttggctagtctggtctcgaactcctgacctcaagtgatctgcccatgtcaggctcccaaagtgctgggattacaggcatgagccaccacccctggtcccccaaattttttttaacttataagtgtacttaaaatttctttttattttaaaagcatgtcatccttgcataggggccaagctaatcttctctgtatcgttccaattttagcatatgtgctgaagtgagcacaacaaattttttaatagataagaaatattgtatacatttattgtgtacatgttgttttgaaatatgtaaacactatggaaagacaaatcaagctaattaatatatgcattacctcaaatacttatctttttttgtggtgagaacacttaaaatctactgtcttagcaattttcaacaacacattattattaactatagtcaccatgttgaacttattcctactatcacaggaataagtatcctttgatcaacatttccatcccctactctctcttgcaagctcctggtggccaccattctactctccgagttcaagtttttttagattccacatataagtgagatcatgtgatatctgtctttctgtgcctggcttatttcacttaatataatgtcctccaggttcatccatgttgtcaaaaatgacagaatctcttcctttttaaggctgaatagtattacattgtgtatatacaccacattttctttatccattaacccactgatggacacttaggttgattccatatcttggttattgtgaataatgccacaatgaacattattgtggttcattggtgcaggtatctcttcaagatcctgattcaattctttcagatatatatatccagcagtgggattgttagatcatgtaacagttttatttttagtttcttgaggaacttccatactgtcttccatagtggcagcaccatttttaatctccaccaaatgtgtacaagcattccaatttccctatatgcttgccaatatttacctttttttcttttgataatagccatcctaacgtgtgaggtgatatctcaccgtggttttgatctgtatttccctgatgattagtgattttgagcacttttttttttttttttttttttttttttgagatggagtcttgttcttgttgcccaggctggggtgcaatggcgcgatcttggctcactgcaacctccacctcctgggttcaagtggttatcctgcctcagcctcccgagtagctgggattataggcacgtgccaccacacctggctaattttttgtattttttttttagtagagacagggcttcactttgttgaccaggttggtcttgaattcctgacctcaggtgatctgccagcctcggcctcccaaagagctgggattacaggcgtgagccaccacacccggccttaagcaccttttcatatacttgttggttatttgtatgtcttctttagaaaaatatctattcaagtcctttgcccattttttaattgggttatttaggggttttttggatattgatttgtaagagttccttatatattttagacattaaccccttatcagatacatggtttgcaaatattttcttccctggaattgttttcttaatttcattagtgaattattcatttatttatttattgagagggtctcactctgtcacccaagtgaagtacagcagcgcaaatgcagctcactgcggcctcgacctgctgggctcaagtgaatctcccacctcagcctcccaagtagctgggaccacaggtgtacaccaccacccccagctaatttttttatttttggtagagacagggtcttgccatattgcccaggctgctctcaaacttctgggctcaagcaatcctcctgcctctgcctcccaaagtgttgggattacaagtgttagccaccatgccaggctagggctgaataaattaatgagagaataaaaagagtgttttcatgtttcttacatggatgaactttaagttttttaagttttctctcatccttgttttatttatttatttgtttgtttgtttgagacagggtctcactctgttgtccaggctggagcactctggtgccatcacagctcaaacagccttaacctcctaggctccagtgatcctcccactttagcctccagagtagctgggactacagacatgggccaccatgcccagctaattttttattttttgtagagatgagatcttgctatgttgcccaggctggtctccaactcctggactcaagtgattctcccgcctcagcctcacaaagtgttggaatcacaggtgtgagccaccacacccagactgtatatttattttcaaatataatcattttgatagcagggatatcttcttattcagctttgcatttatggcaaatagtaggcaacttaataaatttgttgaagaaatggaatatagcaaaactttgaattagccatttatattaaaagggaaaagagaccagcctgggtaatgtagtgagaccccatctctacaaaaaaattaaaaaattagccgagcatggtggtacacacctgtagtcccagctactcaaggggctgaggtaggaggattgcttgaggacaagagtttaaggttgtagtgagctatgattgcaccattgcattccatctggagtgacatggagagaccctgtgaccaccccccagaaaaaagggaaagaagagagcattacttttttcttttcttttctttcagacagtctcactctgtcacccaggctggagtacagtggtacaatctcggctcactgtaacctctgcctcccaggttcaagtaattctcctgcctcagccttctgagtagctgagattacaagcgtgcgccaccacgcctggctaattttgtatttttagtagagacagggttttaccatgctggccaggctggtcttgaactcccaacttcaagtgatccatccgcttcagcctcccaaagtgttgtgatcacagttgtgagccaccacgtccagccagcattacttttttcaagggttaagaacatgcctttaaatatcttgataacttgcttgagtgaatcatcgtataaagttttgcacatagttgttcatcaactgctaagtaagaggacgctcataccacaaactctgagtacttgctccaaagaacttcacagcaaaagagctacaatgtgctaagtaattaatgattttatatttatcctacaacttgctgcttctcaaatgtctaactatatctctaaactcatgcctagcggattaatttaatgagtaaaatcaaaggcaactgaaaataacagttggctgggcacagtggcacagtggctcatgcctgtaatcccaacactttggaaggcaggtgggagtattgcttgagcccaagagttcgagactggcctgggaaacatggcaaaactccgcttctacaaaaaacttgaaaaactagccaggtgtggtggtgcacacctggggttccacctactccaaaggctgaggtgggaagattacttgagtctgcgtggtcaaggctgcggtgagctgtgattgtgccactgcactctagcctgggcaacagagtgagaatctatctcaaaaaaaaaaaaaaaaaaaaaaaaaagaaagaaagcgaaaagaaagaaaattacagtttaggaatataatcctatgagtaagaagagcttccaaatataccttctatttaagataaaatgaaattttatcctgttttatttaaaagctaaagagaagtcaggcatgatggttcatgcctataatcccaacattttgggaggtagaggcagcagtattgcttgagcccaggagttcaagaccagcctgggcaacgtagtgagatttcatgtctatagaaaatataaaaattagccgggcgtggtgatatgcgcctgtggttccagctactcaaaggctgaggtgggaggatcacttgagcccagaaggtcgaggctgccatgagtcgtgatcatgctactgcactccagcctgggtgacagactgagactccatctcaaatagataaataaataataaaagctaacgagcaaaagtctaattcacttgtaagactaatataaagtgctaccatattaaaaagacctctcgctgggcacggtagctcactcatgtaatcccagtgtttggggaggctgaggcaggaggactgctttgagaaaaaatatatatttctaaaagtggtttttgtttgtttgtttaagaatcagggacttttcagactgtacagaaaggagggaagcaggtcttcccctgggaggatgactgaaaggccagtggagaaaagttgtcagcccattgtcaggtcagcatcaggccgttaccgaccctgttggcactaaaaagtaacagatcaagtattcaaaatgtgaaatgtatttattttgaattcagaaattcaaacaacagtgatactgttgtatcacatcagttattcaaaacatgtgaaatctccaaaaaaaagaaaaaaaatatatcaggaacttttaaatctccaagacagttttctgttttatttgaatgaatatccagtggaaaatactgaggaacagatctaaatgacttagggaaaaataagtcataacaggaaaaataacatactaaaaaaatccaaaattttgctcaatgctttgcatttttttccttataacaaaaatcaccaaattttatttctgctctaaaaatattaaaaacaaaccaaaaacttcagtgttcttcctcgtatgtccacttctcaaaggtttacaacttctctaacagtaaggaaacaaaaaaagggactagttattaatttctcaattgcatgagactttgttaggcaaacagtaaattgttacagaagacggtaaatcaaatgtagtttcctagagagactatttttctcatgtgtcacaaactctactgaacctttcaggataactagaaagaactgttacacagaagaatatgtctaatgcaagagaaaagaaagaaaaaagaattaagctgggtgtggtggctcacacctgcaatcccagcactttgagaggccaaggcaggcagattacttgagcacaggcatctgagagtatgctgggcaatacggagagaccccatctctccaaaagataaaagaaaattagctgggcatggtggcatgcacctatagtctcagctacccgggaggctaaagtgggaggatcaccggagcccaggagtttgaggctgcaatgaatcaagattgtgccactgcacttcagcgtcggcgacagtgagacactgtcttaaatttttttaatgttaaaaatagataaataaataaaaattaaacacttctcaaaagactccctaaagggcacaatttagttgttagggaaatgtcaagttttccatttgtggcttcaagtttttaagtaactacaacttgaaaacataacaaaatatactggaaaaaaaattattttatcttccttcccagctatatccgcaaaataaaagaaaaagcaaacaataaggagatgcagttgacaagttagtcatctgtaactcaccttcaggaaacataaaacgtatttctctttccgcagcagcaaagtcattactcccatgaagtgcattccttaggtcatctgtgccataaattgccctcagactaaaaacaagttagagatgacgtccatccaatctaacgtctattccttactttatatgcatgcattccacttaagaattttacaaaagcattgccacttcttacatatgaaagcttcacaatttatgtcaaatttaagcttaaatttaagcttatctatctagataaggatcaaatatatttacgtctgcaggaggaatacactgagaaaataggagttctctggataaaaacgtggtgttgttttgtgagaagtaaaaaagcaatgcacattcaaaagtgcaagaactcaatatcttcttgtttccatacattagcaataatgctgaaaatttgaatttctgttcctgtattaccattattcttttaaaataccattccaatttttccatctaaaaatcctacttcagtggcagtttaaaggttgagagaataagggtaatcaactataaatcagacattctctgttgctttttctggtaggtagtattaaaatagacatttaacactttaaaatgtaaaatggaccccccaggccctgccaccctctgccccccaaaaaagttgattttggaaaacttccaaataaaaaaaaaattcccattacaatgaaatcagatttttttttttcattttcacagatggattccattccctgccatcccccaaaccctgaaaattacctgtctggatgtgtctccttcgctactaagctattatttggtcccaaaagttctaaccaataagagatggctttatgtctagctaatatcatggcgacaagtggtccagaactcatgtaagctgttaagttggggaaaaacatttttccatacttttccacataaaagttactacattgctcagggctgaggcgtagttttcttctctataaaagacacaaagtcaacaaaagcatttaaaatgacagttcaatgatagctcattaaaatcattagtaacttgaaactagtaccaatctgattataacttcaaggtttatctttgtattatgaagaaagaaaaggatataattaaatgtatgctgtaaataagatagtaagaggaattacttagcctacttaagaaaaattatggccgggtgcggtggctcatgcctgtagtcctagcactttggaaggccgaggtcggtggattgcctgagctcaggagttcgagaccagcctaggcaacacagtgaaaccccgtctctactaaaattcaaaaaattagccgggcgggcggcatgcgcctgtagtcccagctactcgggaggctgaggcagaagatttgcttgaacccgggaggcggaggttgcagggagccaagactgcaccactgcactccagcccgggcgacagagaaaaagaaaaattattccagttaggaagcctccctcagcatatgttttgtcagtaacaaatttatcgcatctccttcttaaagtaaataacacttcaattaacaaaactggacttaaaaatattccaaattcatgtttctctatttgtgttactattttgggagctggtctcattttagtacttagaaataacagctaggcacagtggcccatgcctataatcccagcattttgggaggccaaggcggaaggatcgcttcatcccagccaggagttagagaccagcctaagcaacgcaggaagactttgtttctatgaaaaattttaaaatcagtcgggtgtggtggtgtgcgcctgtagtccccactacattagaggtggtgagccatgataacacgactgcactccagcctgggcgataaagcagaccctgtatcaaacaaactaacaaaaaaagtaacatgtagtataatgatgcagtaaaaagtttttcatttgaacgtgtgttctttattctggttctgtcataaatatcttgattcactgtaacattaagaaaaattaggccaggcatggtggctcaggcttgtaatcccaacactctgggaggccaagacaggcagatcacttgaggtcaggggttcgagaacagtctggccaacatagtgaaaccccatctctactaaaaatacaaaaatcaggccaggcgcggtagctcacgcctgtaatcccagcactttgggaggccgaggtgggtggatcacctgaggtcaggagttcgagactagcctggtgaacatggtgaaatctcgtctctaccgaaaatacaaaaaattagccaggtgtggtggcacgcgcctgtagtcccagctactcggaaggctgaggcaggccaacagcttgaacccgggaggcagaggttgcagggagccaagattgcacctctccactccagcctgggtgacagagcgagactccgtctaaaaaaaagaaaaaagaaaaattaggtcgggtgtggtggctcattcctgtaatcccagcactttgagaggacaaggcaggtggatcacctgaggtcaggagtttgagaccagcctagccaacatggtgaaaccccatctttactaaaaatacaaaaattaggccaggcgcagtgactcacgcctgtaatcccagcactttgggaggccgaggtgggtggatcacctgaggtcgggagttcaagaccagcctggccaacatgatgaaaccccgtctctgctaaaaaaaaaaaaaaaaaaaaaaaaaaattagccagccgtggtggcgggcacctataatcccaggtgcttgggaggctgaggcaggagaatcacttgaacccgggaggcagaggttgcagtgagccaagatcgtgtcactgcactccagcctgggcaacaagagtgaaactccgtcaaaaaaaaaaaatacaaaaattagtaaggcgtggtggtgcatgtctgtaatcccagctactcaggaggctgaagcatgagaattgcttgaacccaggaggcagaagttgtggtgagccaagattgagatagcaccattgcactccagcctgggtaacaggatgagactctgtctaaaaaaaaaaaaaattagatgctagtatgtttctcaatctgaaagagtatgaaacactctggacaaatagatgttatttccttcacaaatgagactataaaaattaatcaggtttaaaaaatcatggtagctcagtctaatttgaaactcatgctttctctagaagcagctattttgagtgcttttttttttttttatttttttgaaacggagttttgctctgtcacccaggctagatagagtgcagtggtgtgatcttggctcactgcaacctccacttcctggattcaagtgattctcctgccgcagcctcctgagtagctgggattataggtgcctgccaccatgcctggctaatttttgtatttttagtagagacaggtttttcgctttgttggccaggctgctcttgaactcctgacctcagatgatctgcccaccttggcctcccaaagtgctgggattacaggtgtgagccaccgcgcccggccttgagagcttttaaaaaattatttattactgctggccaggctcggtggctcatgcctctaatcccagcactctgggagaccgaggcaggcggactgcttgagtccaggagttcaacaccagcctgggccacacgcagaaaccccgtctctacaaaaaatacaaaaattggtggtgcacacctgtagtctcagttaatcgggaggctgaggcacgagaattgcttgaacccaggaggcagaggttgcagtgagccgaaatcatgccattgcactccagcctgggcaacagagtgagacttggtctcaaaagaaaaaaaaaattatttattactgctgttttttcaattccactaaaggtgggtgaggagagaaaatgctcaaaatataacagagggattcaaagtagaaatcaaagaacctctgcctgcagtaaggatgatgaaaaatggagatatgtcactaagtgaaggctaaaaatctccatgattatggcagaaatctgtctttctaaaatgtcttagattttcctgagagtaagtgtgaattttaccaagtaactcacctcttaaagccctttccaaaattccgtgtctccgcaggcttcagaaacttggtaaaattgcttggtttgtagcaagggaccaaaccgcccagagcaagaagtttaggaacacgcttacctaggtggcatagctctgctatgaataggacccactggattctcaccagtgaagggccagttactatgaaaaaggtgctgacatttgttctcaaattgaaattcatacagcgattaaataaaagatgtgagaaattacaagagcacctgatttagcataatcctccattctattatctaaaattaagacatgaaactatgattatgcgtattagcgttttttttttttgttttttcttgctgagtttaaaaataaaatctcatctgttgtaatgtaagcccttatctgccacttgccccttaaaaagcaggggaacctaccttctgcaggtatgccagccaatgtagcacaatttttaaaattaagggttcatctttttttttttttttgagacggagtctcatctcactctgtcctccaggcttgagtgcagtggcgcgatctcggctcactgcgagctccgcctactgggttcacgccattctcctgcttcagcctccggagtagctgagactacaggagcctgctaccacgcccggctaattttttttttttgtatttttagtagagacggggtttcaccgtgttagccaggatggtcttgatctcctgacctcatgatctgccgcctcggcctctcaaagtgctgggattacaggcgtgagccaccgcgcccggccttaagggttcatctttaaataaaattgatactaaatcaattattccattggttgctttaaaactggatcaggtgaaattttttgaaattaggttgaatagtctacagccataccaccctgaacacacccgatctcatctgaaattaggttgaatattttcacagagaagcagtgataccaagtactatcagaacagaactcttagtttgtaacaaaggcaacactgccatctactgaaatgacatatcatttttcagcttttcccttaagtgggacaggaaagcctcaagttcattggactcccaagcctattttaaaagcatacagtgcaaaggacaaaacttgcataatttcacttaaattagatagcttgaatagtcaaattcctacagacagcaagtagaatagtggttatcggggatggggaagagggaagcaacgagttagcattaggtagagtgtttcagtttaagatgaaaaggttctagaaatggacagtagtgatggttgtacaacaatgtgaatgtacttaatgcaactgaaatgtacacttaaaaacggttaaaatggtaaattttatgttgtgtatattttaccgcaattaaagcaaaaaatgaaggatgtaccatggctgcctttgctctgaaagttactaactagggaaagtgtcatatatatttacattaaatttttttgtttgtttgttttttctggtctcagtacattgcccagacaatctcagttcactgcaacctccgcctcccgggttcaagtgattctccagccttgcctcctgagtagctgggattacaggcatgcgccaccacgcccagctgatttttgtttgtttgttttttgagatggagtcttgctttgttgcccaggctggagtgcagtggtgaaatctcagctcactgcaacctccgcctcccagattcaagcgattctcctgcctcagcctcctgagtagctgggattacaggctcccaccaccacgcccggctaatttttgtgtttttagtagaaatggggcttcaccatgttggccaggctggtctcgaactcctgacctcaggtaatccacccacctcggcctctgaaagtgctgggattacaggcatgagccaccgcacccagccctaattttggatttttagtagagataaggtttcaccacattggccagggtggtcttgaacttttgacctcaggtgatccacccgcctcatcctcccaaagtgctgtgattacaggattgagccaccacggccggctaatttttaatttataattaacactagccacttaattattaagtttgtcacttttttttttttttgagacggagtctcgctctgtcacccaggctggagtgcagtggcgcgatctcagctcactggaagctccacctcccgggttcacgccattctcctgcctcgtagctgggactacaggtgcccgccactgcgcccggctaattttttgtagttttagtagagacggggtttcgctgtggtctcaatctcctgaccttgtgatctgcccgcctcggcctcccaaagagctgggattacaggcgtgagccaccgcgcccggccgtcactaaatattttttaaaatatggacttttttggccgggcatagtggctcacgcctgtaatcccagcattttgggaggccgaggcaggtggatcacaaggtcaggagatcgagaccatccgggctaacacagtgaaaccccgtctctactaaaaatacaaaaagttagctgggcgtggtggagggtgcctgtagtcccagctactcgggaggctgaggcaggagaatggcgtgaacctgggtggcggagcttgccgtgagccgagattgcgccactgcactccagcctgggcgacacagagcgagactccgtctcaaaaaaaaaaaaaaggacttttttttctttttcaagacagagtctccctctgtcgcccaggctggagtgcaatggcacgatcttgactcactgcaacctccgcctcccgggttcacgccattctcctgccccagcctccccagtagctgagattacaggcacgtgccaccacacccaggtaattttcatatttttagtagagacggggtttcaccatgttggtcaggctggtctccaactcctgacctcaggtgatccacccgccttggcctcccaaagtgctgggtttacaggcatgagccactgcacccgggcaaaatacggacttttaaaaaacttaaatgggacgcctttatctgtatacttcatttattttttctaaagttaatgggtaatataattacaggattcaaaaattcaaagcaagacaaaaaggtatatactgaaaaatcttattcctatccatttcctaatctactcagttcttccttgccctcaataggcaaccctttttaaatgtttatttccccagaattccatttttcaaatattggcaaacatgaatatattactttgtctctatcacaaaaggttggtacacatgattttgtgttttttttgctattttgttctttttgctacacactttgctttcttccgttaacagtacagacaggttcctcattcttctatttacaattagttgcatattatgcaatttgatgggttttccagagtttatttagtcctgtctcccaatctcccaacctgggttattttcaatcttttgttgataagtaaacaatgctgcaaaaaataacctgcatatatatcacttcatattaatacaggcacctactgatgggactaaacagggctctgcgcatgacaggtagtaagagcacaaggaattctataggacagatttccaagagcagaactgctggatcaaatggtaagtccatctgttgtattggtagataactgccagattccctttgataggggttgtgccatttacttttatatttttgccaaatggaatctcagtgtagttttaacttgctttttttcccacctaaagattgagcatcttttcatatatttaaaaaatgtttttccttttctgtgaccatccatctgttctgcccatttttctactaatttatttttatctttttctaggagctctttatgtattaagaagacaagccctttgtctatgagttgcaaatctttttcccaagtttgttgtgttttgactttgcttatggtgtttatttcattgtgcagaaattttttgtttatataatctttttttaaattaaaaaaattttttttttcgagagtttcgctcttgttgcccaggctggagcacaatggcacgatctcggctcacggcaacctccgcctcccatgttcaagcgattctcctgcctcagcctgctgagtagctgggattacaggcatgcgcccccacgcctggctaattttgtattttttagtagagatggggtttctccatgttggtcaggctggtctcaaactcctgacctcaggtgatcaactcaccttggcctcccaaagttttgggattacaggcatgagccaccgtgcctggccttgttgatataatcttatcaatcttttcttccatggctcctagaccttaagtcataacaaaaaaaaaaaaggctgtcctactccaacaacaaaataaatccattatcttttcttcctgaacttacatggtttaatttttttaatatgtagatctcaggtttatttggagtttatcctggtatataatacttgatccaaatttttcagtggctaccagttttcctaacatttactaaaaagttatttacctgagtctttaatcatattaaatacttcctaacactttcttgtgccatccctactctcggactccacctgtcctttgaagctcaactgaaattccgtatcttttctgaagattgatattttctctttatttatttatttattttttgagacagatctccctctattgcccaggctggagtacaatggcgtagtcttggcttactgcaacctctgcctcctgagttcaagcgattctcctgcctcagcttcccaagtagctgggactacaggtgcacgccaccacgcccagctaatttttgtatttttcatagagatggggtttcaccacattggccaggctggtctcaaactcctgaccttatgatccacccatctcggcctcccaaagtgctgggattacaggcgtgagccaccgtacccgccattttctctttatttttaaaaatactgactgaataagcaatatgacactgtataaatgggagaaaataaaaaattggaagttcgaatgagaatactgtaaaagaggcggggtgcagtggctcacacctgtaatcccagcactttgggaggccgaggcgggtggatcacgaggtcaggagttcaagaccaccctggccaacatggtaaaaccccgtctctactaaaaatacaaacattagctggacatggtggtgcatgcctgtaatcccagctactcaggaggctgaggcaggagaattgcttgaaccgggacctggaaggcagaggttgcagtgagccgagatcgtaccactgcactccagtctgggctacagagggagactctgtctcaaaaaaaagaaaaaaaaactataaaagaggaagattaaaaatattcaattctatttgatttatccttaacaatgctatttatattcactttcaaacccctagaatgacaatgtttactaattgcagaacataaggcttaaaacattaaatgttatgccataactgaaaaaagtaccaatagcctaaaattccatcaatagaagatcaagtaaataaattgtagttctaatacacagggaaatattacacagaaattaggaagagtgagatcaattcagatgcaatgatctggaatcctatctgagggactctgtaaaggggtcaagggaaagggactgttctgttttatggggggaaaatgtttataaatgcatagaaaactcctggaagaacagaaagtgttaagtggttgcctctctctggagcctgggacttggggtaaaagaggacaggtgaaggaaaagtccattttatttctcattttacatccttttaaaaactatcacatataacttttatacttagaagaataaacttaaatttaatgctgaacactaagggtttaaatgggtaggcacatttacataagcattttttttttaagggcagagaggaaaaaagcatgaatcatcatacccagaagttacctgaacaatggtgaatccggatctaagaataatatcttgtatctcctcctctttgtcaacaatatctggtttgataatggccagagttttttctacatatatctgaggtggaggcattgatatctccattatggcttttcagggcacaaattaagagtttcttaacaggtatcaactgcaatgacatgcatttccccccacccccatcgcaaattcaatgtaattatgattaagaatagcaatagtaggtacttgattttattaactgatgaaggtagaaactgccatgtttttctatatacagggtctcaataataggattcctactatgtccaaatcgagccccggcttttcgtatacgatgtcaccaaggcaggaaggactatgggctcacataaccagaggccaaggggcgacccgaaggcctggaaccagcaacagccccaggcagcagagggcggtggggcgggtggtgggggctcgagggggcggtagagcgggtggtgggggctcgaggggacggtggctggtgggcaaccacacaccattacagcggcgggtgagcggcctcggccagctgcctctgtgaagcgaccctgtcccgcagggacctctctgtgcatagggtcaggctaattgaaaagcagggcctctaggtccgcggggactttccgggttgcacctgcaaattctgaatttgaccctctctaagtactcacctcagcggccgtcctcatatggtacaacttgttgctaggagacctgaagccccagcgtggggacggtggctgc

SEQ ID NO: 350 - DNA, 95472 bp, Homo sapiens
tggagttagttagaaccagaactttattgtagcggatacactttctgacctatcatgagtatacacatctgcgaagggaaaccgcgcggcgacagcgtgaggacatcccctgggcgtgagcgtctgtccgctgtctaaacagagcagctacagggacgggacatggaggatggccacacatagcacagccaccagtgtcctcagaactagcagtcagggtcacagaacagtattcaaaatgattgcccacctgttttagaaatctaaaattttacatgtaactaagagcaaagtgctatgtgggttttagaccatgactgtttgtttgctctcctgccctaccaccaagcaaagcagcagggctcctgggggagagggatttcaacccccctgatggcagggggtgctctggggaggagagaggagagaacaggctgttttggaaaattccagcactttgacttcgggccatgcgtctctcctggacgttctgagtacggatcgctcaggcctcctgccgtctccaaaaggagtggtcagccggtctgcaggacacctctcagtttctccttttaccagcaggaaaatgtacatttaagcataaaccacaaggctgcacacggtgagaccaggccactgcccagggagctgctgtcggaggaggagtgtggaaaaggggccagggaccccgcaccccacaccaaattaggaacaggtagaatcccaaaggcaaggcccggccacttgtagctaccctgatccagtctcttgagcagcacagctagaggcctgtggcccccgactcccagccatactcagacctgagcaggggctggggcggggctgggcggggtgggcctctccctctggggtctggggagggaggacccggcgggaagagcccgtgctcagagctccgaacttcactttacattccagtcccgggttacactagcacaaaggacacaaggaatccgatttatttacaaaatattaaaaagtcagttaatcatctacacagtaccccccatcctgccattatttatacatgcactagtttggaaaaaataaaaactttttttaaaaaaagaaaaaaatgattaccgggtgggagtgagcatgttttaccctttgtcaacgagcccagctggcatggcttttctggagtgcgaggggccagtgtcctctccccggggggagactccagacacaaacgcggggcctgaggcgctgggaggcccctgtgcgagccggatggcggccagagaggacgtgtcagctcctcgtgggactgaagagcgcgaccaggcagagggtgggcggggagcctagggtcctacacaccaagcacagcgacgatcgtggcggggaggggtctgcacacctactggccgaaatgactttgtacatcgtggacccttgggactgggagaacggatggcagcagagtcttcgaaagcagaaaccgaggtggccgggggcacgggtcagtagctgagggtggagtcatcccactccagctgctgctgccgggttgcgttctgggggtcgccctgctccccctcctcctcctcgctgctctccgactcggcgctggtgatgtcatcctcttcttcgccgtcctcgctttcctcttcctcttcctcttcctcctcctcctcactgctgtgctggtcctcataggtctggcaaggagaagtgacggccacatgagtccggccctgcccacagccccgtcacctggcattctcctctcgacagccacagaggaaggagaacttgccccagcgtctccctccccagcgacagagcagccaggacggcaccggaagttatattagaagtgaagggaaaacaaagctccagtcagcacccacggagtcacccacatacaaagcagcttgggacagcacctcagctgccccaccagagaactctctcaggattaccatgacccaagagcgccaagccctggcatggctcttctctacacttaaggcagaacggccttgaataaggtctctctcagcctcggtttacccacgaagacacctaagccccaggcttgctgagcagatgacgcgatggaaagcatgtgaacctgaaggagccgcgccgtaccggcttctcggaggccctggcctgtgctgcctctcagtcctggaggtcgcccgcccactcctacctccatggggttgacggtgatggtcagggcagagtcgtcccagtccatctcgttctccttcccggtgtcctgatcccgcatggtccgccgatgtgcggcccggatccgaaatacccccaggataatcatgaacaccaggaagctgacgcacaccacgatcacaactgtcgcagtgctggggacgactgtgggagaatgagggggcgggatgcgaggtcactcggcccagaaggccactgtgcccttgacctcctcggctgtgcctggtcaaaacgggctggacagcacgcttcagctgaacccacaggccaggaggaaataccaggaaaagctcgccatgggcctccaacctggctcggccacgtcctgctccatggctgcgggtgacatcatctgccctcttcgagggctttagtttccttgtgtgtgatggggaataattgggacagggaaagaccggcggtcatgctgagcaggaggctgtgcccacggtggggtgggggcagggcggacggcatggagcatctccgcttggtctccctccccatgtcctacctgcgaacgggtgggggttggccaggttgtggcctgacaggtcaacaaaggagcggtgttccgggtgcacgaactgtggctgggcagccatgtggttggcgtgttccatggggttggccgtgtggattacattcacctatagcagagaaagagaggatcgctggagacaggcatcctgagcctgtccaagaggtgacagtggagtcccgcagctggcatgaccagtgccactcagagtggctcctggaccgcagctgggggcaaacggagctacgggaaaaggacagaaaaaaaaatcaagagtaagcacttaaaaaacaaaaacaaagaaaaagaaacaaaaaccaaacaaaaaagagtaataagcacttagaaactgctataacaatctaatattctcacacattccagaaatgtatcacttttctacttattagtatttgttgagactgggtcttgctgtgttgcccgggctggagcgcagtagctattcacaagcatgatcacggctcactgcagcctggaacttccctgctcaagtaatcctcccacctcagcctctcaagtagctgggactacaggcaagcaccacgcacctggctgcaatccatttttattgcattttataaaagattatgcccaaaacaagagcagaaaaagaagccgatggtccttccccatgggtcgtttgggaagcactggcgtagacctttttcctcaaatcacagccgtgtgaaagacagcaccaatcactgccatggatttcctttcatatctcttaccctttgactcaaacaaaacaggcaccgaatttagcattctgctcttgagttcatggtgatattccattgctaagagtaactttgggtcaattttctccaggccacagagagcctgagcgatgaagcagctgctggataggtctgtagacgacctcagagcaggaggagctaccctctagcctgtgtggcctgtgagtcaccagcgccagcctcagcagcactggtcctgcccgtgcgggtccctgcgtgagcccctctcaacctgggccgaggactcgacttcattcacaggagggccagtgacctggcacagatgcagagaacttttggttccctggatgctgctctttctaaaacagtgtctttggctgggcacagtggctcacgcctgtaatcctagcacttttggaggccaaggcaagtggattgcttgaacctggggggacaagaccagcctgggcaacatagtgagacctcgtctctaaaaataaataaataaataaaaccacatcctcctgtttctctcatgggaaatctcaagaagccccagaggcattaactgccacttgctctttgtcacctccctgcaaagttccttaggctccaactcaggctgaggcagccagggaaaggggagcaccccccaccccagctcaccccaaacacaacttgtcactccaacaagcccaggtgtaacctgcagcaggccccaggctggaaaggcgaccccctagaatgagcctgtatagctgccatcatgaatgctctgaggttggcgtttgtgaatattagggctgcaaatcagcgccctcactcactgctgctattggccctgctcagtgggagccttgtactcacctccaccttaaattcgttgctgatgtagcggccattcagctctgagcagatgagcttaaacttccggtcaagcaaggacctggcatgccagttccgatagcgcagcaggtgcaaaacctcctcgtagctggccatggtgtccacgcctgcaggggttgaaagggggaagattgccgggtggcttagggcaggagcatgggcagggctgcagccgtcagcacaggcaggctcaattagacacccaggttagctaggccaaggggtcacacaagttggctttctagccatgggaataaatgcaatgtgcacaggggcattcttccctctgtgggggacgtgtcatcccacgcctcaaccctccccctttagagagtagtggctacacatccggtacctgtccaggagacaggagtatgcgtgcagccaacaatgatcccagcgaacgtgctccttccccatctccctctaagataactcaacattctcagatggcaggcagcagccagccaagagctctcaaagtcccctcttgcagcctggcccacctgcgtggctgcagcgctccccttacctgtgaaggtcatgcccagttcagagctgctcacttcaatgcccttctgctgcaggcgggccatgtccacctccaggctctcctgctcgtggttcagctcctctccctccaccgtgacctcacaggtatccaggtcgtgcacgatctcctcggacaccagtgattcttgaactgcaaaagaggcccaaccagaaatattaagtaggggcagtggggcccagcgtggcggggcacactggatgccctgccggctcaccccaaacctacatggctctcgtaaggaccaacgacagaagcaagcgagagttgctttcaagaaacggctgggcgcagtggctcacgcctgtaatcccagcactttgggaggccaagacgggtggatcacctgaggtcaggagtttgagaccagcctggccaacagggtgaaagcccgtctctactaaaaatacaaaaattaaccgggcgttgtggcaggtccctgtaatcccagctattcgggaggctgaggcaggagaatcgcttgaactcaggaggtggatgctgcagttagccaagatgacaccattgcactccagcctgggcgacagagtgagactccatctcaaaaaaaaaaaaaaagggggggagtttcatgtgtcctgagcaagaattgtggggacattgtgcctccatgggctggccagcctggcaggtgcaagcagtgtctcccgtaagtgccctcaacccctcaacctcaagccacatctcaaagcctggcagcaaccaggaaaagatgtaagacccctccagatgggattccagagatcaccatgagctccagctcacgggtcagattccagaagcacacccgagagaacaccaacgaaagattaaaacctccccaaatcccacagagacaaagagccccgccaagtacatggggacaatggggtttccggccgaggcgagggagcccgcgccccacagagcacattacctgtggggtcctcagccccgtccccttcaggctccacttctctcgtgatggtgctgatgatgcgaagctcagggaaaaggaacaccccttctgagctttcaaattcagaagctgctcgggcaaaatggtggacgccactcaggctgatcttgggctcctcgggctgtaaaaccatcacgtagccatctaccggggggaccgaaatgcaggtggcctcgttaaaacacctgccagcaagaaatggggaagggtcagggctttgggagccgatcttggagcccacctgtgcaaaggcacatggaggtgggatacagaggcccccactaacacctgccggggccactccaggaacacacttgcaaacaagatgcgtaaatatcactcagctctctgccccacactttctggttacacacgatggctcacctttccttacagaaggggttaggctgtcttaaaaacctaaatatacaagtgtcattgggcaaaacaggccggctgttaaaaatcaggacgtacttgattgtgctggtgattttgagtctgcgaattccgggcgtggggaactgccgggagttcaggtacgagatgtgctgcatggccttatccaattccccgaggtcttctccctccaaggtcaataccaactggctggggtgtgcttggatctgaaatcacaccagccacagagaggagaagaataagccagtaaccgcaggagctgaaaccacagatgcctccacaaaggggactggcctgggttcgatttgaattgctgacttgaaaaagaaaagctcgtttaagtccagtgaacacaactcttttacccaacagtaaacgtatcaatcacagattactcactccctcatcccaccagcctccggggctgtagtctaaggggcccatgagtggtgtgcagtcgagcgctcggtgttacctgcacgcctctgccactgtcttcgaggacctgcaggtccagcccctccttgcaggtatacagacagtcgatcaccttcttatccgcgagtttcccggaacggagagttaagccagccagattgcctcggaaaaactgggtcatgtgcaggtcgccacctttgggtcaggggagaaaaggcgaagtcaggcgtgcaacccagcatcgcccaactcacttctcactcaacacggtgttaccggtgctggcagctcagtggatggacatgcgggttagttcataccaagtcctgttagccttgcaatctacatggaagcgcaatgaagaaattaaaccgtttatgatcatgcacatggcctggagaaagggagagttgggggtgtctcacctgaagccaagaggtcccctgagggtccccacacctctggccactacctggtaaggtggcctaccctgttctcatcaccagggtgcatggtgacacttcctacgccaccagcctctccagccactgccttctcagctggctgggttccacatggctgttttctctacctggcacgccctggggaatgaacccacacaagcgaggcagggaggataaaagggaggcttaaaatactccctgcatggaacggcctatttcaaggatgctatggtgttaagtcccatccttcctgcctcctcctgaggattgctgagaagtgcagatgttacaacgaaaaccaaaacccagaaaatggcccttgacagatgacaacaaagagccagaaacaggttacactaaaccttgttcttaaactgaaaaggaaaagggacaaattttcagcaatgtgtctcattctggtacagaaatcaggcactgtaaatcatgactaggaattgaggtttctaagaaacggctatttgccaggcatggtggctcacgcctgtaatcccagcgcttcaggaggccgaggcgggtggatcacctgaggtcagagtttgagaccagcctggcgaacatggcgaaaccccgtctctactaaaaatataaatattagctgggcatggtggtgcatgcctgtagtcccagctacttgggaggctgaagcaggagaattgcttgcacccaggaggtggaggttgcagtgagccaagaccgcgccactgcactccagcccagacaacagagcgggactccatctcaaaacaaaaaaaaaagagagacgtctatttaaaatttactgtcaatcaggacagaatatctagaaacaagtcttttcctgtctcgtggttcatccacatgacagtcacgaggcggcctcccaaaccctgcctgtaagactgaaaaagcagggagcctcatgcagtggggtcagggtcaaactggatggggggggaagtcccatgcatgcactgcctgagatgtcatttgtcctcactccagctggggtcagaatgggcagaataagggaactccatgaagcaatggggaagcgcaatgcagggaagcagctcagatggtgtccaggaccaaaatgcaactggggcgtttcatgcgacacgtggaatgaatcagtctcatctttaaatgaaacacaatagtgaatgtagggaaaaaatccagcaacctgcagaggccacagtcacaggctcagtttcattgtcattttcaactcctgaaaactctgtggaaaagcaagacaaagacaatagaaaaggactgagaggttagggtcttcaaaccggaccttgaaaaccaggtttgaagcaaccaactataaaacatgaagagaaaattccctcgtgatcccgctctgggatgtacccatctggacgcaagcttgtatttaatcaccttttcccagaagtgactttaccacccccaaccccaggcttcttttgttccaccttcccacatcctccttgccaaaacatatgttagattcaaaataagatgaatgaaagcacacacatggaattcgttcccctccccaatccgtgctatgaagtaggacactccacagaggctgagcctgggctgcaatgctgctcccgatataaacaccaccaagttccggaccaacagcacctcttctcctaatagggaagacactgcgcagacaaaaaggcatagcacacacgtgtcccaagcctggtacacagtaagcatgcggaagtctgtatattttggaagctccaaacaagtttacatctgtctagccattaacctttgggcgacagaggaaagaagacattctcaatcactttttctgaatgagagggagatgcagaggctaaggaacccacctagggaagcatagcctacggtggacctggggaccctcaccaccttcagctcctctagctcctggatccagtgtacagagtaatacaacctaccagaaaggcacacacacagcggctaagcacagaaccaacactctccaggtcatgctgaggggaaaggccactcctcaagccctgcagccctgcagccctcccctctatggtgtgctagggccccttttgggctgcggctgtgcggggctgcatcaaggggcaaggctagaggtgtatccaggtgaagcccatgtgagccacgggcctgtgctacctccacacacaccaagactcccccacaacacgctggtagaagggaatgaagctgctgcccacagcccaagctctccacggccaacgtgtagcaaaagtggcagaatcaaccacaaaaaagaaaaggagatcctctctcctgttaactgaattttaaacaatctgtggggtttttttgtttgtttgttttgagatagagtctcactctgttgcccaggctggagtgcagtggtgtgatcttggctcactgcaacctcagcctcctgggttcaagtgattctcctgcctcccaagtaactgggattacaggcgcacgccaccacgcctggctaatttttgtatttttagtagaggcagagtttcaccatgttggccaggctggtctcgaaattctcctgaccttgagtgatctgcctgccaccgcctcccaaagtgctgggattacaggtgtgagccactgcgcacggtcatctttcataaatttctaaccttactcaaggtacaatgtttccatagggagaaaaaactaatcaaaaagtaattaatgatgatgataccttgaaatgacacagcagagtccagtgcaagggtcaaggtgggaatcatgaacctctggggtaacctgagggttccatgaacttggatgggaaaaattacatgcttatttccactaacttctgaaattcagcatttcctttggcaataaatgtaggctacacaccacagcagttagcaatgactgcaactttgtcaccaatagaatgcactgatatttgcacaccaggccacagctgttgcagatgccacagggatcctcgcacagccctcacaacttggaacttacaccactgttggacctgctgctaaagctggttcttcatttgttaacataaagtaccactggtgttactgtttcacaaatgtagtatttcaggatgttaataactatatttcagtttaactgattacccttgaatcctatgtatttattttgtagattaataagaagggatccattggccttgccagaccacccaagggctccatggcacaaaaaagggcttaaaaccccaggtctgagccaggcgcagtggctcatgcctgtaatcccagtactttaggaggctgaggtgggaggatctcttgagcccaggagtttgagatcagcctgggcaacacagtgagaccccatttttataaaaaattaaaataataacaataataaaaaccttgatctggtgggtctgagtgtgggcccagaatacacaggtttttctttttcttttgagacagggtctcactctgttgctcgggctggagtgcaatagggcattttttttttttttttttttgagacggagtttcgctctgtcacctaggctggagtgcagtggtgctatctcggctcactgcaagctccgcctcctgggttcacgccattctcctgcctcagcctcccgagtagctgggaccacaggcacccgccaccatgcctggctaattttttgtatttttagtagagatgggatttcactgtgttagccaggatggtcttgatctcctgacctcatgatccacccacctcagcctcccaaagtgctgggattacaggcgtgagccaccgcgcccggccaatagggcattcttggctcatgcagcctctgcctcctgggttcaaccgattctcctgcctgagcctctcgagtagctgggatcacaggcacatgccaacatgcatggctaatttttgtatatttagtagagatggggtttcaccacgttggccaggctggtctcgaactcctgacctcaagtgatctgcccgcctcagcctcccaaagtgctgggattataggtgtgagacaccgcgcctggcccacaggcttctcaaagtaaaaaaattcaaaaccctggctcctgattcatcagctgggtgacacctggcttgctgcttctgtgggcctgagtttcttcagctataaaaaagggattctaaggtttaggtgagacaacgtgtataaaggagttggcacacagcctgccacttggtaagtacaggtaagaagcactggtgctctggtggttatcatatcccctctcagcagagacttccatggaatcctccccacacgtggcccttgctgagggtgaacagagccctcgcagccctcctaccaggtcaccaagtgataaacactctggaagagtcctccaggtccaaggcgcacttctacttctgcgtcctttatttctgtgcctgactcttgctgttgcctctttgtccttgtgaacctttcaataaacggattaatttataaaacagttccccccactacacgctccctctgtggaacgctccctcttgggtttccgggaaaggtgacggtgtggtcagtcctatcacctttatggagcacctacagacagagctatgctagctagagtggggtaacggcagtgtccccaaaaaggctgtacacaggaaatggaaggaaaagatccaggacacgagggtaaggctgtaggataccgatcacagcctgctgccaccaacctagtaaagaggtacaacttaattctcgagtcgagggcggggggtaatgacaggtaccttgccagcaagcccccaccacgagctgagtttctatcttggatggatggagcgggtaatcctcagtcacagagaagggctcgtgggacgtgccatccacatagagagtcacactcgggaattctacattgaggacgtagtggtgccattcctcatcacagacctacagaggcaaagggaagcggggaggtgtgagatgtccactttccttctcatcaatgcccatggaaaccaagtcacccaacacaagggtcttcctaggaggaaaaggatgaaaaaaatctaaccacaaaatatctgcaaatacatctcaccaaaagaagccaagcatctctagggcatttccaaactacgggggctgcattgctcactaaccagaggacacagcccaagtagggagctgcccaattctgctctgccaacagtgtggcaccaggaagttcctgtatgggcaagctggatacccaccctcgaaagggttgagttagtttaccactggccattccttttctgaataaaaataaaaagtgcctttaggccgggcgcagtggctcaggcctgtaatcccagcactttgggaggccaaggcgaggagatcacttgaggtcaagagtttgagaccagcctggccaacatatcgaaaccccatctctactgaaaatacaaaaattagccgggtgtggtggtgcacgcctgtagtcccagctacttgggaggctgaggcacaagaattgcttgaacccgggaggcaaaggttgcggtgagccgagattgtgccactgcactccagcctgggtgacagagcaagactctatctcctccccaccgccgacaaaaaagtgcctttaatctcagaataaggcacaccatagtacatgtattttcttttccaactcaaagttgatgatctcaataaatatgaacatcagctccaagggcaccccaaaccaaactgtgttcccatcctgtgatgaacgagtgtgtgaacacgcatcagccagctgcaatgggcccttatctgggtcgtaactcaaacaaattgtaaacacaaaaacatttatgaggctacttgaaatctgaacattgactggctatttgatcgtattagaaattttactgttaggtttttttttaatgtgaaagagtgctgtgattatgcttgtctatgagatacatcatgacatacaggcgggcgtctacaagaatgaaatgctctatttgggatttcttgaaaattattaactaacgtttgagggggtgataaaaattttcagcagtgaataggggtaacaatgaaactagactgaccaagagttggcaactgttgaaggcataagggcacacagggctattctttaatctgtctgcttttatataaatctgaaattttccataatacagtttttaaacagtatatacttagaagaaactaaatatataaatgcagactatggctactataacagaactgtagctaaaatgtccacctatgttgcaaaatatttttccaggactaagcctttctttagttttttgaaaataattaatggtaatagtttctgagaaataatcactcacataaataaaaaaatacaccaataagagatgaatgctacccagcctgaccaaaatggtggaaccccatctctactaaaaatacaaaaattagccgggcgtggtggcgcacgcctgtaatcccagctactcagaaggctgaggcaggaggatcgcttgaacccgggaggtggaggttgcagtgagccaagatctccactgcactccagcctgggcaacaaagcgagactcagtctcgggggaaaaaaaaaagagacaaatgctaccaactggacacccacttcaactttccactatcatatactttttcctttctcatttattctcttttacttttatctatcctatgattatttttagacactattatattttagcaactgcaggcacatataacatatgtcagcttttgtccactaactccatgagacaaataaaatgatgataaggccaaaggtttccttctcatcccaactctacatcaaaagaaaaaatgatctattctgattttaatagagggttctaattttacagtgctctctcgtttcctgtagcacgtggggtttttcacaggatatttgctttctatcacagcaactgctagaaaattagctttgcggccgggcacagtggctcaggcctgcaatcccagcactttgggcggctgaggtgggtgcatcagttgaagtcaggagttcaagactagcctggctaatatggtgaaacctcatctctactagaaatacaaaaattagctgggtgtggtggcatgtgtctgtagtcccagctactcataaaattataaatatacactgactatacacagccatccatgtgcaaggttgcagtacctgcttactctctcttagaagatgacagtgtttttctttttctttggagacggggtctcactctgtcatccaggctggagtgaagtggcacaatcgcagctcattacagccttgacctcctgggctccatcaatcatcccacctcagctccccaagtagccaggactacaggcatgtgccaccatgcccagctaattttcgtgggtttttttttttttgtagggacaggatcttagtaatgttgcccaggctggtctcgaacccctgggctcaagcaatcctcgtgccccagcctcccaaagtgctgggattataggtgtgagcaccttgcccggccctattagtgcgttttcaattcactcacctgattcaacttccagtggaactctgcaggtctgtatttcttctcctcagaaggatcctgacggaagaggaagatcagccggcacccgtggacatagagggagtagtggtgccgattcatatctgcaaaggcagtttctatgggtaaattgccaactaaagatccaaaggagaaattaaagctgtttcttgaatggattttgaagacacaatttcatctgcataaatgaactcttcggctaagccaaggcagggcttagaaacaaatacacttgggctttcctgagaggcggagcctgtgatcaccgtggaccccactgagcaacaacagctaatacccaaatgcccaggccgtggctctagggaaccaagtgccccaggcacacagcatggcacatggcctacgagcaccaggctggcaggggaccctgggaaaggagagggagcctgccgctggcacccaccctactggacactggggcctggcatcgcttgcagagctattaccctacctgttttatcagaactgcaaagaattgtctccttcttcctgccgaatggcccatgtctcatccacaccgagatggtgaacggctctttggggctgaccgacacgacgccatccgggatcctcactgcctgggtgccgttgaactcaaacacctggtcgctgtcgtggccattgtcggtgggcaggcccatggtccagttgagggatccactcggggatggcagcagctcggcagtgcccgcggccgcacctgaagccacagtgctcggtgaaactcatgtgaggagccagaggtcccgcgcacctcaagcccccaggcacgtgcttgtcttacacttaggcaatctgctggctccagtttactttttttttttctttcgagacagagtcttgctttgtccccaggctggagtacagtggcgcgatctcggttcattgcaacctccacctcccgggttcaagctgttctcctgcctcagcctcccgagtagctgggattacaggcgcgccccattaaaactggctaatttttgcattttcaggagagccggagtttcaccatgttggccaggctggcctggaactcctgacctcgtgatccgcctgactcggcctccaaaagtgctgggattacaggcgtgagccaccacgcttggccctttcagtttacttctcttcaaaaatcagggttttaaattacaaaaataaaaataacaaccatggatttgtttaaggaagggaaagggccaggcgtgaacccgggaagcggagcttgcagtgagccgagatcgcacccctgcactccagcctgggcaacagagcgagactccgtctcaaaaaaaaaaaaaaaaaacaaaaaggaagggaaaggaagcatttcttgtaatctgattcaaattataccattttagtataaacacccagtcctcctttggtaaatatacacaaaaatgatgcgttttcttagaaaaatggagtcctggcagggcttggtggctcacacctgtaatcccagcactttgggaggccaaggcacacagattgcttgagcccaggagttggagaccagcctggacaacatggcaaaaccctgtcaatacaaaaaacacaaaaattagccaggtgtggtggtgcatccctgtagtcccagctacttgggaggctgagatgggaggatcacttgagcccaggaggttgaggctgcagtgagctgtgactgtgccactatactccagcctgggcgagtgcgaccctgtctcaaaaatatataaacaaatacaataaaagtggagtcctgctatgtatgtgcataatacatatatattcctagcaatattcttctatcatgtaatttaaactatctgaatagttgttttttttttttttttttttttgagacagggtctcctctctcgcccaggctgcagtgcagtggtgcagcgttggtttaccgcagccttgacctcctgagctcaagcaatcctcccacctcagcctcccaagtagctgggaccacaggtgtgtgccaccatgcccggctaatttttgtgtttttgtagagacggggtttcgccatgttgtccaagctagtctccaactactgggctcaagcgatccatctgcctcagactcccaaagtgctgggattataggtgtgagccaccgcgctcggcctgaatagcatttcattgtacagatacagcatcacctactgaccagcctcccaggtgggcacagaggctgtccctaaccttttcctattataaacctcacctgcatgcacagctttatgtgtctccatgattattcccttaaaataaattcctagaaatgaaattactaagtcaaaaaacataaaaaatgttttccaaccattcttatgtattgccatgttcaaattaaaaaaatttttttttgtccacaggaaaagattttgcaagctccttcttgactaagctattactcggagcagcaggccttggctggaccagcctggcctcttgagtaacagaagaccttggtccaaatcttagctcctgaagctagacgtggtggcttgcgcctgtaatcccagaactttgagaggctgaggcaggcagatcaactgaggtcaagagttcaaaccagcctggccaatatggtgaaactctgtctctacaaaaatacaaaaatgagccaggcatgatggcagatgcctgtaatctcagctacttgggaggctgaggtgggagaatcacttaaacacaggaagtggaggctgcagtgagccaagatagcacgattgcattccagcctgggcgacagtgagactctgtctcaaaagaaaaaaaaaaaccacacacacacactagaacctcagctcctgaatatgtgggcttgggcaagctacttaacctgctttagtctcaattgtttaattcctctgtaacaaggtcaatacccacctacttcgtagacttgttgggaacattaagctaaaacacacatagaagtacctggagtaaggccaggcgcagtggctcatgcatataatcccagcactttgggaggccgaggtgggtggatcacttgaggtcaggagttggagacgagcctcgccaacatggtgaaatcccatctctactaaacatacaaaaagtagccaggcatcatggcacatgcctgtaatcccagctacttgggaggccgaggcaggagaatcgcttgaacccaggaggcagacgttgcagtgagtgagattgcgccactgcactccagcctgggcgacagagggagactgtctcaaaaaaaaaaaaaaaaaaaaaaaaaaagtacctggtgcatagtaagcactcaaattatttctattcttcctaactttattctgctgaaaaaaaattcacttaataccatgaaatgagagacggaataaattttatatattatacttacatgcatggtttaaaacagaaaatgtgccagacctccttacttaaatatatttaggtgacaattatgaatatttggattcagagttgccaaacacccccatatgctcatcattggactgtggcagcataatgtctagttttctactttggtttatttaccacatgataattttcttcttatttattgttttttttctaagacaaagtctagctttgtcacctaggctggagagtagtggcacactcttggctcactgcagcctcctgggttcaagcaattctcctgcctcagcctcccaagtagctgggagtataggcacctcgcaccacgcctggctaattttttatttttagtagagcgggggtttcatcatgttgatcaggctggtcttagacccctgacctcaagtgatctggataattttcaattataaaccagtggccgggcgcggtggctcatgcctgcaatcagcactttgggaggccgaggtgggcggatcacgaggtcaggagatcgagaccatcctggctaacacggtgaaaccccgtttctactaaaaatacaaaaaaattagccgggcatggtggcaggtgcctgtagtcccagctactcgggaggctgaggcgggagaatggtgtgaacccaggaggcggagcttgcagtgagccgagatggcgccactgcactccagcctgggtgacagagtgagactctgtctaaaaaaaaaaaaaagaaaaccagtaacctaaatctcatggttgttatcaggctagtgaaaagactcatcagtttaagaaaatgctccctgaaaagctgtttcacaaaagctttttgaaacacaaaagacccttccaatttatgaagacgctgcttcatttagtgggattttatcaccagtcaactaaatgttcttccctcaacatcttccatgacagccatccatacctcacctcttcttcatttagataaaccagaaaaatatccgcagctgacagtaaagagagacctagccttctggtgggtttcccagtaattctgtctctcaatttctccacacaatattgtgatatagaaaatctattgagattctaagttagatgtggctatctttagttctgattttctacttcatgtttgtcaaaagctattgtattacctatatttttccttcagttctttttgagacaggttctcactctgtcatccaggctggaatgcagcggcgtgatcttggctcactgcaacgtccacctcctgggctcaagcgatcctcctccctcagccccccaagtagttgggactacaggcgtgcaccgccatgcccggctagtttttgttttttttgtagagacagggttttctccatgttggtcaggctggtctcgaactcctgacctcaggtgatctgcccacctcggcctcccaaagtggtaagattataggcatgagcccccatgccctggcctttgtcttcaattcgtaagtaaacatctcatttcatgtaaaactcactccatgtactcctatagaagccctttttggatgattctcagagtatgctggagaaatacttccttcaaatcagtggttctttttttaaaacagggtctcactctattgcccagggtggagtgcaatggtgccatcacggctcactgcagcctcaacctcccgggctcaggtgatcctcccgctcagcctcccaagtaactggaactacaggtccatgccaccatccccagttaatttttcaattttttgtagagatggggtatcgctgtgttgcccaggctggtctcaaactcctgggctcaagtgatcttcccacctcggcctcctaaagtgctggaattacaggtataagccaccacatctggccaccagtggttcttaaaatgcacatatacacaacatgttgaatagacgtttaggagttgatgtccaccccctgccccacccccgaagcccatccagtatgaaaactagccagcaaggcagcaaagttcacttcagaaatgcagattctctgtcacagtttataattatgaacacaacacacacaagtatttccagttgtaaaggtccctcccaccttcaccaaagccagccggatgcaagaacgcctggtctccttaccacagagccggtggagggacttctctgagtaggtgtctcggtcgcagcctttccctatgtggctggtttctagctccactgtggcctgtactgaggcgactggctcgtcacatgtctccaggtggatatttggaaagacggccaacgcgccggtgcccggctcatactcaatcctgttgttccatcctgtgttggtccacaagtcagcaggggaagagagaaggaaaacacacactctaggttgctgccgcatacatcagttttaagagcagatgtgagcgcaggggagagaatgaagctcaccttgccacccaggggtgcaggtgggcttaatgctgatcttcaccaaaacatcttctgtggctcttttcttcccacagtcataggcagtgacggtcagcttatattgatgttctttcccgtagtttaatttctctgtgttttttatataaccttacagagggcaaaaacaacagtgagagccaaaacccatgctggttttacttttgttgtcctaggcggaaagacaaaatgcataggctttaagccctgtaaatactcagccagaaataaacatatgcttgggatgcttaaccctcaacctgtcctccctgagccctaacacgcactaaatccatcctgaagagtttcaacagaagagacggagctacacagctcagtctccacttactctcacagtgttacattgggctttacattaagatttaactgtttacatacattcagaggattaaaaaataataataattcaagtacctcaaatattaaatataagatcgctgatcaaacatttactatattaaaagaaagagagatttcctacccccacctgcttagaacagaagcctgctttttgaacgtggtgagtatagatctctggaaagtgtttgcaatgtccataattccatcaaagattctagaccgtgcattgattaacaatggaaacactgtattatctttttttttctttttggaacagggtctcgttctcttgcccaggctggagtgcagtggcctgatctcggctcactgcaacctctgcctcctgggttcaagcgattctcccacttcagcctcccaaatagctgggactacaggtgtgtgcctgcagtcccagctactagcgaggctgtggcgggaggatcccgtgagcccaggagttcgaggttacagtgagcagtgactgcaccactacattccagcctgggcgacagagcaagaccttccctcaaacaaaaaaaaaaaaaaaaaagatgtcacaggagattctaacttaatggagaacatggccaggcgcggtggctcacacatgtaatcccagcactttgggaggccaaggtgggcggatcacctgaggtcaggagttcaagaccagtctggccaacatggtgaaaccctatctctactaaaaatacaaacaacaacaacaaaaaattagctgggcgtggtggtgggcacctgtaatcccagctactcgagaggctaaggtaggagaatcacttgaacccgggaggcagaggttgcagtgagctgagatcgcaccactgtactccagcctggggaacagagtgagaaactgtctcaaaaaaaaaccacaaaaacaaaaacaaaaaacttaatggagaacagaaaatgagacaaactaaatgtaaaggtcagtctcattcagatgcatgtggactgaaagttaagaagattaaaaaaacaaagccatgtcaggtaggaggatttttatttgattttggtgggaaagcaaaaaagaggtgagccccacaagagaacacaggacttacaggttccagagaagaagttgtcagggaacaaagtagaaacttaaatgtttttacaattaaaagcaaacacacaccaggttaggtctccaacttgtgagttccatgaagttctgacgaagcacagaagctggggtgtaaagtcagtggggttagcagggactgtctacctagctgaaaagccggctcctcgattcttaccatctttgtcaacagtaaagggcacgtctggagtgatgatttcgtagctgcaaatctggctgaactgaggggagcagtcggcatccacggcctccaccctcaaaatgctgtcgtactgcttcccctcgatgaccgtggctttgtaggacttctccttgaacacgggcgcgtactcattcacgtcgttcacctgaatatgaacagttgctctggacaaagggagggagaaaaatatttttctgcttgttttcagtgtgagagagagacagagagtgtgtatgtgtgtttacccaattctgccctactttaaaatttcctgtttctgataccttgtttcatgaaattcatatgatgaagtcaaaaattaaacaagctattcactgcttttcattcaagtgtggagataacagaaagttaaaagagggatttgggtcgattcttccatatcctaagaataaagcaaaaaaccaatcatctaaaataaaagagacttgggtgtttttttttgacaatatgggacaagacaggcagaagggagataaacaataccagacgtctgtttgctctccaattataaagttgaaacatattttgtagcaaaatccagaaaaaaaatagagccaagggaagaaggggtatgaaacagagaaagcatgaaatggtttgattctgagagttcaaacgaattctgtcctacttctagggaataggctggagtccatggcatcacctggtcctgattcaacaaatggaagagttcaggagaggcaggccgttgccacctgccaataccccagctcagttatcaagaaaattagggtgtcatcagacctggctacaaataaaaaaaactgtaggtttcaagggctaatggtcagggcatgcttctgaatcagtcaaggactttggtcaaaatctgaccttttcaagggaaacaataacattacactgtggaaaaagagaagagactcactggggcactgcaccttctgctcaccatgagcctcctcatcccagtgccatcggtctgaccctcacaatgggttatgtgacaccatctcgcccacatacccttctttagtagatgtgctaagtagaaactgagactcagggccgggtgtggtggctcacacctatcccagcactttgggaggctgaggcaggagggtcaccagaggtcagagttaaagaccatcctggccaacatggtgaaactccgtctctaccaaaaatacaaaaattagccaggtgtggtggagcgtgcctgtaatcccagctgcttgggaggctgaggcacgagaatcgcttgaaccctggaggtggaggttgcagtgagccgagattgtgccaccgcactccagcctgggtgacagagcgagactctgcctcaaaaaataagtaaataaataaataaataaaacaaaagaaaaagaaacagactcaacaaaattaaatttgcacaatgccaaagggctagcaagtggtggagaaaagactagagctctagaaaagactagagcttacaatctaattgtagaagacactggacttgagaacaccagcagtccccagcctttttggcaccaaggactgatttcatggaaggcaatttctccacagatgggggtgggaggatggttttgggatgaaaatgccccacctcagatcatcaggcagtcgattctcataaggagcgcacaacctagatccctggcatgctcagttcacaacagggttcgcgctcctgtgagaatctgataccgctgctgatgtgacaggaggtggagctcgggcagaaatgctcactcgctcacatgctgttgacctcctgctgtgtggcctggttcctaacaggccacggaccagtactggcccacgtcctgaggtatggcgacccctgttctatgttgtcttgtccaaagccctctctgctacaactgcagttcctaactggcaggaggtgcagcaacacactcaggattgtggcagcgagccagcctacttccaccagcagtgactaatttttttttttttttgagacggagtttcattctttttgcccaggctggagtgcaatgatgtgatcttggctcagtgcaacctccacctcccaggttcaagtgattctcctgcctcagcctcccgagaagcagggactacaggcgcgtgccaccatgcctggttaattttgtatttttagtagagacagggtttctccatgttggccaggctggtcatgaactcctgacctcaggtgaaaatcacctcaggtgatctgcctgcctcggcctcccaaagtgctgggattacaggcgtgagccaccgtgcctggccaatttttgttgttattgttttttagggacagggtctcattctgacactcagactggagtacagtggcacaatcatggctcactgcagcctcaacctctcgggctcaagcaatcctcccgccttagcctcccaagtagctgagaccacaggcatgtgccaccatacctggctgtttatgttttgtagagatggcatctcctacattgtctaggctgctctcaaactcctaggctcaagcaatcttcccacctcagcctcccaaagtgctgggattataggtgtgagccactgcacctggccaacaatgattaagtttatgcccttaggaattacagcaaaagataaatatgacaacaaaataaccttcctaagggagaagcagactttttcaatttttaatgtagggcctttacttctttaatagagtatttggtgtgataaaattattcactcattcatttattaaaaacctaggccgggtgtggtggctcacgcctgtaatcctagcactttgggaggccgaggcaggtgaatgatggggtcaggagtttgataccagcctggccaacatggtgaaacccgtctctactaaaaatacaaaaattagccaggcgtggtggcaggcacctgtaatcccagctactcgggaggctgaggcagaaaaatcacttgaaaccggaaggcggaggttccaatgagccaagatcgtgccactacactccagcttgggtgaaacagcgaaactccatctcaaaaacaaaacacaaaaaggccaggtacggctcacgcctataatcccagcactttaggaggcccaggcaggcggatcacctgaggtcgggagtttgagaccagcctgaccaacatggagaatccccatctctactaaaaatacaaaattagctgagcgtggtggcgcatgcctgtaatcccagctatgtgggaggttgaggcaggagaatcgcttgaacccaggaggcggaggttgcggcgagccaagatcatgccattgcactccagcctgggcaacaagagcaaaactccatctcaaaaaacaaacaaaaacaaccccaaaaaacctaatatgcctaatgtgagcaaggctcttgctagaaactgtatacaagggtagagagacatgattcctgccctccaagtgtttacaatctaattgtagacacttgagaactatcttctgcctatttcaaaaacagtcttggggagcaggcaatagtcactactattttcgttctgcgcacacacgtttactcggtgggttatgttcactctttgtccagcttacttacttatgagactttttcacgttggtgccatcaggtcccttcccacaatcataggcctggatggtgaatgaatagtctttctgcagctcacagtccagtttctctttggagcgaatgactccctcaccagtggatttatccactaccactgcatcaaaggggacattctgcccgtgaattttaaatccacaaatctcacctagggagtcaaagcagaacaggtaagaattcctaccacatagatcttctgcaccttgccctcctccccccatctccacccccaaagaaaataaatgacaacaatttggcagccaggggtttggagggtccgtggacaaagcaggggcactgtgttttaaacatggggaagttctcgggctttagtaagatgaagcagattctggctttccaagcaacttgtttactttgcatccattcatgcaggaatacaaaagagagagagaagaaaatatagacaggcattccacaggagcacttagatagctcgagggtaaaaggagtctcattagcacacagccaggcctgagaacaccagcgctgccccagctcctgggagggctggcagccagtttgatttggaccagagagaagctaaaacgcagttatgtgttgagagaggaggaagcgtgagatataggatcagcaccgtaattacagaaattctgtcaaaaaaaaaaatcaaaggaaacaagtcttcctgtgcaatgagcctggctaaaattagggaatcaaaacaaactactcaatgagaaaggtagaaataccgactcgtcaggcatccatttcaacagctattttatcatctacgattcagacacagtttctattatgggagggactggctagacttgcctttgtttcggactttatcctatcaaacctgaaaaagacaccagcctgggaacttctctacatctaaattggctcacaacttaattaggagttaaaaatctatgtttccattcttgtccatgggagaacagtataaatgttttgatgtcgatgtgaaactccacaaaatgtatttcacatgaaaataagactgcactccttccacaattccaactaatagaaaattgttataaagcaaatctctgaagttctattaaacaaaaatgtacagtgttatccatacagttcaaatggatgtctgatttccagatatttctaaccaagggtctggttacatacaatttccatcaatatactttaaaatagaaacaaagtaggagaataaataaggataaaagagcatgacagtttctcctgtttaagggctgattcccaattttataaacaaagttagtgggttaatattcataagaggggaagaaagaaccctttatcaccttctttggtgactgtcacctcaaaactctctaaagggagaaaagataagcccatgtcagtaatacaggaaagaatgaagatggaatacactaaggaaaaaagtcaaaggtgcacatattacacatttccacaccaagctcagcgaccggcttctacgattgctacagcaaaacctaatcttcaggaacaaaatgtcactttgaatccaacttaccatgaactactgcataattctgaagttattaatttagggatgaaatactcctacatgaagtgtcctaacaccctcaggggtcattaggatttttcttttttttgagacagagtctcgctctgtcacccaggctggaatgcagtggtgctatctcggctcactgcaagctccgcctcctgggttcaccattctcctgcctcagcctcccgagtagctgggactacaggcgcccgccaccacgcccggataattttttgtatttttagtagagacagggtatcaccatgttagccaggatggtctcgatctcctgacctcgtgatccgcccacctcggcctcccaaagtgctgggattacaggagtgagcccccgtgcccggcaggatttttcttttaatgaacactctagtgacaaaccatgaataagtacatctatttgttattttgcagttttcagatgttcatttccaacctaaattctctcagctagattctggtaacattcaactcatcagtagatttaatgaaacaaaaatttggagcaaaaggtttttttttttttttgagatggagtcttgctcagtcgcccagactggagtgcagtggcgtgatctcggctcactgcaagctccgcctccctggttcacgccattctcctacctcagcctcccgagtagctgggactacaggcgcccgccaccacgcccagttaattttttgtatttttagtagagacagggtttcaccatgttagccaggatggtctcgatctcctgacctcatgatccacccgcctcggcctcccaaagtgctgggattacaggcgtgagccaccgcacccagccgaacaaaaggttttaaccctttgttcttgaactgaaaaaaatgacaatatttttctaatccaaagtacccaaccaaggcaacaaatataaacccctctgctaatggaacatctgcttaaatgtgaatagaaaccagattcaaaactaactgtagggatgctacaacagtcactgttctcattacatgaaagctctgttctaccaagtcaatatatatcctgcttataaaccctttactatggaggagtggaaatgtgaagagatcaggaatttcgctgcccctcaacacactgggccctcactggtggcaccttctctcccccaaaggtaacacgacctgaattcccttgctttgctaatagtgctaccatttattctccctgaacagtgttgtttcattttgcttggttttaaggttttaaaaatggtatcacatggcatgcagttttttgtttgtttgttttgggggggggtgggaacggagtttcactcttgttgcccaggatggagtaacaagatctcggctcactgcaacctctgcctcccgggttcaagcgattctcctgcctcagcttcctcagtagctgggattacaggcatgcaccaccatgcctggctaattttgtatttttagtagagatggggtttctctgtgttggtcaggctggtctcgaactcctggcatcaggtgatccgcccgcctcggcctcccaaagtgctgggattacaggcgtgagccactgcgcccagcccacgtgcagtttttatgacttgcttctttttctttttttgagacagagtctcactctgttgcccaggctggagtacagtggtagcatctcagctcactgcaacctccactttctgggttcaagcgattctcatgcctcagcctcccaagcagctgggattacaggcgcctgccaccaagcctcgctaatttttgtatttttagtagaaatgggatttcaccatattggccaggctggtcttgaactcctgatctcaagtgatccgcccgcctccgcctcccaaagtactgggattacaggcgtgagtcaccgcacctggccatgacttgctttttcatgcaactttgtgtatctaagatttattcatccttgctggtataggtagctatagtttattcattttcactactacctaacagtgagaatccacgggtcaaaacatgtaaagtgcttaaaacattgcctggcggaaagagagcacttaacaaatgtttgctattattacaatcattttccactgtgtgaaaatgccatcagttgttcctgctgtttaaaaacaatggtgtcatgattatttcggtccctgcttgctgctgcacgtctacaagagcctctgtacgcctgtgctgcctaacatggcagccactagccatgtggggctgttcaaatgcaaatgaaaattcaagctaaaaatcaaacaatgtgaaaaatccagttcctcagttacactggccagttctcaagggcccagcagccacatgtggctggtggctgctgcaagaagacaatggacgcagagtgctccccttggcacagcaagtcccactggacagagttgctttgaattaggggtctgcaaactgccgtttccagaaagtccaacctgttcctgattttgaagagcccacacactaaaaacaatttttaatagtacttcataacatgagaaaattacatgaatttcaaatacaaatacagtttctttttgtttgtttgttttgagatggagtccttgctctgttgcccaggctggagtgcagtggcacgatcttggctcactgcaagctccacctcccgggttcacgccattctcccacctcagcctcccgagtagctgggattacaggtgcctgccaccacacctggctaatttttttgttattgtatttttagcagagacggggtttcaccgcgttagccaggatggtcttgatctcctgacctcatgatccgcccgcctcggcctcccaaagtgctgagattactggcgtgagccaccgcgcctggcctcaaatacagtttctataaatatatttcactggaacacagacatgctcatttgtttaatgtatggtctctgctttcacactgcaagggcagaggttgttgcagagttacatcattgcgaaagagatccgaggggccccaaagcttaaaatagtccctatctagttcttcaccgaaaaggtttgctgatctctgctctagagagacacccacgagtaaaactgcctggtatcagatgtgtccaaatgttttccaggatgtgctaactcacaatattacatgttttgatgcatattaatactgcataatacattttaaagtaatttaggttgcccagctttaatttggataaaacttctcagtttttgacttgagtttactgtggaatagcgaggcagttccacatcatctgaactgacattaatgacagtgactgtggtgtgctttcctgacacaggtctctccataggtaagtgcagatttcctgcttgttggttggttgttttagagacagggtttccctctgttgcccaggctggaatgcaatgatacaatcctagctctcaaaataatcaatattctgagtattgacattggctactttaatgagttccaccaacaggatatggtgcctcaaatccaccagtacttattcaattgctagtcaggctggctcctttacctacaaggacttaaaaaaccaactcgccaggttggtagttcaaggtggcaggtgcagtgtgggctttgcaaaactcaggcagacctgggtcttccacaccagccttgcaaccgagcccatcactgcagagcctgctgagccatctgcagggtcagccagtacgcctacctcaaggggccatttgtgcattcaacctaaaactctacttttaataaggaagacggatcggactggagcaagacaggggctaccacagtacctctgatgagatacaatgagggctgaactaggcactgtcccaaggagacatttaagggatttttaggggaatagatgggacctccacctcctgagttcaagcgattctcccacctcagcctcccgagtagctcagaccacaggtgcatgccacccattcccgggtttttttttttttttttttttttggctacaggtgaggtttcaccatgttgcccaggctggtcttggactcctgagctcaagtgatccacctgcctcagcctccctcagagctgggattacaggcatgagccaccacgcccgccccagttcatggtagtcaaatgcatgctacggcaccatcacatacgaaggtgcagctccaccactcgctatcctaaactcagcctctctcaaactcaaacaacctcatccgttgcagggaaggacctctcagaattgcctctcacatcccagttcctttctgccctgctccctcccactcaattcagctggctctgttacgcaaatctacctaaaaccctgcttttatcaagctgaagacacccaaccaggtttcccagacaacctctccagttaggctctcctaggaatgggccaaatccttcccagtctctttccccaaaccttcattcccctaggagatcatctaaaatggtcaaaaggaactttacttaagaaatttgaggagcaggcctggtaggtcacacctgtaatcccagcactttgggaggctgaggtgggtggatcacctgaggtcaggagttcgagaccagcctggccaacacggtgaaatcctgtctctaccaaaaatacaaaaattagctgggagtggtggcgtgtgcctgaggtcccggctacttgggagcctaaggtgggagaatcacctgagtctcggatgttaagcctgtagtgagccattatcatgccactgcactccagcctctgtactctgggcgacggagtgagaccatgtctaaaaatttttttaaaaatttttttaaggaatttttaaagcaaaacataaaaatatgaaaaatggatgaacccaacaaagtatggatttgacttctggatatccaaagtcacgtgcagggttctcagctgacagcactttgccctcactttcctcatctgtgcctttgacaaaccccagctttaggctggccctgctgttctttcgaagtcttcttcctaatctgaggatggcccctcctacacacgtctcccagctctcaggggaccctgcccttatattgcaaatgtttcctttgctccttacgtataacagctaaggttctctgattgtaagcaacagaaatcctttctaggtaacttagcaaaaggaaactgattggaaaactatcaggaactcatggaactgactgtaggccagagaaagggacttggaaacaggtggaagccaaggcggctggagaccaggaaacaggaaccgcaacagtcccactgcagaacagcctggacagacagacccgaaccgcaactattcttagcatcgctgtcgctccactcaccattcaaacttcagggaggggcacctgttcacttggctaggggaagctgggtaacaggttgtagatccactgatctgtgcccaatgggaaacggatcacggggctgtaaagaagagaaaatgggccgggtgtggtggcccacacctgtaatcccagcattttgggaggccaaggtgggtggatcacctgaggtcaggagttcgagaccagcctggtcaacatggtgaaacccgtctctactaaaaatacaaaaattagccggacatggtggcaggcacctgtaattccagctactcaggaggctgaggcatgagaatcgcttgaacccgggaggcagaagttgcagtgagccgagatcacgccactgcactccagcctaggcgacagagcgagactctgtctcaaaaaaaaaaaaaaagagaaaatggacacttgccaagcagcgactatccacttctccccgctgcactcggccttggtgcccacactcaacggctccgctccactcggccttggtgcccgcactcaacggctctgctccactcggccttggtgcccgcactcaacggctgggtgtccgggctgtccctgacgttgggtgacctctggctttcttgccaagcagcgactatccacttctccccgctgcactcggccttggtgcccgcactcaacggctgggtgtccgggctgtccctgacgttgggtgacctctggctttcttgccaagcagcgactatccacttctctctgctccactcggccttggtgcccgcactcaacggctgggtgtccgggctgtccctgacgttgggtgacctctggctttcttgcttactggtccaggctagtttctggaatgagctcatacgtgtctctaatcagcagttttttcggggtacctttttttttcttttttttggagacagagtctcgctctgtcacccaggctggagtgcagtggcacaacctcagctcacagcatcctccacctcctgcgttcaagtgattcctgtgcctcagcctcccgagtagctgggactacaggtgcacaccaccacgcctggctaatttttgtatttttagtagagacagggtttcaccatgttggccaggctggtctcaaactcctgacctcaagtgatctccttgcctcggcctcccaaagtgctgggattacaggtgtgaaccactgcacccggcctaggataccttaaatatatgtaacaataaccacagactccaagagttacgctctcgcaagttcctcactgactacagcagtggctctcaaattctagtgtgccaaaaatggtctgtgacgcttgttaaaaatgtggtttccaagctccatccccagaaattctgacttggtggttctaggggcagagcccagtgatctgcattttgagcaagcactgccagatgactccaacacagacagtctgcagacctgggaaggtggcccattgggggtttgcaaacctagctggctggtatggatttctcaggtgccactcctggaggtacagactaggcagctgagcatggagctcaggaacctgcactctacaccagggccccaggtgatccagacatagcattggaaaaccccatgcatccattcagcctagcaatggaaaccatgtggactcaagttgacttcaatcctgtgctcctctataccccacgccacacaagctgacctggtcacctaccctgggaggcccttccagttcccacctctgctcccacctctcccctctcttcactgcctatgcaaactccacccaccctttacaggactcaagccctgtaaaccactgtagaaccacttctgggctatctcagcccattcagtgttgctacaaaggaagacctgaggctgtgtaagttataaagaaaaaaggtttctttggttcacacttctgatggctggaaagttcaaggttgggcatctgcatctgatgagggcctcaggctacttccactcactgcggaaggccaaggggaatcgtgtgtagaaatcacatggtgagggagaaagaaagagagagagagagagagagagagggagagagagaggtgggtgggggaggaggaggagcaaccacaggctctttttagcaatgagctcttgtgggaactaaaagagtgagaattcacccactaccccccaccccaccacctcacccccatagccagggacaacattaatctattcatgaaggattcaccccctgtgacccaaacacctcccattaggccccacctccaacaatgggatcaagtttcagttaggggcaccatggctcatgcctgtaatcccaacactttgggaggccaaggcaggtggatcacttgaggtctggggttcaaggccagcctgggtaacatggtgaaaccctgtctctactaaaaatacaaaaattagccaggtatgatggcacaggcctgtaatcccagctactcggaaggctgaggtgggagaatcgcttgaatatctgaggcagaggttgcagtgagctgagatcccgctgctgcattccagcctgggtgatgaagtgaggctccatctttaaaaaaaaaaaaaaaaaaaaaaaaaaagtttccacatgaggtttggaggggacaaacatccaaactgcagcacttgcctccttagcccacaccatcgttgcctctgtcacttggggctgaactacaagtttcctagtatcctttgccaatcttggtttggccctcttacccacattatcagtggctttgaaaacaggaaccaacttttacacttttttttatcatctctggaaaacctagcatagctacctagtatttaatcattactgatcccaaactcttcctgggtggtgtctacatccaaaatgggtccattcaagtcaatcacggttaataagaagcacctgtcctaacattcagctacttacttaaaattgttactcaatgcattattgccttcgattaagctgaagcatgtgaaatgtcatttttttttcaaataccttaatatttcaacatttaaaaaaattgggccaggcgcagtggctcaggcctgtaatcccagcactttgggaggcaggcagatcaactgaggtcaggagttcaagaccagcctgaccaacatggagaaaccccatctctactaaaaatacaaaattagccgggcgtggtggcgggcgcctgcaatcccagctactcgggagactgatacaggagaatcgcttgaacccaggaggcggaggttgcggtgagctgagatcgcgtcattgcactatagcctgggcgacaagagcgagactccatctcagaaaaaagaaaaaattggcctggtgcggtggctcaatcctgtaatcctagcactttaggaggctgaggcagggggatcttgaggtcaagagtttgagaccagcctggccaatatggtgaaaccctgtctctactaaaaatacaaaaattagccgaaatcacttgaacccgggaaacggagactccatctcaaaaaaagaaaaaaaaaaatggaggccaggcgccgttgctccacctgtaatcccagcactctgggagactgaggcaggtggatcacctgaggtcagcagtttgcggccagcctggccaacaaagcggaaccctccctctactaaaaatacaaaaattagccgggcgtggtggcggcgggcgcctgtaatcccagctactcaggaggctgaggcaggagaatcgcttgaacccgggaggttgcagtgagccaagatcgcgccactgcactccagcctgggcgacacagcgagactctgtctcaaaaaaaaaaggcaatttcatgcaggtcaaccaattcactgctgcaagcacaaggtcagctcagttacatgtgctaaaaaagcaaaactgggcagtgaaatgcagcagttaaccccactggccaccctcagggcatgtgaatcacattcataacaaagaatacagacaagagtatcacagggctcctcggtgggctctaactgactatcaatgaaaactaagttcccattcttgccctgaaacttcttttggattctatttgtatcattatggttcaaccaatcttgtaaaacatccatacttaatctggaaaagcaggaaagagattgctagaacaccaccacctcctagaaggaggagctctgaagaggaaacaagaagaggaggcacggcttctgacaagaacagaatgcatcatcttcaaggccccaaccctgtggcccacacatgaggctcaagctggtaactctccacgaaatatataaaatgtaaacaaaataggccgggcgcggtggctcacgcctgtaatcccagcactttaggaggccaaggcggaggatcacttgaggccaggagttcgagaccagcctggccaacatggtgaaaccccgtctctattataaatacaaaacattagctggctcgtggtggtgcacgcctgtgatcccagctactcgagaggctgaggcatgagaattgcttgaacccggaaggcagaggttgcagtgagccgagatcgcgccactgcactccagcctgggtgacagagcgagaccctgtctcaaaaataaatagataaataataaaatacaaaaattgttttctgacccatgactactcaggctttcagcagattaaagagaaggcgcagaacaagaaactgaatcatttaaatttcctaaaacacttgacaaataccaagactctgtatcagaatttcaccccaaggaaacaatccgggcgagactggatcttcattgtgaatgtctgattagtgatgacttacaaggagcttcaatgactaagctcccagcattgcatgtgcattcatttcagagctctaacaagtgaactcctgtggctacccacacacacatgccttgtagtgggatcacactatgaactggaatgttcacacagtgagctgggcccagaggcggctctgtcacttatgagctgtgtgatcctgggtaaactcatctcctccctctacaaatatctatggagtgactgtgttccaggcactgacggaggttttggggataaaatggaaaacaaagtagcttctcctgctgtcacgcagctggcagacacgctgagcctggttcctcacctggagaacagggacagtgggcatgtctactgcgtaagattggagaagagaggctgggcgcagtggctcacgcctgtaatcccagcattttgggaggccgaggcgggcagactgcctgagctcaggagttcgtaaccagcctggggaacacggtaaaaccccgtctctaataaaaattacaaaaaattagccaggcatggtggcatgcacttgtagtcccagctactcgggaggctgaggcaggagaattgcttgaacccaggaggcggaggttgcagtgagccgagatagcaccactgcactccagcctgggcaacagagcaagactccatctcaaaaaaaaaaaaaaaacctgctgaaaagaatcggagaaagtaacccacaccgggccctcagagcaacctctgccacactgcaggcactcaataaacgttagatgccaccaccatcaccaccctcctcctcaacatggtgcgaaattaaactcaatgtcatcacccaaatcaatctaagatgaaaataaggctccaggtctagcctctgtcttatccaaaaaatacttaagaaagtctgtaagaaaatgcaacactataacgacttttgtagaaagatgaaaaaatatttctcacaaaatgttaagtgaaaaaatatttttaaaagattctattagtagtaataacagcagcggcaaatactgtaggtggtaattactgtaccacccactgtttaaagctcttcacacgtatgaataaagaagctaacattcccccaaaccaatgaggtctgtgacattaatgaggtctgtgacatcttatccttttacaaatgatgaaatggaggcacagaaagggtaagtaatttgcctaaggccacacagccaataagtagcagagctacgattcactcactggtccctcggctctagggtctctgttcctgacctcccttgctcagtctcatagggtcctgttctgtgctgggtggcaccatgggggcggggttgtcctggacggcaccatgggggcggggttctgtgttcggtagcaccatagggatggggttctatgttgggcaagatcatgggggcggggttctgtgctgggcggcaccatgggggcggagttctatgttgggcggcaccatgggggcgggattctgtgttgggcggcaccatgggggcgggattctgtgttgggcggcaccggggggcggggttctgtgctgggcggcaccaggggggcggggttctgtgttgagcggcacaatgggggtggggttctgtgctgggtggcaccatggggttggcgatctgtgttgggtggcaccatgggggcggggttctgtgctgggtggcaccatgggggcggggttctgtgctgggtggcaccatgggggcggggttctgtgttgggtgacaccatgggggcagggttctgtgttgggtggtatcatgggggcggggttctgttaggtggcaccatgggggtggggttctgtgctgggtggcaccatgggggtggggttgtgttgggtggcatcatgggggcggggttctgtgttgggtgacaccatgggggcggggttctgtgttaggtggcactatgggggcggggttctgtgttgggtggcaccacgggggtggggttctgtgttgggtggcaccaaagcaacagaagagggagggagggaggaagcaacacagggagaaagtaaaggagaaagggaaagagggagggagggagggaggaaaagggggaaggagggaagaagggatggaaggagtgagggaggggggaacagaaggagggaatgagggagagagggagaaaggggaaaagggagggagggagagggagggagagaggaaggaaaggacagagggaggaagcgaaggagggaaggagagagagaggaaggaaatgagagggagagagggagggaggaagggagggaaggaaggagggagggaggtaaggagggatacggctgcaggtcaggtgctccctcccccccatgcagctgcccactcctccagcagaggaccccacgcttcagtcaaggggatcagttgcactcctgtgtgtatactaaaggactgaaaacctatgtccacacaaagacctgtacaggaatgttcacagcagcatgacccataatagccaaaaagtagaagcaactcaaatgtccatcagtggatgaacagagaaacaaaatgtgatctactcatagaatgaaataatatccagcaacaaaaaaaggaatgaggggctgctaggcacctaacacaggtaaactgtgaaatcaccatgctgggagacgcccatcacaaaaagccgtacagtgcatttacatgattatccagaatagagaaatctgtagtggtagccagggcttgggagtgaaggagactgagggatgagtgccacttggtgcaagggttcctttttggggtgatgaaaatgttctggagttagacagtggttggcaggtgcatggtttttggaacattctaaaactcaatgagctgtacactttaaaagggtgattttttggcagggcgcggtggctcacgcctataatcccagcattttgggaagccgaggcaggcagatcacgaggtcaggagattgagaccacggtgaaaccccatctctactaaaaatacaaaaaattagccgggcgcggtggcggactcctgtagtcccagctaatcgggaggctgaggcaggagaatggcgtgaacccgggaggcagagcttgcagtgagccgagatcgcgccactgcaccccagcctgggcgacagagtgagactccgtctcaaaaaaaaaaaaaaagggtgatttttgtggcatatgaattatctccaaaaaagaaaaaagaaagaaaaaatattatatgagtaactgtgcttcccccatgaaaatatccaaaaggaaaatattgacttatctatccactatggcaaatacaaccaagttaccactataattggatttaaattgcttttctatacagttaaaatacatatcacaacatataatttttgtacatcagtaaaaaaaacctgagaatctctaaaaaataaacttgtataagtattatttcatctagaatatcttaagtttgagaaatacacaataaaattaaatacagtaagaaaaaaatatttcattgataagactttttctttcaaagttaacactcggcgtacatttcatttcctacttccttgtgaacttcgtgcagttaaagatgtagctacgtcatcgtagcaggcagctgtcccgcctgggctggagccctgcctctgcaccccccgaccagctacacgcccagagcaatagcttaactattctgtgcctccgcttcctgcctttaatgcagaaaagcgtatttattatcttatggttattggggattaaatacaaatttatatttgtacagtacttagagtagtgcctgggacattgctatgcatgctttataagtgcatgcattattggctgggtgtggtggctcacgcctataatcccagcacttcgggaggccaaggcaggcgcatcacctgaggtcaggagttcaagaccagcctggccaacacggtgaaaccctgtttctaataaaaatacaaaaattagcagggcatggtggcgggcacctgtaatcccagctaatgggaggctgaggcaggaaaattgcttgaatctgggaggcggaggttgcagtgagccgaaattgcaccactggactccagcctgggcgacaaactgagacaccgtctcaaaaataaaacaaaacaaaataaaataaaatagtgcatcaattattaacaacatagtaagatcacactgcacgaacaacaggactgctgatacttcaaaaggcaaaggaggacctgagggagcaaatacacaagcctggactgcaatcacttcttgaaatgcgtaaaacatcagtaatgtatataaaactgctcaaaaacataaactaaataattctgttaaaatgatctatccactagcactttgcaaggccaaggcaggtggatcacctgaggccaggagttcgagaccagcctgaacaacatggtgaaacctcgtctctactaaaaatacaaaaattaggacgggcatggtggcttaagcctgtaatcccagcactttgggaggccaaggcgggtggatcacaaggtcaggagttcaagaccagcctggccaatatggtgaaaccccatctctactaaaaatacaaaaattagctgggcgtggtggcaggcacctgtaatcccagctactcaggaggctgaggcaggagaactgcttgaacccgggaggcagaggttgcagtgagctgagattgcaccactgcactccagcctgggtgacagagcaagactgtttcaggagaaaaaaaaaatgtgggggaaaaagcaaaaataatcaccctggcaactggacaaatgctgtgtgtgtgttcacggcatggggtactgcctctactgtccttttcatcagaattctctctgaaaattaataaacacacaaaacaacttgggaggctctatctttacagcacaagctggttcacgggtgactgtgctgaaaatgtgatgtggcgcctaaacagaatgaagtacaaatttatttttcaaatagttcttcagaaacaaactcatgtttatttccttcaacttactatagtaaaattaacatatgtttcatacaaattcatccaatttttcttatttgtccctagacaaatagaacacttttttttttttttctgagacagagtctcactctgtcgcccaggctggagtgcagtggcgcgatctcggctcactgcaagctccgcctcctgggttcacgccattctcctgcctctgcctccggagtacctaggactacaggcgcccaccaccacacccggcttttttttttttttttttttttttttagtagagacggggtttcaccgtgttagccaggatggtctcgatctcctgaccttgtgacccgcccgcctcggcctcccagagtgctggcacaggcatgagccactgtgcccggccagaacactctttaatacgagaagtttttgtttgttttgttttttgagatggggtcttgctctgttgcccaggctggagtgcagtggtgcaatcaaggctcactgcagcctccacctcctggactcaagcaatcctcctgcctcagcctcccacagtgctgagattacaggcatgtcactgtgcccagccgtgcaggagaagatctgatctggaaaaatatgcgaaaacaactcttaaaaattaactttacaatgtcaactccaactctgaggcagaaaaaaggtggcgcagcccattctctaccagttaaggacccaacgtgaagccagaacagctctgacttggaaaatgctattaagtgttagcaatgtacacggttattacagtatgaaaatctccaaagcaatgctacaggtttgtctctataaagactgaggctacaatctcatgtctttaaaattcactgaaggtaaaatctatgccaaaagcattcctctataaagaccgctcaacttcttcaagtaagtcttctcaggtcattgaaatctaggtaatgcaaggaacccctggcgctgtgattctccggctccatgccacttgaggaccagcaacaccagcagtacctaggagcaggtgagaaaggcagaatctcaggtcctcccagacccgctgtctctacattcctcaggtactccgtgtgcaccctagagccagggatgcactggtctaggagttatctggctacattaagataaagaaaaaaattatgcaattaaattaaacagtttgtttttcaactataagaacaggcctttttgtcagctaccccaactattaaaaggaaaaaaaaacatgctacaaaggacgctacaaataaccctcagctatggagacattttcagaaacgctcagcattacccaaatgggatgtgcagaatgcttcctgaccaggcccgattcatcaagagtcaatgaaagccccgttcctacctgcaaatcgcagaggcgcatctttatccagcgcgatcagtggggggtcgaggagcacggtgttgtcgttctctgtgactatgccgtggtaggtgggctccagccagggcttgtgcttgttaactgtgtttaaaacaagagaaaaaaatagacaaggttagaaatattattttcaactccactacttttgaagacacacacctgctattaaaataataaaactctcattaggcttgaagacagtgctcacagttctgtcgcaaaatttggtatcaagacccaaatgagatgaaattctaaattccagaataagtaatgttgaaattatctgaatccatgaagcaaccagaaataagaaataaattgctctagaaatcaagggaaaaaaaaagactgatggctacgggaagactatctctgttttcagcctatcactgaaaagttacaaagaaaggtattttcacttctttatgattttttgagacagagtcttgctctgtcacccaggctggagcacaatggtgtaatcatgactcactgcagcctcaacctcccaggttcaggtgatcctcccactcagcctcccaggtagctgggactatgtgtgtgcaccaccatacttgacttattttttttttttttttactctttgtacagacagggtttcaccatgttgcccaggctggtcttgaacccccgggctcaagtgatccgcctgccttggcctcccaaagtgttgggattacaggcgtgagccacggcacctggccccagtattattattattttttcttttttctctgttgccaaggctggaatgtagtggtaggatctcagctcactcactcattaaaccaccgcacccagctgcccaatattaattttaaatttgtattacaaataataatgtaaagcaaagatgcaaaacacaataaagtattaaaataaaactctgcagaatttcagaaaaacccaccacttgactgaaaacaagagtgtttaagaataatccatccgggcgtggtggctcacgcctataatcccagcactttgggaggctgacgagggcggatcacctgaggtcaggagtttgtgaccagcctggccaatatgttgaaaccctgtctttactaaaaatacaaaaatgagccaggtgtggtggcacacacctgtaatcccagctactcgggaggctgaggcagaagaatcgcctgaacctgggaggtggaggttgcagtgagccaagatcacgccaccgcactccagactgggcgacagagtgagactccgcctcaaaaaaaaaaaaataatccacttttgagttaggcttggggtccaattccagcctccctctattatgagctgtgtgaccttaattaagtacattaacttactgccggaaaagggtcccaatccagcccccgagacagtgttactgaacttcatgcagtaagaattcggggcaagtccacagagtcaagtgaaagcaactttattaagaaagtgaaggaagaaagaatggctactccacaggcagagcagccctgagggctgctggtcggctatttttatggttatttcttgattacacgctaaacgaagggtggattattcatgagttttcccggaaagatatgggaaattcccggaaactgaggactcctccccattttagagcacatacagtaacttcctcacgttgccatggcatttgtaaactgtcatggtgctggtgggtctcttagcatgctaatgtattttaattagtgtataatgagcagtgaggacgaccagaagtcacttttgtccccatcttggttttggtgggtttcggcgggcttctttatggcaacctgttttataagcaaggtctttgtgacctgtgtcttgtactgacctcctacctcatcctgtgacttagaatgccttaacctcctaggaatgcagcccaatagatctcaaccttatttcacccagaccctattcaagatggagtcgctctggttcaaatgcctctgacaaactgatctcaagttcctcgttcgtaaaccagggacacccccaccctcctctcggtgatggcccggatcactggagaagtgctatcttgtcccttcttgattgggactctaccagaactgctacttttgcttttctggccgctgctgacctcacttccctgagaagatgatcatttagcccctgtctgctttgctttgcctggggctcggctcctaagtgtcgatgtcagacgtcctcctggtagccatgaatccctccctgagccagcagtatctccacacgcacactgggggccctgttccacagctcaaatatttccattttccttttatgttcaccttaagagggttaacagcttccattataacctcagactatgaatgaaccaggggactcctcgattaagctgatctgaaaagatggaaagaaatggcttgaaaacgttgtttccaagtagacggggcctacttattgaatgaaccactcaggttctgttaagtgtgagtcaatccagaaggatcttcgtgcaacattccaggatgtgatgctacctctgctgtacctgcactttccccagagtggcacccagggaggggggtcacgctcacgtgtaaggctcagagtaggcgtgtgaaggcttgcatctggaaggaagacagaccagaacaaagctgcctcctctcttttttttttttttgagatggagccttgctctgtcgcccaggctggagtgcaatggcgcgatctcagctcactgcaaccttcgcctctcaggttcaagcaattctcctgcctcagcctcccgagtagctgggactacaggcgctcaccaccacgctcagtttctgtatttttagtagagacgggatttcaccatgctggccaggctggtctaccaactcctgacctcgtgttccgcccacctcgcctcccaaagtgctgggattacaggcgtgagccactgcgccaagccgctgcctcctctctaattaatgaaacatttaccagacatttgtacacactacatccaagccaagagcaaatccttctggcttcacttcctaaataaacccagaccccggggagttgttgtttaatgggtataaaatttcggttttgtgagatgaaaggaatttggaggttggttgcacaatagtgtgaatgtacttgatgctactgaactgaacgcttcaaaatggtagacaggaaaattttgctgtagtttacatttaaaaaaaaaaatccacatacacacaaactcagacacagccatttcttacctccttcctgaaaggtcacaaaagccaagtaacaagcctccctgtccttatcccggcacttactcggcagccagagggaagcttctacaacaatgggtcttcaactttggggtctcagaacccctgtacaccaaaaagttactgagggacccaaatagcttttgtttaaatggattggtcagtcagttgattatccatccatccacccacctatctctatctatctatctatctatctatcagcatttatctatcatctatcagcatttatctatcatctatcagcatttatctatctatctatctatctatctatctatctatctatctatcagcatttactacactgaaaattaaaaccagtccaggagcagtgtctcatgcctgtaatcccagcgtgttgggaggctggccacacagatcacttgaggtcaggagtttgagaccagcctggccaacatggtgaaaccctcctgtctttactaaaaatacaaaaattagccgggtgtggtgacacgcacctgtagacccagcttctcgggcggctgaggcaggagaattgcttgaacctgggaggtgcaggttgcagtgagccaagattgtaccactgcactccagcctgggcgacagagcgagactgtctcaaaaaaaaaaaaaaaaaaaagcctgggagtggtggctcaagcctgtgatcctggcactttgggaggccaaggcaggcggatcacttgaagtcaggagttcaaggccagcctgaccaatatggtaaaatcctcctgtctttactataaatacaaaaattagctgggcgtggtggcacacacctgtagtcccagctactcaggaggctgaggcaggagaatcacttgaaaccgggaggtaaaggttgcagtgagccaagatctcgccactgcactccagcctggacaacagagcgagactatgtctcaaaaaacaacgacgacaacaaaaaagataattttaatacttattaactcatttaaaaaacaaacacattatataatacattcacataaacaatatttttatgaaaataactttttgaaaacaaagcttactaagaagagtggcaacagttttgtttttgcaaatctttgttgtccaccttcacagaagacacctgagttctcgtctctacccccgctccccctgcactcagcctgctgccttgctccccttaacatagtctctagaaaatgccacagtgcagcctaagaggatgagaaaacggcaaataatgtcttaatattgttacagttctgccctctcgcatcctgccagggtttcagggactcagtatctcactcgggctctgttgaaaaggtccttcctgctgctctcaccaacctcgctctgtccctctgttccaacacctggggagaagacggcaggggagggcactggagcccagtgcccaaaggcctgggtgggacctgcctgggctccaaagggcccgcgacctcagggccttcgcttcctcatctagaaaatggggacaataatagtccccatctcataggtcgttgtgtgattaaacatgcaatcacagttcattacatataaaatgttcagaagagtgtctggcactcagtaagtatcaaaaggtggtggtgttatttctcctccccaacacacacacacacacacacacacacacacacacacacacacacacgcagactgtgagaaagtggccttttcattctctaattcccagtacctggaattatgcttagcacacatgcaggaactatttgggaaatgagtatataagaaacctcaaatgcgcaaatcagatcagttgccctgatttatgaattctctcatggagaagatagctttggagctgggaattcaaaagatactgcgaaggtgtttttttttatttttgtttgtttctccaggtggatgttctgagcaagagagctagaaaatctagagacaacgcacgaaaccaacaggtcaaaagacatcagtctggaaaaggttaagttatggaaggttagattacagagggacttaatatgaaatcaaacccagaccataaagaccaaaaataaaagtgtctttgaaatccgtcttctccccccgtccataggctgctctgaaacaagagactggctaagaagagaataaggggccggatgcggtggctcacgcctgtaatcttagcactttgggaggccaaggcgggtggatcacctgaggtcaggagttcgagaccagcctggccaacatggtaaaaccccgtctgtactaaaaaaaaaaaattacaaaaattagccgggcgtggtggcaggcaactgtaataccagctactcaggaggctgaggcaggagaatcgcttgaacccaggaggcagaggttgcagtgtgccaagaccgtgccattgcactccagcctgggagagaagcgagagacttcgtctcaaaaaaaaaaaaaaagaagaagaagaagaagaaggctggctatggtacggcacctttctcctgcgagcctccctggagcagcagggggtctgccggcaggaggtatgtgtgaggctgtctgtgggagctttacgcacagactgcaccagcatcaggtctgaaacggctctctgagagaataacttgactttgcaatcaggttgaacactttatctaaccactgaaactcaacatcctctccagattatctttttaaaaaaatttttaggacgggtgcagtggctcatgcctgtaatcccagcaccttgggaggtcaaggcaggccaattacctaaggtgaggagctcaagaccagcctggccaacatagtgaaactccgtctctaccaaaaatacaaaaattagccaggcgtaatcccagctactcaggaggctgaggcaggagaatcgcttgaacccgggaggtggaggttgcagtgagccaagatcgcaccactccaacatggagaaaccatggagtttgactccagcctgggcgacaagagtgaaactctgtctcaaaaaacaaaaaaaaaagtttttttagttgagatgaagtcttgctatgttgcccacgctggtgtcaaactcctgagctcaagcaattctcccaccatggcctcccaaagtgctgggattacaagtgtgagctacaacatccagctcaggtatctatgaaaataaaccatgctatgatgtaggctggaagaagcttagagttacagatgtaagataggccattttaaagaaaggactccaaaaactccattgtttgttaccaatctttcactttctttttttttttgagatggagtctcactctgtggtccaggctgaagtgcaatgaatggtgcaatctgggctcactgcaacctttgcctctcaggttcaagtgattctcctgcctcagcctcctgagtagctggaattacagacgtgcatcaccacactcggctaatttttttgtattttaagtagagatggggtttcaccatgttggccaggctggtctcgaacttcagacctcaggtgatctgcctgcattggcctcccaaagtgccaggattacaggcatgagccacggcatccggcctccaatctttcattttaaagcaaaaattgctagttcaatttgccactaatcaaattaatattcgattccaatttggcttcatactttaaggttttattaataaaattacaagcactataaatactaaaactaaatattcttctaatatttgagtccataaaactcctgagacttaaactaaatgaatttatgtctttatttagcccaacggggatgtaaaaataccaggcagagcacattacagaaaacccatgatgagtagtaacgtaaaatgtgtgtttctgctgcccaaatggaaaggcctgcagctgaaatggttaagggttcggtggaaaaataactgtgtaactatgttcccagtattccaattttataattcaaattttctaaatcgctcttaagctggcagtagaatgagatctggccagttccaaacactgaacttttaaatatttaatgagtgatatttttaatatttcatcacattcaatttgcatcataaaacatttacagaaacaagtgaccgatgtttctgtcatcatcacaaaaaaatggcaaagacaagagactactggctgcaagtctaggaacgtgtcacctatgtcggaagtctatacctgactcatttcatcacattctaggaggttttaaaaaacaaactaaactgcttctcctgcctcccttggcctcagccatggcgagtagccgtggcagcgaatccaaatgcggtgcgggagaccatggacaggatgctgaataaactgtgtgttgtgcacctgcatcttgactttgatccatcacatgaggtgtggaattttccactgtggtgtcatgtcggtgcttaaaaagtttcggattttggagcatttcacatttcaggttttgggattaagagtatccaacctgtactaatcacacattctgcttgagatttcaagaatttagaatgctggcttagatatggaaactcctatttgtgtacggctttgtgaacaagaaattaacccagaagctttatcatcagttattaaggagcttcgcaaggctactgaagcactaaaggctgctgaaaatatgacaagctgattttctggggaaattctgatgagatatgtcaagctctgcaagaggatttaaagattgcactgtagtcgagaatgtacaatgatactgaatgcagcagtgtagaaaaattttcctttttaaaagaattataaaaccatagcattataaatcagtggaaagtggcttacagacagaactatcagatgtgtttacatcacatcttattcttttttttttttttgaggcggagtttcgctcttgtcacccaggctggagtgtagtggcgtgatctcggctcactgcaatctctgcctcccgggttcaagcgattctcctgcctcagcctcccaagtagctgggattacaggagtgcactaccacacctggataattttgtatttttagtagagatggggtttctccatgttggtcaggctggtcttgaactcccggcctcaggtgatccgcccaactcggcctcccaaagtgctgggactacaggagtgagtcaccgcgcccagcttattcactttttttaacggctctaatgcttccacatcgccatgttcatatttatgtattctttatttatagctttgatagctttaattttctaagcagtctatcagatgtgcacatctgctgtgcctgtagtggaacccatcagtagtaatgtgtagtagttgtgacttgttgacatttccactataaattttaactttgaattgtttatgcattataactgtggatttatattgtattgggctgaaagctgacactatttcagccaccattggtgaattctgatttagattcattatgtatgtcggaatcttgttttttaaaataagagcatggaaaacatttcttgcaatctgatctttaacaaagaatacttagttttttaaacagtttgttgggcagctaataatgtgaaccaggtcatttttgtattgagtaaaaatttaaacttctagaaacttagattttaaaagtaatgacaatgcttaggttagtattatttgcaattcgaatcatttacagctaatgagaatgttttcttaaagttttataccctataaatggaggcctaaaaaaatgtgtaaaatgaaacatagcaaacatgccaaactcctgtttacttttcttacataaaagtaatttgagtccttgactaataaatcttgaatggttatttaataagttattaggtaagtaatgtgtttcaaaaaaaaactaaactttgaatgtattaatttaaaactatgcaaaagcaaagctggcaatcaaaccttctacaagtgcaggctgtagctaggcacacacctatcatttcaggatatgactcattttttagggttatggtagatttcagtcattagaaattatttgatttttaagtcaagatgaaaaaaatacaataatcaactttaggattaacatgaatataagctatgctgccccagcacaacccaactctgtgggctaaagagaggctagacccgggccgggcgtggtggctcacacctgtaatcctagcactttgggaggccaaggcaagcagatcacctgaggtcaggagttcaagaccaacctggccaacatggtaaaaccccgcctctattgaaaatacaaaaattagccgggcgtggtggcacacgcctataatcccagctacccaggaggctgaggtaggagaatagctggaacctgggaggcggaggctgcagtaagctgagatcgcgccatcgcactccagcctgggtgacagagcgagactccatctcaaaaagaaaaagagagagagaggctggacccatgcctaagtctcacaagtaacggggatttcagcaggttggttgcagagcccagacgccaaccacaggtcccagggtggccctgatatcagtcaacccagtacacgaacagttcctttccggtttattcactcatatggatggttccccacttacagtggctcaacttaggatttttagactttacaaagatgggtttatcagaagataaacctgattgtaagtaaagaagactttgtaactagaaatccacggtttccagccaggcgcagtggctcacacccataatcccaacactttgggaggcccaggtaggaggattgcttgagcctagaagttcgacaccagcctgggtgacaaggtgtgatcccgtctctacaaaaaaatgttttaaaaaattaggctggacacagtggctcacgcctgtaatcccaacacttcgggaggccaaggcgggtggatcacctgaggtcaggagttcgagaccagcttggccaatgtggtgaaaccctgtttctactaaaaacacaaaaattaggccaggcacagtgtctcgcgcctgtaattccagcactttgggaggccgaggcaggtggatcacctgaggtcaggagttcgagaccagcctggccaacatggtgaaaccccgtctccactaaaaaaatacaaaaattggccgggcacagtggctcacgcctgtaataccagcactttgggaggccaaggtgagcagatggcctgaggtcaggagttcgagaccagcctggcaaacatggtgaaaccctgtctctactaaaaatacaaaaattaaccaggcgtggtggcgggtgcctgtaatcccagctacttgggaggctgagacaggagaattgcttgaacctgggaggcagaggttgcagggagctgagaccacactattgcactccagcctgggcaacaagagtgaaactccatctcaaaaaataataataataataatacaaaaattagctaggcgtggtggcagatgcctgtaatcccagatacttgggaggctggggcaggagaattgcctgaaccagggtgacggaggttgcaatgagccaagattgcgccactgcactccagcctgggcgacaggagcgaaactctatctcaaaaaaaaaaaaaaaaaaaaattaaccaagcgtggtggcatgcacctgtaaccccagctactcggaaggttgaggcaggggaatctcttgaacctggggggcagacgttgcagtgagcagagattgtgtcacttgcactccggcctgggtgacaaagcgagattccctcttgaataaaaaaaaaaagttagctggcatggtggcacatgcctgtactcccagctactcgggaggctgagacaggaggaatgtttcagcccaagagttacaggctgccgtgagccaagatctcaccactgcagtccagcctcagggagaacaagactatctctaaagaaaaaagaaacccactgtttcaaacaagagtgtgatgtgtgcctcttatcatgacacgtaggttggtcatgtctgcccttaaaaaacaacagctaaatattgcaagagactgttggcgtctcacctataaatcctagatgatgttacaggtttcatttgcagattcaacttttaaaccttggtctatcataagaacctgcaattaaggaacactgccagcaggtggtgacaggtgcccttgcatgctccaagttctcaggctttgattttaaaatcctgctagttaatttccaaaggcgagctagtaggcccttgttaaagatgacatgggtagaaaagtatcttaaactctaagtttaaaatctccagctgattctttttttcctcaaaaaagcatttggaacaggtaaaatattcacagttttaaaatcaaaatataaaaaggcattatctctgggtctctaagtattgtccctagtcataaattctttttttttttttttttgagagtcttgctctgtcacccaggctgaagtgaaataaaactacaatgtgtgccaccactcccagctaatttttgttatttttagaggagaggggttttcaccatgttggccagggtggtcttgaactcttgacctcaggtgatccaccgtgcctggctaatttttgtatttttagcggagacagggtttcaccatgttggccagtctggtctcaaactcctggcctcaagtgatccgcctgcctcagtctcccaaagtgctgggattacaggcgtgacccactgcacccagctgtaaaacagattttttaattactcttatttttttttttccaaagactgaacactgccaaagaatctctgtatgcacaggtttaaggatttcttcatcagaatcccaaacaaactaaattttaaagggctgattgaaacaccaaatacatagcttagacattatttagatcagggtttctcaacagctggacactctgggccagacaatgtttagctgtggggctgtcccgtgcattgtgggacgttcagcagcatcccggcctcaaaaccactggatgtccgcggcctccccaccaagatgtgccaaccagaagtgtctccagacattccccaagatcccctgggggcaatcctcctccctcctcccttgagaaccactgactgacatccaccccgttaaggaaaaccaatgatgtctacatgaaaatcacttgtacactttaaaagagccactttaataatttgtgcattacattgatgtgaatttctttttttttttttttccgagtcagggtctcactctgtctcagaggtgtgggacaccccacccagcttgaagttaatttttaaaataaaaacacattaaggccgggcacggtaggtcatgcctgtaatcccagcaatttgggaggttgaggtgggtggatcgcttgagttcaggagttcgacaccagcctgggcaaaatgataaaaccctgtctctacaaaaaataggaaaaaattagccaggcatggtggtacacttgggagctacttgggacctcccagctactcgggaggctgaggcatgagaatcgcttgagcctgggaggtggaggttgcagtgagctgagatcacaccactgcactccagactgggtgacagagcgagacctgcctcaaacaaacaaaaaacacacacattaagtgtcaaataaattcttaagctaacagaacaattgagttttttaatagtacagtgaaactttccctgcatttattcacttttcccaggacaagcatcataccaccacatactgttacacacaatgcagctgttctacgaaaggtgaggctgggcgcggtggctcatgcctgtaatcccagcactttgggaggccgaggcaggctgatcacctgaagtcaggagttcgaaaccagcctggccaacatggcgaaaccccgtctctactaaaaacactaaaaattagccaggtgtggtggtgggcacctgtaatcccagctactcaggagactgaggcaggagaattgcttggacccgggaggtggaggttgcagtgagctgagattgtgctattgcactccactgcagcctggctgacaagagtgagactccgtctcaaaaaaaaaaaaaaaaaaaaaaaaacaaaggtgagagctgtttgcaagctctgcacatctggatccactctcttgctcacaggctgggacacctgcctgtccgccaccaggcggtctatggctgggcatgggctcaccactacccagctcacagggcctgagagctacatcgggctcctcgtgttggggagcgcaaggcatgcatggtggcatcatgagaaaagaccagggaatgagcaggaacagatggaggaggaacccctatgtccttctccctggtgcacatcccaccctgaacactaagaaggaagcaaggggaccagaccctgcacatgagcctcagggtaggatgccaggagagtcccaagaacgaagttgggggtgaagaggtggctgcaggggtgagaagagaaggggaaggggctgggctgagactgcagtttagagtctaggtatctcccgcacacggagatggggctgtccccaactagaactgagagctaaggaggaatgacagggcaggagaatccagaagaaggggcttctgtttcccccttcttccatccatccatccgtctttctcgaggcccaggtagtcttctaggtaccaagaaaataatggtgagtaaaacagcccctgccctctcagagcttgtgttatggttgataaaaatatgaatttgaaacagaacctgcaaagtaatcctcacttcctacaattgcaacttttgaaagcttaaagtgagccttctaatttttttttttttttttttgagacggagtctcactctgtcgcccagcctggagtgcagtggtgtgatctcggctcactgcaagctccgcctcccgggttcacgccattctcctgcctcagcctcccgggtagctgggactacaggcacctgccaccgtgcccggctaattttttgtgtttttagagagacggggtttcaccatgttagccaggatggtctcgatctcctgacctcgtgatccacctgccttggcctcccaaagtgctgggattacaggcgtgagccttctaatttttcctccaaattccaaacaagtttttttaatgtgggaaaatacacagtataaaaatttaccatcttaaccatttttaagtgtacaggccaatagcattaagtacattcacactgtcatccaaccgtcaccaccactacccgtctctagaacttctttcatcttgcaaaactgaaactctgcacccactaaatactaacttcctatttcccctcccccagcccctggcagccaccattctattttctgtctctgtgaatttgactatttgactaagggtccggcgtggtggctcaaacctgtaatcccagcactttaggaagctgaggaaggtggatcgcttgagttcaggagttcaagatcagcccggccaacctggcgagaccccgtctctacaaaaaatacaaaaattagccaggcatggtggtgccacacttgtagtcccgcctacttgggagggtgaggtgggaggatcacctgagcctgggaggtcgaggctgcagtacgccaagatggtgccactgcactccagcctgcatgacagagtgagaccctgtctcaaaaaaataaaaataaagaatttgaccattctaggccagatgcggtagctcatgcctgtaatcctagcactttgggaggccgacatgggtggatcacctgaggttgggagtttgaaaccagcctggccaacatggtgaaaccccatctctactaaaaatacaaaaattagctgggcatggtagtccatgctaattccagtcacttgggagactgaggcaggacaatcgcttgaacccaggaggcggaggttgcagtgagctgagatcatgccactgtactccagcctgggtgacagagtgagactgtttccaaaaaaaaaaggaatttgaggccgggcgcagtggctcacgcctgtaatcccagcactttgggaggccgaggcaggcggatcatgaggtcaggagatcgagaccatcctggctaacactttgaaaccccatctctactaaaaaatgcaaaacatttgccaggcgtggtggcgggtgcctgcagtcccagctcctcaggaggctgaggcaggagaatggcgtgaacccgggaggcggagcttgcagtgagccaagatcacgccactgcactccaagctgggcgacagagcgagactccgtctcaaaaaaaaaaaaaaaaaaaaacaaaaggaatttgactattctagtacctcatatgagtgggatcacaccacacttatccttttgtaactggcttcattagcataatgtcctcgaggtgcccccctgctgtggcatgcgttggaattccttttcgaggctggatgatgttccgttagaaggataccatgttttgcttatccattccctggttaacagacgctgggttgcttccaccttttggccattgtgaacaatgctgctaatgctggtgtacaaatacctcaaggccctgttttctaatcttttgtgaatatgcccagaaggcggactgctggatcatacggtgattctatctttagggtgattgtatctttgtgttttgaggagccgccataccgttctccatagtgactgcaccattttccattcccaccaaccgtgcacaagggccccgatttctccacctccttcccagcacttgttattttctgctttttgatagaccatcctaacagatgaaaccaaacatgctttatatcaagtaattttaccttctcgtattgtgtaaaattgataagataccaaagtagacaacagagagtaagaagccccatgtgctcctcactaaccactataatgatccacgcagaatgaatcttgtttgacttcactcccactcccaacaccgataccacttattttgaagcaaatgccagacatcatataacttcccctctcaataccgcatcatacatctctaaaagataacaactctttttaaaactaaccatatcaagtccaatagagcttaaaggtaaaaaataaaataagctgggagaggtggcttatgcctgtaatcccagcactttgggaggctaaggagagtggattgcttgagcccaagagttcaaaatcagctaaggcaacatggcgaaacccgtctctagtaaaaaatacaaaaattagccaggcgtggtgatgcacacctgtagtcccagctacttgggaggctgaggtgggagaatcgcttgagcctggctggtagaggctgcaatgagtcataactgcaccactgcactccagcctgggcaacagagcaagaccctatctaaaaaaataaagtaaaataaataaaaactaaccataatggcagtattacctaaaatttcacaattatttaatatcatcaaatacctaatcagggttcctatttatctgcttgtttggtgtatcaaataatttcactcaagacttttctcgctctgtagggtaagtttgtgttgtttcactccgaattccgctatgaaagaaaaatgaaagcactgataaccttgaacagtaatgcttaggggtttccacaatgtcgccaattcttttttcacctttaagtatgtttattaagtaggttttcgtagatgttatttatcaaattgagagagagcccctctattcctaactttgagagttttcatcatgaatgaatgaatagcatcttctgaaatgctatttcggcattaattggtatgctgtgacttttcttttttagcgtattgattggtgaattattgactgtcaaatgttgaaacagtcttatgtatgtggactagatcctatacggtcatggtgtatcattcttcttgcacattgtttgatttgatttttgttgaggactttttaaatgttttgttgagatcgccattaaaatattttgtcagtatatttcaattcacttttcttttgaaaattctgaaaattctactggcatgaatatatccagttttgtatactcagcatcaaatattacgcatatttcggagcacaggtcaggcgccgtggactcccttttgctgaccactgaggctaatctagcggattcagctatatgaaaggcaagagacagcgacaatcacaaggctatttttgaaaaatcagggtgtgacgatcgcaaatgtgcttttaaaaattaggattaaaaaaaaaacagggccgggcgcggcggctcacgcctgtaatcccagcactttgggaggccaaggtgagtggatcatgaggtcaggagatcgagatcatcctggctaacaaggtgaaaccccgtctctactaaaaatacaaaaattagccaggcgtggtggtgggcgcctgtagtcccagctactcgggaggccgaggcaggagaatggcgtgaacccgggaggcgggaggaggcagaacttgcagtgagccgagatcgcaccactgcactccagcctgggcaacagagtgagactctatctcaaaaaaaaaaaaaaaaaaaaagatggaattgtttctcctgttaaacctggcttaaatatagcaaccctaaagctgaaagacaaagaatttgaaggtttgtagttaaagtggcaggacttcctaaagcaaagttcacaactttttcagatcacaggctttttgctctgttgcccaggctgcagcctccaactcctggactccagaaatccttctgcctcagcctcccgagtagctggggagccaccatgtccagctagttttaaaatttttttgtagagaaggcggtctcactgtattgcccaggctggtctcgaacttctgggctcaagcaatccccctgccttggcctcccaaagagctgggattacaggagtgagccaccatgcccggcccaaatcctttttttttgagatggagtctcgctctgccacccaggctgaagcgcagtggcacagcctcagctcactgcaacctccgccttctgggttcaaacaattctcctgcctcagcctcctgagaagttgggattacaggtgcccaccaccatgcccactaatttttgtatttttagtagagatggagtttcagcatgttggccaagctgctggtcttgaactcctgaccttaagtgatccgcctgcctcggcctcccaaagtgctgggattacaggtgtgagccaccacatgcggccccaaatcctttttagtttaatgttaagatttctggccgggcccagtggctcatgcttgtaatcccaacactttgggaggctgaggcgggtcgatcacctgaggtcaggagttccagaccagtctggccaacatggggaaatcatgtctctactaaaaatacaaaaattagctgggcatggtggcgggtgcctgtaatcccagctactcgggaggctggggcaggagaatcatttgctactcaggaggctggggcaggagaatcatttgaacctgcgaggtggaggttgcagtgagctgagatcggtcgtgccactgcactccagcttaggcgacagcgagactccacttcaaggggaaaaacaacaacaacaacaacaacaaaaaaaacaggccaggcaccaacccaaaacataagcagcaagtgtaacagcaatgccggtattccacactgacttccatcctgagcttcctaaacaactctcatatgccatggctggcagtctctcttgaatgtcacaggtgtgatgtggcagcctctccagcagagagcctcatgtccacctacagcagtgagatttccagcagcaaaggctttagcacaatccttccagaagttccaaagctgacaggtgagatgcgcaggaagggccactcttaaaacacttaggaaataaggggtctccctcatgattgggctgtaaccttgggagagtcatcttacagccatcctgtagggtattaattaccagggacacagactccagccacgggtgtcgggtgtcgggaaccatgcccttggctacggtatccctggaaacacagcatgcccttggcctgaatcccagaataccccagagaggatgcgtgaagatgggtccctgaaacaagagcacgtttgcaggtaaaaatccccaaggagctttggggtcttggaccaaggtggatgggtgcaggggtggggtcaagtttctgctagtgtttctcaagctccgtaccctcaggagcagctgttcatgtgtgaatgttgagtagtcctattccagagctaagttttgtgaaacggagtgagaagggggcaggggaagagacagaggtggacagcctctctctcattccaacatttatctctagagtaagcaaaggtgggaaactggagaaatctcgattaaaacgcagatccctttttttttcttttgagacagagtctcaatctgtccgcccaggctggagtgcagtggtgtgatctcagctcactgcaacctccaccttccagattcaagcgattctcctgcctcagcctccctagcagctgggactataagcacgcgccaccacacccagctaatttttgtatttttagtagagacggggtttcaccatgtttgccaggctggtctcgaactcctgacgtcaggtgatccaccagtctcagcctcccaaagtgttgggattacaggcgtgagccactgcgcccagcctaaaatacggatcctaacagacaaggggagatcaaacctcagatagtaaagagcacgcccccatccatccacggcagctgtgggccgtaatggggcgccaggcaagattttctagacaaccctgttaaactgcacccgctgggcccccgcttcgaatctgagacaatcaatctgacctggcgctgacaggtttgctgtggaacaatttgatgcactccccaacagagaacaatggcctcacagaaggttcatgaatggaggccattcgaaagctttcttgtaagcaaagaagggaggttatcagccttcctgggcaatttccactttgactccaagacgctttttgccctctgtatgtcccgcctcgggtggggtcttcagctttgctcttctaagagattaacttgcaagcagcaccagttacagccactgctgctatcttgtgttttagcatgagcctccctgaagcaaaatcatctcaaaatctctgaaatgtaacgtacagaatttcccacaggcaaaacagtgcaaagttgggaatatcttcagtggtacccactgcctttctgtccatgctgctaccagcttcctagagcttcccctggtgggccagggtttccaacagacaccttcccccataagtgctcacttcattcgcattgggttagaactctcccgctccaacttcccgtttcttcacagccccactaacactggccatttagttcaataaactaattggagggggatgctaatgaccggtaatgacttaaggcactcacactttgtaaagaacctcagcaatttaatataaaaacagggtaagtaacgcaggcactttgcaggctggtggaggaacacgttttcagaacagagccctgagctttcttcagtttataccttgtccagagaattaaatacacagcaccaggggaacaaatccaatgccaaaccactatcagaacatttccaactgttgaccgtatattttcattcaccaattaaatgttgtttgagattgagtctccctctgtcgtccaggctggagtgcagtcacgcaatctcagctcactgcaacctcctcctcccaggctcaagcagttctcctgcctcaacctcccaagtagctgagatcacaggcgtgcttcaccatgcctggctaatttttgtatttttagtagagacagggtttcgtcatgttggccatgctggtctcgaactcctggcctcaaatgatctacctgcctcagcctccgaaagtgctgagattacaggcatgaaccaccacgtctggccttcaattaactcttacgatccaagccaggcaggaatctagctacacaaccagggacgtgccatgatttccttcaatttcctattttgcaatgttatcagaaaatatgggctaggtctggccttttctttcttctttatcatgatcacatttgtcttgaattaaaaataggacagggcaccatccttaatcaaaacataacagaccaggggtaatttccaagttctgtatgtgttttttgtctcctgaccttcacatacaatggaaaactttatcatatatagttcaaaacagtccacacagtattcaaggcctgatggcattcattatcaatgccaagttcttaacagctgttacccaaaatactgtcaccaactgactaggattgtctaataaatccatgaaggctaatcagaaaaaaaaaaaagaaaaaaaatcaagattctgtctttgcacccctattttttttgcttttattatttacattcctaaaataccaacaatagcaagagtaatgcttttacatagaattcttacatcatttataaaacaaatattaactttttttttttttttgaggtggagtttcgttcttgtcgcccaggctggagtacagtggcccgatctcggctcactgcaacctctgcctcctgggttcaatcgattctcctgcctcagcctcctgagtagctgggattacaggcatgcgccaccacgcccggctaatttttgtatttttagtagagacggggtttctccatgttggtcaggatggtctgaaactcccaacctcaggtgatctgcccgcctcagcctcccaaagtgctgggattataggcataagccaccgtgcccggccaaatactaacatttttagagcaacagaaaacaaaaccgctcaatcttattctgccactgagtcactgaagaagcatgtttatttttattaaaaagggcagaaccaatagaagcataagagaactacagtacaagattggggaagacatgaaggaaaaagaaaaaaatgtactttccttaagttattttaaggaaataaaggacactggctgggtgcggtggctcatgcctgcaatcccagcactttggggaggccaatgcaggaggatcacttgaggccaggagttagagaccagcctgggcaacatggtgagaccctgtatctacagaaaaatttaaaattagccaagcatggtggtgcatgcctatagtcctggctacttgggaggctgaggcaggagaactgcttgagcccaggaggctgaggctgcagtgagcgatgatcacactactgcactccagcgtgagcaacagaacaagaccctgtccccacctccaaaaaaaaaaaaaaaatctgaggctgggcatggtggctgacacctctaacagcactttgggaggccaaggtggccggatcacttgaagtcaggagtttgagaccagcctggccaacatggtgaaaccctgtctctactaaacacagaaaaattagctgggcgtggtggtgggcgcctgtaatcccagctactcggggggctgaagcaggagaactgcttgaacctaggaggcagaggttgcagtgagcggagatcatgccaccgcactccagcctgggcgacagggcaagactgtctccaaaaacaaaaaaaaaaacaaaaaacaaaacaaaacaaaaaaaaaaaaacaggcatttgacctggcatctcctaacttcctggtgactgaggacaagatggtgaaatggaaactggatgaaaataaagatgggtgggccaggcgcggtggctcacgcctgtaatcccagcactttgggaggccgaagcgggtggatcacgaggtcaggaaatcgagaccatcctggctaacacatgaaaccccgtctctactaaacatacaaaaaaaaaaaaaaattagccggacgtggtggcaggcgcctgtagtcccagcaactcaggaggctgaggcaggagaatggcgtgaacctgagaggcggagcttgcagtgagccaagatcacgccactgcactccagcctgggcgacagagcgagactccgcctcaaaaaaaagaaagaaaagaaagatgggtgaattatttacaacaggtttaatgaccacctaaaaggtcactgaataataaacccatggaaacctgcaacggcctctggtaacctttcaaaggcatcatacttggttggctctgttcaaccattacatcaaatttgaaaataacacgaagccagaatgaacagatggaatgtggagtcaggattcaaaactgcttgacggagcagagtggagagtcagatacggcaagatgaaatgcaacagagataaatgcagagactcacactagaacaaaacatcaagcttgaagatgagaagcatggttaaacactggtgcgtggtaggggtacttgggggttggagttaaataaaatgcagtgtgacaaggctgctgagacacttagacaagggaatgctagccccatgctactccaaggctgtccttgagtcaggaattctgttaaaaccttggccccatctgaaaggcatccaaagagaaagaaatcaagctggactcaggaggctcaggcaagaggacccttgagcccacccaagagtctgagtcctgactgggcaatgcagtgagaccctgtccaaaagaaagaaaaggtggggagaggaaggggaagtgggggagggagagggtagaaagaaaatcaatcaggctggccatggtggctcatgcctgtaattctatccctttggaggctaaggtggggacaatcacttaagccagtagttcaagaccaacctggtcaacattaatgagacctcaatctctacaaaataaatttttttaaaattagcctggcgtggtggtgcatgtctgtagtctcatctacttgggaggctcaggcgggaggatcatgtgagcccaggagttggaggttgcagtgagctatgattatgctactgcaccccagtctgggtgacaaagcaagaccctgtctcaaaagaagagaagagaaggctggctggtggagattttggaaacaaagtgacatgaaaaacagctgaaggaacagaggaggcttggctaggaaatgaaagaagctgatacggagagagagaggggaggacaaggtaaattccctttcctggcaggaatgttaaaatattgcagctactgattggcggttcctcaatcgattaaaaatagaaatactgtatgaggcgggcagatcacttgcgaccaggagttcgaggccagcctggccaacatggtgaaacctcatctttactaaaaatccaaaaattagccaggcgtgggggtacatgcctgtaatcccagctactcgggaggctgaggcaggagaattgctttaacctgggaggtggaggttgcagtgagccgagatggtgccactgcactccagcctgggcaacagagggagcgagactctgtcaacaaagaaagagagagggagagagggagagaggggaagaggggaagaggggaagagggagggggaggggaagagggagggggaggggagggaaaaagaaagaaaagaaaaactatatgacccagatattccactcccaggtatacatccaaaagaactgaaaacaggtactcaaatacttatgaatgaatcatcacagcagcactattcacaacagccaacagccaaaaccatcctaaaacctgcatcaacagatgaacggacagacgaaatgcagtctatccaaacaaggaaccataaaaggaatgaagtactgatatccacaacatgtacgagcctcaaaaaattatgaaactcagaacattcagctaagtgaaagaaaccagacataaaaggtcacgtatcacatgattcccccacttatatgaaatagccaaaataagtaaatccatagagacagaaagccgattagtggttgccaagtgctgggggcagaagggagtagcaaatgcctgtttaatgggcatgaggttttcttttgggatgacgaaaacattttggaactagatagaggtggtagttgcacaatgctgaatgtactaaatgccactggattgtacattttaaaatgtgatgctggggcttccagtttccagtacagcatgttaggagattagaagttgctaatctgtcctaataacaagtaaaaaagccaaagaaactgaaaaatcaagaactattcttagatccctaagagaagtgagatcacaaggcaattgctgccccccaaaattggagacaggctgcgtgtgatggctcgcacctgtaatcccagcacactttgggagggcggggcaggaggatcacttgagcccaggagtttgagcccattctggcaacaaagtgagacctcatctcttactaaatcaaaataaattagccagacatagtggtgcacgcccatggtcccagctactcagggagcagagatgggaggaccacttgagcccaggaggtcgaggatccagtgagccctgatcgtgccactgaactccagcctgggtgacagagcaagaccctgtctcaaaaaagaaaaaaatacataaattttaaaaattggagacacaggcaaatacacaaggaatcacaatttacagagcagaaacctccatgggaaccggtgccagggtaggaaaacctaagctgtaatcgacaaactgctggagttcaatgtgcagaactctgagagttaaaaattccagggagccgggcgcggtggctcacgcctataatctcagcactttgggaggcagaggcgggtggatcacgaagtcaggagatcgagaccatcctggctaacacggtgaaaccccgtctctactaaaaatacaaaaaattagctgggcatggtggcgggcgcctgtagtcccagctacttgggaggctgaggcaggagaatggtgtgaacccgggaggcagactatgcagtgagccgatatcgcgccactgcactccagcctgggcaacagagcaagactccatctcccaaaaaaacaaaaaaaaaatgccaggcgcggtgactcacgcctgtaatcccatcactttgagaggccgaggcaggcagatcatgaggtcaagagatccagaccatcctggccaacatggtgaaaacccgtctctactaaaaatacaaaaattagctgggcgtgctggtgggtgcctgtagtcctagctgcttgggaggctgagacaggagaatcatttgaacccgggaggcggaggttgcagtgagccaagatcgtgccactgcactctagcctgggtgacagagcaagactccgtctcaaaataaacaaacaaacaaaaaaccacacataaatgtaacacgtggatcaacaaagaaatatcgaggagttttaaaatgttttgaactaaatgaaaaagaaaatataatttatcaaaatgtgtgggatgtagtgaaagcagtgcttagtggaaaacttaagcatttaatacatatattagaaaaaaagaaagagctaaaatcaatcatataagcttcaaccttaggaaactagaaaaagatcagcagattaaatacaaagagagcagaagaaaatgaaataaaaactgaaacaaaaatcaataaaactgaaaacaggaactcaatagagaaaaccaacaaaaccaaaagctggttttttgaaaagatcaataaaactgataagcctctagccaggctaactatgaaaaaaaaagagagaagacacaaattcctagtatcagaaatgaaaacaggaacaccgctataagaccccatggattaaaaagatacataaaggggctgggcatggtggttcacgcctgtaatcccagaactttgggaggccgagacaggaggatcacgaggtcaggagatcaagaccatcctggctaatacagtgaaaccccgtctccactagaaaaaaaaaaaaaaaaaaaaaaattagctgggtgtggtggcaggcgcctgtagtcccagctactcaggaggctgaggcaggagaatgacgtgaacccaggaagcggaccttgcagtgagccatgatcgtgccactgcactccagcctgggcgacagagtgagattccatctcaaaaaaaaaataaaaataaaataaaataaataaataagaaaaaaaaatacaaaaaaaattggccaggagtgtggtggcatgctcctgtaatcccagctattcaggaggctgaggtaggagaatagctggaacctgggaggcggaggctgcagtgagccgagattgcaccattgcactccagcctagacaacagagtgagactcagtctcaaaaataaataaataaataaataagaggctgggtgcggtggctcacacctgtaatcccagcactttgggaggccgaggcagatggatcacctgagatcaggagttcgagaccaccctgaccaacatggagaaaccccaactctactaaaaatacaaaattagctgggcatggtggcaagcacctgtaatcccagctacttgggaggctgaggcaggagaatcacttgacccaggcggcggaggttgcagtaagctgagatcgtgccattgcactccagcctgggaaacaagagcgaaactccatctcaaaagtaaataaataagaaatattatgaacaactctatgcctaaaaatttgataacctagatgaaatttatcaattccctggaagatacaatctgccaaaactcacccaagaaaaagcaaacaatctaaatagacctgtatctcttagagaaactaaatcaacaattaataaccttccaaaacgaaaagtaccagacccagatgggttcactggtgaattgtaccaaacatttaaggaagaaattacaccaattctctacagaagcaaagggaatacttcctaactcattctgtgaggtcaccattattgttcgtttgtttttgttgagacagagtttcgctcttgttgcccaggctggagcgcagtggcacgatctcggctcactgcaacctctgccttctgggttcaagtgattctcctgcctcagcctcccgagtagctgggattacaggcatgcaccaccatgcccggctaactttctgtgtttttagtagagatgcggtttctccatgttggtcaggctgatctcgaactccggagctcaggtgatccgcccacctctgcttcccaaagtgctgggattacaggcgtgagccaccacgcccggcctcggccaccattattctatcaaaaccagacaaagatgttacaagaaaactacacaccaatatctctcatgaacacagatgcaaaaaccctcaacaaagcaagcaaaaaaacagcaaacacatgtttactatagtgttctaagtactttacaaaattggttcaatccccccacccactctgtgagaggggtattattatcatcatccccattttacagatgaagaaactgaggcatgtagagattaagtaagatgtccaagattacagagctaatgagccgcagacttggggtctgaacctcaacagtttagttcagagttcatgctcataactgctccactatgctcttgcagtgacaacatttaggcagaactgagacccaggactttctgacaaggaatgcttccctccaaaatagaaagatgctctctgattagaagaattccagcagggcctggctaaattatatcaggccacactgtgaagaggatcctacgtcaaaagctgccccagccagaccatttctaaagctcttgtcaactctgcaactgtgatttcagcagagtgtgcaaatttctgagatgttcacattaaaaagtgctacaaattttcaaataatgtgactttgttaacaggatgtactatccatccagattttttaaactccactctaattttataatctactttcctgactcaactgtacatgagagaggtacagactcacccaaatgtatgctttctgaatattttctattatagggaaacagggttaaagacaccccagaccagatcccactgttcattctactttccctattctgaactacgaaaatatcacactgacgacaatggcaacttcacttgtttcctctttggtaaaatgggctgcctgggctaaatgatttctcaagctccttccatttctagaattctagccatataattaaggagctgattttcttagatttttttttttttttttttgagacagagtctcactttgtcgcccaggctggagtgcagtgacacaatcagggctcactgcagcctcaagctccagggctcaaatgatcctcccacctaagcatctcaagtaactggggccacaggcacctgccaccacacttaggtaattttttattttttgtagagacaaggtttcgctatgttgtccaggctggtctcaaactcctggctcaagtgatcctcctgcctcagcctcccaaagtgctgggattacaggcataagccaccacgcccagctaaaagtacttaacattctaatgcaaaaataatatacaagcaaacagagcttacttaagtgggaaggcacgctgccagattctaaaagcaaaggattctatcataaaagggaggaaaggattagataacctctcaaggggaaactggatttatgggatatagtctaggcaaaaaccagatcattggtaatcaaggataataccaaaacaaaccaacaaaccacccaaaacagcagctctcaacctctcccatcaaggcagacagcccaggtacaggcccacgcacagatattccatgggtaaaaccagattctgagaaaagctgaaaagatttttcataaaaataaagcaaacagtagcacaaaggtcttttatcgtggtagttataaaaatgttttacggccgggcgcagtggctcacgcctgcaatcccagcactttgggaggccaatgtgggcagataacttgaagtcaggagttcgagaccagtctggccaacatggtgaaatcccgtctctactaaaaatacaaaaattagctgggtgtggtggtatatgcctgtaatcccagctacttgggaggccgaggcacaagaattgcttgaacccaggaggtgaaggctgcagtgagcaagatcacaccactgcactccagcctgggcaacagagcaagactccatcttaaaaaaaattaaataaaattaaattttttttaaaaagtgttttacaatgacatcagccatttaaaggtctcaaaaaggccatcttgtgaggaaaaacgaaagtggtaatctttttcaactactgaacttttgttaaagccttgatctttttctagacctcaggaaaatattaatatggtgaaaggatacactaccaaagaataagcccaaataaacctgattttaacgtttacttatatttttgtacctattcttgcctttcccttattaaaggcgaggggccgggtacggtggctcacgcctgtaatcccagcactttgggaggctgaggcgggcggatcacgaggtcaagagatcgaggccagcctggccaacatggtgaaacctcgtctctactaaaaatacaaaaaaattagccgggcgtggtggcgggcgcctgtagtcccagctactcaggaggctgaggcaggagaatggcatgaacccgggaggcagaagttgcagtgagctgagatcatgccactgcactccagcctggcgacagagagagactccatctcaaaaaaaaaaaaaaaaaaaaggcgagggtaataatccacaagcacgcagatcctgactgcacatgggaatggacaccacctgtccacctgtgagggcctccctgggagcagcagcaggtgctctatgttatgggcaattccaggccatatggagttcaataatgaactccacccagcttctccacttaagaaagcaaggagtggcaggagctgtggctcacaccaatcatcccagcactttaggaggccaaggtgggcggatcacttgagcccaggattttgagaccagcctgggcaacacagtgaaatcccgtctctacaaaaaatacaaaatttcaggcaggcatgtagtcccagctattcaggaagctgaagtgaaaggatcacctgagttcggaaagtcaaggctgcagtgagccgagtttatgccactgcattacagcctgggcgatggagtgagaccctgtcttaaaaaaagaaaggccgggcacagtggcttatgcctgtaatcccagcactttgggaggccgaagcaggagatcacgaggtcaggagttccagaacagcctagctaacacagtgaaaccccgtctctactaaaaatacaaaacttagctgggcgtgctagtgcatgcctgtaatcccagctactcgggagtgaggcaggagaatcacttgaacctgggaagcagaggttgcagtgagccgagatcgcgccatagtactccagcctgggagacagagcaagactcctctcaaaaagaaaaaaaagaaaagaaagcaaggggcaatgtaaactatgaagagacataattccaggaaaaagttgaactaactctcatttcgtttttaagcaagtaaatcactagtaagctttgctttgttacttcaactattatttagaagcaaattactggtgacatgtcccctagttgtatcttgacatcaatgactgccctagagcagcagttatcagagcgtgatctaaggactcctgcgggggcagggaggaatccccaaagctctctctttcccaactatatctgtgtgaagctcagttttcttcatctacttcaaacagataacagacaatgcagaatctagctgttttctcttaagttggacattaatgagattagcaaaaacttaaaatgccagtcttcttactaagttgtttctggtttttggaaaacagttaattttcactaaaaatgtgttatttaggttgggcacaatggctcacacctgcaatcccagcactttgggaggccgaggcaagtggatcacctgaggtcaggagttcaagatcggcctggccaacatggtgaaaccccatctctactaaaaatacaaaaattaaccaggtgtggtggtgcgcgcctatagtcccagctactcaggaggctgaggcaggagaatcgcttgaacccaggaggcggaggttgcagtgagccaagattgtgccactgcactccagcctgggttacagagcaagactctgtctcaaaaaaaaaaaaaaaaaaaagttatttaagtcaccatgcaatgggtttatcattgctattttaaataatttaataattacattatttaataggttctcactttttatttctaataaatatccatagataaaacccacatatggctgagcacggtggctcaagcctgtaatcttaacattttgggaggccaaggcaggtggatcgcttgaggtcaggagttcaagaccagcctggccaacatggccaaatcctgtctctactaaaaatacaaaaattagctgtccatggtggtgggcacctgtaatcccagctactccagaggctgaggcaggagaatcgtttgaacccagggcagggggggtggagggggggaggttgcagtgagctgagatcacgccacttcactccagcctgataagagcaaaactctgtctcgaaaatacaaacaaacaaaaacacataaccacaagctctttaaagtccatggtaatttttgagcacaggggtcctgagaccaaacaatctgggaaccctaaagggttaggttgggttcaattctactacatccctctaagggattagtttacacaccatacctggggcaaatgtctgctgaatgaatgactttaagagaatgttacaaaataccctgtagaatatgactgcattttgtttaaaactttatgtagttaaatttgtacaaagaaaaaaatctataaaaatagacacgaggccgggcgcggtggctcacgcctgtaatcccagcactttgggaggccgaggcaggtggatcacgaggtcaggagattgagaccatcctggctaacatggtgaaaccctgtctctactaaaaatacaaaaaattaaccgggcgtggtggcgggcacctgtagtcccagctactcgggaggctgaggcaggaaaatggtgtgaacccaggaggtggagcttgcagtgagctgagatcacaccactgcactccagcctgggcaacagagtgagattccgtctcaaaaaaataaaaataaaaacagacacaaaatgtttacactaatgatgtcaaagaggcagtcttttaagtctttttaccttactttcattctattttggactaactgtgttttcttgttctacagtaagggcgtgggggggggtctggagcagcattgcctaaagtgtgttccccgggacactggtgccacaggtgcggcagaaagagtcccaggtcaagtgagttggttttacccccggctcagcaattcctccaagtgcactcaagcctgtgagaagccctgcagtaacgaaacctgtttaacgttaacagcgcttcccaagcttacatgaccgagacctcattgacctaacagcacctgtccacgtcacacacctagggagacccatctctcatcctagatgagtttcaaggggaagcctgcagttggtcactacatccttaccattagaagtcactacacggactacgtcaccattatttacaaacgacaacttctagcaaagataatattaaatgatacatgatacatcccactggaatagctgggagttacatcaaatacattttttacactgactttagtaaaatgcctctatacaagggagtaaatttacttcatatagatttaggaacttggtaaattcaagtaacaattttaaatagcaatatttcagttaaattctttgatgaaaaacactaagcgcgtctggccctaagtcattcctccacacagcgtacagcagtcagcatcccctgaaaggcgtggccaccgtgaagaggcagggcctgcagaggcggctgcttgcagagggcccaccgcccccggttgtggctctcctgcctctcctccacctcaaaacctttctgcccttggaggccgtgcctctgcctgggcatgggggcccctcctccctgggcttcctgacgtgcttctgcagatcccagtggcaggctactctctccctccttttcttctcactggctcggtcacctaggaccccaggaactaggcttctgcctccttcacaacccttctctggtacctcggcctcctagccccttcatcccaggtgggggtcaaggggccactgattgtggctgctgcccccacagaatcctgcggcgctgccactccaatgcctcccaccactccaccttaaccagcgcctcaccgctggtttacagaatgacagcagtccctctgtatccaccagggtagtggttccaggacgccagtctacacctgaatccacacatactcaagttgttggtcctgcaggacccaagtattcaaagagtcagtgcttcccatatgcgggtgtcacagcccacaaatactgtattttccattcacgtttggttgaaaaaatccacttataagtggacacatgcagttcaaagccatgttgttcaaggctcaacagcactgtactgcaacgtgggtgagcgtgaacgcatgtgcatgcatgcgctggaatttactgccaatctacccaatttccacttgttataggttaaatatgtttctgacagtcacttttggagctttataagcattgtttataacaaatttccacggggaagatacaatttgggttccaacttgaactccaaaccgatcaatatgagttacctttccaaatcagaaatggcttaggtaccaggaaacaatgtatcaagacaaagctaggttgaggcagtttgccagtaattactagacgatcccatgagcggaggtagtcaggaatttcagcaaggggccagttcggtttacccaggcctggggacagactgagtggagaaataacacgtgcccgagctctcaggaaaaaggcctcaatctgaccagaactagcacggactcacattggttggccactgctgtgggctgctcagatgccagggttccatcactgctctctgcaccagcttgccccagcttacctgtctgtacttgggtttccaaacgataagagtacagccgggactgctctagcctgagccaaggctgctgtcccaaatcctcatctggtctcctgcattctagatataacagaaacttcaggaaacccttttccccttctccttcaggcctaagcaacaaccagatttggcccaaggggcccatgtttgttctccctttgtccctggcttcactgtccaccagagtgaaaacctcatacgcagaaaacacccacaacccaagctgaggggaaacaatggccctccaggctctgcccttattctctgccaagacttacacctctggccttatgctgtcactgtccgctggccacagatgcctcccagagccctccctgagaagacacaggatgtgagtgacagcccatcagacacacaccccccagcctccaggagtcactctgaagcgcccgcccaaatgcggatctgccttactcgcctgatggtctgtcctcttcctgggtcagcacccaatcctgaataattcactccttcaatctctgcagtcaggctcctgtgcacaccactctgcaccgtgcattcctgaagataacatgaacggcctcttaatcaccaccccacctgcctctcctcggtactcatgcttgcattcacttctctaaaatctaaactgggccaggcagggtggctcatgcctgtaatcccagtgctttgggaggtcaaggaggctggatcacttgaggtcaggagtttgagaccagcctggtcaacatggtgaaaccccgtctctactaaaaatataagcagtggctcacgtctgtaatcttagcattttcggaggcctgggcaggtggatcatgaggtcaagagttcgagaccaacctggccaacatggtaaaaccccatctctactaaaaatacaaaaatcagccgggcgcggtggtgggtgcctataatcccagctactcgggagggtgagacagaagaactgctggaacctgggggacagaggttgcagtgaaccgagatcacaccaccgcactctagcctgagggaaagagcaaaactctgtctcaaaaaaactataaaaatgataccagctacttgggaggctgaggcaggagaatagcttgaacctgggaggcagaggctgcagtgagccaagatcatgccactgcactccagcctgggcaacagagggagactctgagaaagagagagagagaaagagagagaaagagagggagagagagagagagaaaggaaggagggagggagggagagagggaaggaaggaagggagaaggcagggaggaaaggaggggaaggaggggaggaagggagggaaggcaggcaagcaggcaggcaggcagggtatggtggctcacgcctctaatcccagaactttgagaggccgaggcaggtggatcatctaaggtcaggagtacgagaccaggctggccaacatggtgaaaccccatctctactaaaaatacaaaaattagtcaggtgtgggagtgtacacctgtaatcccagctactcgggaggctgaggcaggagaattgcttgaagccgggaggcagaggttgcagagagccaagatcatgccactgcactccaggctgggcaacagaatgagactctgtctcaaaaataaataaataaagactggggacactagctcacgcctgtaatcccagcactttgggaggccacagcagatagatcacctgtagtcaggagttcgagaccaggctggccaacatggtgaaaccccatctctactaaaaatacaaaaattagccaggtgtggtggtgtacacctataatcccagctactcaggaggctgaggcaggagaatctcttgaacctgggaggcggaggttgcagtgagccgagattgcgccactacactccagcctgggcgacacagtgagaccccaactcaaaaaataaataaataaaattaaaaataaataaataaataaaaataaaatctaaactgttgaccacatctacctagaatgcctcattccacatacctccggatcctctctcctctctgttctctgatcaattctcttgctcctgggaccctcacaacaatgtatgatatactttatatgcaacaagaaaaatgcaatcaacacaatctgttcagacccactgccatatgcattactttaagtagcagttaaaaagcccaaaccttctaagaacactcagaaaaagtctagaaaaagacaaagttaataaactttaccaaatgaatctgcaaatatatattaaccactggtattaatggcctaaaacattatttcattcaaacaaacagtaatgtcgtagttgttattaaagtcagcagaagggaggggaaaggctatgttatgaagctatcccagtggtacttactccaatttagaagaagttttaacatgtcagatttcatataaaaaagcatttaagccagtatttattttctattcaaggctctgaatgtttagaagacatgtattcgctgcttcctaggtaaacaagaggcggctctcgtacacttgggcatggactttttaaacccttgccaaatgaaaatgttttctacaggaatcatgagctggtatcaatggatatttacagacagctcagaagcaagctctgaccttgccaacttagggctttataatcagtcaggattatcaaggtccccttccaactagtcacaaggcactagtaactgaggggctcaaaaactcaaaacgactgtaccccacctgttactccccacccccactgttcctttaataattttagcccagagtgagagggcctaaggagaaaatgaaattcaagtcagtgtgttttactatttacttagtactctgacaaatgcttgaaatgcatggcaaaaaaaaaaaaaaaaagagtagggattatccaagaattttaatgatttgttatcctttttactaattctgtaagtaataagaaactagcatcaattagtcaaatcattttaaaagtaaacataggccaggggcgatggctcacgcctgtaatcacagcactttgggaggctaaggtgggtggatcatgaggtcaggagactgagaccatcctggctaacacagttaaaccccatctctactaaaaatacaaaaaattagctgggcgtggtggcatatgcctgtagtcccaactactcaggaggctgaggcaggtgaataccttgaacccaggaggcagagcttgcagtgagccgagatcgcaccactgtactccaggctgggcaacagagcaagactccgtctcaaaaaaacaaaaaagagtaaacataatctgcttaacagaagggctttagtcccccagatcatacacaaccctagtcttctgtgagcctctgtctaccatcggttctcactgtccactgagaacggagtagagcctatcctttgcttgttgctgaggatggaaagatgaaggggaaacttgcaccctgaagccacttagaataaaaggcaggactcttttcccaaggggaaggaggagcattggccagagatgcagctgacaagagacacagaggacaagcagctctggtgaaaatctcaggccctgggcccacaatttgactattaatactctgtcatctagttttatcaatactcagggccagtttcctgcatgtgccaggagccaggcatagaagggccccagggttggtttaaaaacctattgctggctgggcacggtggctcatgcctgtaatcccagcactttgggaggccgaggcgggcagaacacctgaggtcgggagttcaagaccagcctgacaaacatggagaaaccccatctctactaaaaatacaaaattagccgggccagttgtggtgcatgcctgtaattccagctactcaggaggctgaggcaggagaatcacttgaacccaggaggtggaggttgtggtgagctgagatcacgccattgcattgcagcctgggcaacaagactgaaactctatctcaaaaaaaaaaaaaaaaacaaacaaacctattgctgaccaggtgaggtagctcagcccataatcctagcactctgggaggctgaggtgggaggatcacttgaggtcaggagctcaagaccagcctggccaacatggtgaaaccccatctctactaaaaatacaaaaattagccaggcatggtggcgggtgcctagtaatcccagctactcaggaggctgaggcatgagaatcgcttgaacccaggaagtggaggttgcagtgagccgagagtacaccactgcactccagcctgggtgacagggcaagactctgtctaataaacaaaaagaaaaacctgttgccatcttgatattttttataatttttgggacagatgcagtggctcacgcctgtaatcctagcactttgggaggctgaggcgggtgaactgcctgagctcaggagttcaagaccgtcctgggcaacctggtgaaaccctgtcgctactaaaagtacaaaaaattaaccaggcttgctggtgcatgtctgtaatcccagctactcgggaagctgaggcacgagaattgcttccaccctgaaggcggaggttgcagtgagctgagatcatacctctgcactctagcctgggcaatacagcaagactctgtctcaaaaaaaaaaaaaagaaagaaagaaaaagaaaaacatttttaataatttttgaacaaggggccccacagtttgttttgcattggccccttggattatgtagctagtcctgtcaatcttcatcattaactacatctgaaatatgcaaaactcagtgagactagagtctgcatttcagatggaattcattataccctttaaaagccacttaatagacaaccttatacaaatcattctgaagtttcacatttcttcaatttaaatttatgacattcaactattttgaagtggtcctcaaaagtactatataagaaacatgttggctgggcgcggtggctcgcacctgtaatcccagcactttgggaggccaaggcgggaggatcacaaggtgaggagatcgagaccatcctggctaacacgatgaaaccctgtctctactaaaaatacaaaaaaaaattagccgggcgcagtggcaggcacctgtagttccagctactcaggaggctgaggcaggagaatggcatgaacctgggagaaggagcttgcagtgagccaagatcacgccattgcacaccagcctgggtgacagagcgagacactgtctcaaaaaaaaaaagaaagaaaaatgttaggctgagcatggtggctcatgcttgtaatcctagcactttgggaggctgaggcagggagattgcttgagtccaggagtttgagaccaatctgggcaatatggtaaaaccccatctctaccaaaaaaaaaaaaaaaaaagccaggcatggtggtgtgtgtctgtagttccagctattcagggggctgaaatgggcagatcgcttgaaccttgggaggacggagattgcagtgagctgagatcgtgccactgcactccagcttgaataaaaatttctttgctatactttaagtatgtaaacaaagaagatattcatttttactgagttttaaaattcactttgaatctaaagacatatttctaagcattttatatgtttgaagattgggtaattgaggaatagttaaataaaatcaaaggactagaaaaaataatttactttttaacaaagcacatttttagccaactagcataacaaaaatgtaatgaatgaagaaatgtcagctggacatggtggctcacgcctataatcgcagcactttggagggccaaaaagggcagaatgcttgagcccaaaagttcgagaccagcctgggcaacataggaagatcccgtctctacaaaaattttaaaattagccaggcatggcggtgtgcacacctactcaggaggctgaggtggaaggatagtttaagccaagggaggttgaggctgcagtgagctgtgattgtgccactgcactccagcctgggcaacagagcaagatcctgtctcaaaaaaaaaaaaagaaaaatgtcacttttctaaactagttgtagtttgaaaattctcgtgttttttccagtccctttcattaagttaagccctgctcctggaaccaggatattgactctgcatgtgtctgggtggctgtcccccaaacactgcatgtgtagccctgtgctaggctcagatttcctaagaaatctacagaaatcaaggcctaggcctcagtgctctcagtctctcttaatgtgtgaggtggtaaaaacaacagactgtaggcttggatgcctgcaaaaatacaaaggcgtgataaaatttagtcctcaggaaagctgaccaaaggctcaatgtttttaagaaaagggttgctctgtgagctaccaagagccccacagcagcagagttcaaacagaggctgaatgatcaacacacaagaacatatgaggaaatgtctgttttacagggaaggctatttaaagtatagaggaaagaactttcaaagttcctttcaactcaaagtctaaagtccagagtagaaattatatgagagacaatggcaaaggaaggaattggttggatgaaatgccggtttgcacctagactaggaaaaattcaacttaaaattctaacaaactagaaaactgtgaaatgtgtatttgattcgaaaaatgctcctgtgagtgactatggaggtcaagtggatacaggatggtgcagccactttgtacaaccaactggtagttcctcaaaatgttaaaaacacaggccgggcatagtgctcacgcctgtaatcccggcactttggaaggccaaagcagctggatcacttgaggtcaggagttggagaccagcctggccaacatggtgaaaccccgtctctactaaaaatacaaaaatcagccgggcatggtggcaggcacctgtaatcccagctactcgggaggctgaggcaggagaatctcttgaacccaggaggcggaggctgcagtgagccaagataacatcactgcactccagcctgggtgacagagtgagactctacctcaaaaaaaaatttttttaatttaaaaagttaaatctaagagttaccctaagacccaacaattccacttgggtatacacccaagagaaatgaaaacatatgtccacacaaattcctgtacaaaaatgttcatagtaatattttccaaaattagctacaaagtggaaataacccaaatgtccatcagtgaataaatggataaacagaatgtgttatatccctacaaggatatattatttacctatgaaaagaaacgaagtcctgatacatgctacaacatggatgaaccttgaagacatcatattaagcaaaagaagctagtcacaaaaggccacgtatgattccattgatgtgaaatgtccaaaataagcaaatccatagacagaaaatagactaggggttgccaagggaggaggagaggaggagggagatggagaatgattgctaacagatatgggatttcttttgggagtgatgaaagtgttctgaaattagatagtggtgatggttgtgcaactttgtaaatatactaaaatcactgaattgtatgccttaaaaggttgaattttatggtatgtgaactatacctcaataaagctgctttaaaaaaaaaaaaaaaaaggagtggatgcagaaaaaggtgggtttttttgtttgtttgtttgagacaaagtcttgctctgtcacccaggctggagtgcagtggcatgacaaaagtggtctttttttttgagatggagttttgctcttgttgcccaggctggagtgcaatggtgtgatctcgactcactgcaacctccgccccctgggttcaagcaattctcctgcctcagcctcccaagtagctgggattacaggcatgtgccaccacgcccagctaattttgtattttttagtagagatggggtttctccacattggtcaggctggtctctttctcccaacctcagatgatccgcccacctcggcctcccgaagtgctaggattacagacgtgagccaccgcacccagccggtggtcctcctttgtcctacacaatgactcagagaaagtacagatcaaggtaggcttgaaaagtagcagactcaacagaagttcttgtcatgggagaatcagacagaacgaaacagatggctgaaagatgattcttcggccaggtgcggtagctcatacctataatctcggctctttgagaggatgaggtgggaggactgattgagtccaggagttcgagaccagcctgagcaacacagtgagacgccacttctattaattctttttaagataatgattcatgtctgaccaaagaagtaaaaaagaaaaaacatgactcttcttttgatatgctatcacatacttcttattggggttccggaatgggaaggaagctttcagatttttttctttttttgagacggagttttgctcttgttgcccaggctggagtgcaatggcaccatctcggctcaccgcaacctccacctcctgggttcaagcaattctcctgcctcagcctcccgagtagctgggattacaggcatgcgccaccacacccggctaattttatattttttagtagagatggggtttctccatgttggtcaggctggtcccgaactcctgacctaaggtgatccgcctgcctcggcctcccaaagtgctgggattacagttgtgagccactgcacccagccaactttcagatgttttataggcatttaagctgctttaaactctgctactttgaagtacgtgaatctctgccaagaatctttaaaaataaaaactttagtaacagatcttgtgaaaatttttaatctaataataatatcctaaagctaaatcaaaaaatgagcaaaaatatacctaaaacataggagagaaagaacctatcaaatcagggacaactgaaagcagcattctagttcccgggtggtggcagctcttagggaaaagacgggtattgtatgtcaggctgacacagtggggaggctgtcgccatttaagggttcctatatatggcctttgcatagcctcaaaatgtcacttttgagggtctgttagtttggcttttttttttttttttttttagagacagagtcttgctctgtcgctcaggctggaatgcaagtggtgtgaccttggctcactgcagcctcaacctgccaggctcaatcagttctccagcctcagcctcctgagtagctgggactacaggcatatgccaccatgcccagctaattgttttgtatttttagtagagatggggtttcaccatgttgcacaggctggtctcgaactcctggactcaagcagttcacccatcttggcctcccaaagcactgggattacaggtgtcagctaccatgcctggccgtttgggtttttttttgtttttgtttttgttttttcctgagactgagtctcactctgtcgccaggctggagtgcggcggtgtgatctcggctcactacaacctccgcctcccgagttcaagcaattctcttgcctcagcctcccaagtagctgggactacagatgcatgccaccatgcccagctaatttttgtatttttagtagagacagggtttcatcatgttggccaggatggtctccatctcttgacctcatgatccacccaccttggcctcccaaagtgctgggattacaggcatgagccaccgcgccaggccttggttgttttttaatgcacgaacatgacattgcataaataatttccaccaatcttgaatctgtagtcctgaaacactactaaaatccgtattttgtagcaaatcaacattttaaatttcacttataaagacatatttcttcaagcaactctttttttttttttttttttttttttttgagacggagtctcactctgtcgcccaggctggagtgcagtggcgcgatctcggctcactgcaagctccacctcccgggttcacgccattctcctgcctcagcctcccgaatagctgggactacaggcacctgccaccacgcctggctaattttttgtatttttttttagtagagacagatggggtttcaccgtgttagccaggatggtcttgatctcctgacctcgtgatccacccacattggcctcccaaaatgctgggattacaggtgtgagccaccgcacccggccccttcaagcaagtcttcacaccaaattaagacccactaaaaaaacaagttttaatgatctaagccctcaaccagaatacataagaaatagactcttggcggttttttaggataatcagatctctattttgtttcaactcttataaatgaaaactacccaaaaaaattaaaaaacatactttcctgtctcagaaagcaataataaaaataactcagtactttttttcctttgttctaaaattttaacctatctcagcttcctcattttaaacatttagacttggtttaataagcttcactaagtcctgcagctagtgttacgaaattacagcattttctattttcaatgtaatattttatatcccacaaaaatttcattttttggtcatattcttcataactaaaactgaaatattatttgcgtttttggcttgaatatcaaatactggcacagataatgtatgttatgacctcctaaaccttccttttgaaaaataattcctataaaactgcttggtttcatgctttttctcccaaaagaaatatccagccaaaggacgaattccagctaactgaaggttccagttaaccgagtgaatgctctaaaattggaatatattcaaaattgttcgtattttattatttcttcagcagttataggtctcctttgagaaataaatgttatttactttcagtattaaaaatgttagactatgggtaatactgaggtctatattcgaacgacttttttccacatcgttacttctgaaaaaacgaggtaacaaattaagaaaccatcttcccaaaaaagctgaaaattatagtatttttaaagggactaacaggggtagccacagagctacagccttcaaaggctgagacagagtttcatgatctaatatccccaatactgcaaccaacagaattgatccttgaactttttttttttttttggtatttttgtagtgacaaggtttcaccatgttgcccaggctagtctcaaactcctgggctcaaacaatctgcctgcctagttctcccaaagtgctggaattacaggggtgagccaccgaggctggccccatgatccttgaaaatttacccactaatgaattcccatatcgacactgcagaatttaagtttgggccgggtgcagtggctcacacctgtaatctcagcactgtgggaggcagaggcaggcggatcacttgaggtcagaagttcagaccagcctggccaacatggtgaaaccctgtctctactaaaaatacaaaaatgagcccagtgtgatggcatatgcctgtagtcccagctactggtgaggctgaggcagaagaatctcttgaacccgggaggcggaggttgcagtgagacaagatcgcgccattgcactccagcctgggtgacagaatgagactctgtcacaaaaacaaaaacaaacaaaaaaaaaacttaagtttgctttacactatgtaatttttttcagtatatagcatttatctgtaaagtgaaaattaggatgcaaagctactacgctgtctaaactgaaatgctgttatccatccacccattcattcattcaatcacacaatactggcatgcctctggtgtgctggtgacgggaaacatatgcaaagcagatacccttccatcttggggcatatgttctactgaggggaaacagacgataaacaattcaataagtaaacaacaaggcatgttagaatgggctaagtgctatgcaaaaagaaaaagtgttgcagggaaacaggatttaggggttcaggaagagaaattatttcaaataggatggtgaggggaggtctcactaagcctatgtgcaaatggaaaagtaacagtgaattttatgtattaagtggcttcgaaatgcattacatggttgcattttttaaatattcatataagctttctattttctctgcttcactgttctatttcccgatctccatgaagaaggcaggtagctgaaggacatgaccgtccagggcatgccaaagatatttcttctaatattttggcttactgaatttgtttttaagatggagtcttgctttgtcacccaggctggagtgcagtggcgcaatctcggctcactgcaacctccgcctcctgggttcaagcaattctcctgcctcagcctcccaagtagctggagttacaggcgtccaccagtacacccagctaatttttatatagttagcagagatggggtttcaccatgttggccaggctggtctcgaactcctgacctcaggtgatccgctggcctcggcctcccaaagtgctgggattacaggcgcaagccactgcacccagctctactcaatgttttttgagaactacagctataattaaaataaaatttgagggtctctacaaaactaagagtcaagatgcaatttatattagaaaatctatcattttctgcagcagtctgtacgtaatctaacattaacaatgattaaaggtagctacagcatgaacaggagttcatgtcgtactgccttacagccgtaaaaaattcaattagttgaaatgatctcttaaaacgagcccacagagtgtctccaaactgtaaatttacatatgaaattcacttgtaatatttcaaaatgaaattgtttattagcatttcgtgtaattccaagacattttctaacttgcaacctgaaaaaaatgcatacgaataactgatgtgtaaaatgtctttattccgaagactaagaatcttgaactactgtaactgcaccaagaaaaacttagagaaagcaaattacaaatgactcaactagccaacacacctttcacacaagatttctgtcggtctcaggtaatgaagatattcaaagttgaaatgtatgctgtttaagtaaccaaggcaattaaataatgactaacaaatgtaggtgctatttaagaaagcaccaattttaacaagaaatggtatcactgactaaatatacttaaactgttcccaaaatacccaatccaagcacatatttttaaaatgtgtgggttttccccaagagaagcaaaacttttgacatttctcttggatatattagagtttcagacctccaacccacatctggaaagaacatttcaaacttagcttgatgttacttttaaaaatcaaatggccagcaatgagatacttagtgactaagatctgaatttgacagagtcaacagaatgttagaaatgaaataaaagaagtattcaaagtttatcatcctcgatgtttagaaaggaacatggaacaaaagatgcatttgccgcctctgccctttaattcgtgaacaccatacttctctccttatgtcacgccagggaagggaaaataagaatttttaaaaagcttgctaaattcaaatatgaccatttcatctagatttctatcaatcctcctccccaaaatttcttttgattaaaaaaaaatcagaacaacagatttaagcctacagtagattctacagactacacctagattactctgctctaaggccaaggaaaatgtttacgatttcaagatccactcagaagcaaatactgtatctgcaatgcgtaagcttttcgttggcaagaccagtcaatagcagaggcatgcaaggtttaaaaggttaagtggatgaaggttaaaagctaataataaattagccaagaaatactacttcccaccgagccataaaataatttcggtcctacaatcctaaaaaaccagagaggtttctcgtttttgtagagaacatctaaccctccacggtctaaatgaccgtcagaaaaacagcaccaaggcaccaggggtagcagagacggagatttctaacactgggtgagcccgcggtcgcaaatctcatcgcgatttcacctttgggtgaaaaggtgggagggaagcactaagtttcagcctcggctccactggaaacagacaacgtctgaaggactctgggaggaggcggaaaggggcgaagtcgtggtgtccgcggtgcagcaacacagaatcgggatcttggaaacgggatgcggaggagtgggctcttatgtaagcacacaccaaaactgtgcgtgcaccccccgcctgatgcacatctgagcacacgtacacagagcatctcacccaggggtgcagccccagcctgcgtgcgccgctgagcagggcggactgacccttcggcccgtctgcacgttcccccaaatcagcgcagccaccaccatgggctgcagtgggggcagcccaggctcaggagccccgcccgggacggagcctggcttccccgggacgcctgcagcgcgcgcccacagtctcctgcgccctggccccggctccgcgagcccgacccccaacccgaaccccacgccctgacccggctccctgcgctcggacccgactccccgcatcccggctcgaatcccggcatccggccctactcccgcacccggacccgaatccccgcaccgggacccgaatcctgcacccggacccgaatcccgcaccgacccagcggcccggcccagccccggggcttacctcgcgcggcccagaccccgccgccgcacagcagcccggccagcagcagccgggcggccggggccagcgcgggagcggggcggcgcagcatcgccagcccggggcgggagcggcagggaggcgcgcgggacgccgagcggagctctcggagctctcggggctctaggggcctggggctagctgctccgcggcgcggggagctccgggggtccaaggaggagccgccgccgccgccgccgtgacgctgggccgcgcgctcaggacgcggcgccctccccgcctcagagcagcgtcttgctgaaggcagcggcagcaactaagatggcggcggcgctctctctcgggtccggcgagggtacccggccgggggcggggtggcggcgggaggggcggggatggggagcgacgcgaggcgcgcgcgcggcggaccctgggagcgcgcgggcccgggaggggcgggggagaggagcggagggagcgcgcgcggcggacccggcagcgggcgcgcgcctccgagcccgtcggccccgcctggagcgcgcgcccgcggggacgcgcctggggtgggttccgagcggccgggaggggcccgggggactgtatccctttccctggccgcagatggagagcctcaactccgcgtccctacgcgcgctcccgggctcctaaggccgggtgagcggtacccggggacccgctcctccttctccaccccgaggactcatccttcccacccgctccgccgaggagcgcagaccccggcggagcagtgcggcccaggacccttgtcacttcgggcaggtcgcgtcgccccccagaacctcggggtcctcgtctccccagtagaggt

SEQ ID NO: 351 - DNA, 95472 bp, Homo sapiens; identical to SEQ ID NO: 350

SEQ ID NO: 352 - DNA, 621806 bp, Homo sapiens
tgctagttcacagaaagaccatttttaatatgaaaagagaaaaacaatttgaaggccccacaatttgttgtgtaacaacataatttcaagtaaagtgaatgtgattaaaacatcttgatttcacaaagccattcagaggaggcttcgacaaacgcaaagcgacccaaaccctggagggtcacatcccggctgctacaaacctcggcggggcggccccgctcttgcggccgggacagcgcagcggcagcaggggccgcaggggacccgcagattggcacgccgctccccatccccgcagcgcgtctgcaccggagactctgcggggattgtagccggagggcgggccgggctccgaggcgctgctcaggcattggggtttgtcctcatgagctccacgtcggcgtgcaccatctccctcaccagctcctgcaacacaggggtgggcgtgagggaggagcttctgccactctctcctggtgacaccccaccccgggtgtcggccccagagaggcctccgcgtccctcgttccagctcccctcacttctcccgcaccccgccttccgggctttgggcatcgcaggcgcctcaggcgcccgaccctgagagctgccgccctgcagcccggggccccgcagcgggcggcgtgcgccctaagagatactcacatcgaaagcgacccggggcttccagttcagcttctgtttcgctttggtgcagtcgccctgcagaaagtcctagggaagaagagggggagacgaagcaggcgtgggtcgtgggggtgggggcagcaggtcccgagccccgggaactcccaccgttccgctccctctgggcgcacaaggctccgggtttccctgctttcggtccctgctgtgcgcgttcagttgcggctctcggcgccgtaaatcactaggtcgcggttaagaatgtgctgtgcggacccgtgaggaccgtgaccgcgatccacccccagctacctccacacctcttctccccaaggcgtcccttgggctcttaatgctttttttttttttttttttttttttttataacatgaagttgtcagggacgctcctatgagaactgtttggaattgctgcacttctctggctaggagggaagtgagtaaatcaccaggcgcccctcccagctgcccgtgtccctgcgccgctcagctcctgccgcagggctggccgcgccaagcgcgcgtcctacccaaagccaccagccccgcggggaagggactcgggctgtggggcgcgaggccccaggactcggggacccctctacctcggcggcagcgtgcgaccctctttctaacgcggccgtggatgtttcttcccgggccgcagccaagcgcggttcttcctgggcggtggctttgggcttttcgtacccacagtcaagtcagttcacgtcgcctcccgcacacacgcgttcataaaacgaaactggagtttcacgaagcaattcttaggcttagcgtccaggaacgctgtagacggtctattctattctacccctattctactcggttcgattctgttcctaagaaaatgccgatctcgacccacttgtacttccacgagcggagctgcagccagcagctctgcaggaccccgcactgcccgccaccgtcccctctggcagtgccttcctcctcccgctttccccaactgctccactcgaggaaacaagggcatttcatctccatcgacttaagaggcttccctggaaggaaggctggctaaaagaaaaccagcggagaagaacttaatcctgctctcagcccctactcaccaatgtctttcttacagctctgtgaagactgactgacatgaaggttgagatgagaatttcaagatgaattacaaaataggaaagaaggaagaaaggaggaaaggagaaagggaggaaagaaaggagggaagaaagaaaaaagactttgagatacataattgctagaagtgagataaatatttagcttttgcatacacaaatgtactcgtcaaataacacatcagatgtgattcctcgaaataaaccgaacgcaaaggccgtacgaaaatagccgatctttaaaggtgagaaatactcgatcattctatttcagctacatacaaattaaagaacagcctaaaaggagtttcatcgtgtgaaagtaacagccagtcaagctgccactgaaagcctttcctgcttattttcttcagacttccctgaaacttggcaggtggggaatttgttctagattcatgatggtcgagagggcaggggtgggacctgctttgccctgggtttggagctcaccttctctgctgagccttctagagcagaggctgtctggatcctgctgaatgtctgcaccgtgggcttgcaatggggctgcagcagtacacgcagcgactctcgctgtcgttctcatcatccatcactactttttcaaacgctttgcatttcgcaatacactgaagtaccagtttcctccccagagtgttaatagtactaaaacaagttatttctgctggccctaaaagtccatatacagattcttcaggaaaagtagaatacaaaaagtagtaattagcaatttaacatagcgctacaaggaaatagcaatataagcagaaaaacgaagtaatttatttttctttcccctccctaaataaacttgtatatatttctacaggcttctattttgctataagcgtcacacaaagatactcattctttttccccagaggaagctgtgcaatgtggagtcatgcagcccatccctcccctctctcaatcctatagcggctagacggtgtggagaaacatggttattgtttaatcacatcacactggctgtaaatcaaccagcacgacataggatgcatttcatggctgtgaactcatagtcagcaaaaccctaaaacccagtttggcttcaaataatcttggtaggcttgggaaatggagctttgtattgtaattatgtttcctgtagttttctacaagtagctcacaatataaaaacaaccagggaactacaattaaggaaaaagaaaaatgtttttcaaaggcttagaaacagaccttgctaccatacactgtaaaagtatttcattgaaaccagagacgcacccagttaaacttctcaatttagttttgagcctagctccaatactgcagtctagctgcttcctttaaccttctgccaaggctctgtctccctgaaatttaattagaccaagagaccttgggaagaaaaaggatgaggtcccctcagaacaaaacattggctctctatgccagctgttcctaggctgacatctggactgggcagtaagcttatgttccaatcaacttttaaggaaagactacgagcatcccagcttgttttacacttaactgttcctgaaggaatttcttacttcttcccattgtgtcatttatagaaaagatatagtcaatggttcatcctgcaaggttctaggcacaggacatacttaaagggtggcgtggggagggcctgtgtgggaaagcgcacacagctctagaaggagagcaaggatgtggattcccttccttaaataaggcttcctctgggctgagaaggaattaggtggtggcaaatgctcatacaacggggtccaaactgctgtgctcagatacagaactgtgaggagtgagaggggagcgtgggccatgatacacgtccctttaatctttacctccctcttaaagatttttgaacttccacaaatcccctccaatagggtataatcagctcctaaggacaagagagaagaatgagcttatctactgtgctcttttcttcttttttgacagttcgtttccttcattatacatatgcttacagccttagtatgacaatgggggcaaaagctgaattaaagtgatgattttatgtacagcttcccaaaaggacttccaccagtgcaactgggtggtctggagcttttcttgaaaaaagagaaaataaagctttgagaaaaatttaaagtatttctatgtgaatatgacatttcctgaactctggcttctggtgtcttcactgttttcattgctattccttaggtgaactatacggtttcaatatgtaatttataattgtcaaattcaattaggtttcactgagcatttcacagcagcaaaacagcaggagcaatgtctccgtccacacagccctccagatttctgactcacggactgtgtgtattcatttgaccttcgggagttgtcctttagctgtaccatccaggcatacatttacagagctgcaaacagcagcatggaggagggcatgtttggctgcagccattttttaggctttcctggcttacgttcttgttaaagtgaactgataaagcgccagaccaaatgctggaaaagtcattaagcctgtttctgagcccacagtagttaacgcaaactccagaaaaggagagaccatagtgtgccattatcttctaccctaacgacaggtccctttcctcagatctctcccatctagataacaacgcagctttaaaatcacactggttagttttcattccttcccccgatgttattttgatccttctttaacacatttattgcctgggatcctcccacctccatatcactttctctaaaaccattgtggggaatgctattcaacagactgtatcacataggatgattttttgaggttcacagtctcatttcattttctccccttttcactgagtttgctttgggaaaactttaatatttagttcaaactaggtgttggatgccacatttcctcaacaggtctgcttataaggtttgcaaagaacatctgtttaggtggagaaatattctaagagtatgagatcttttggcagattattgttaaatttctaatgtacatcttggaagaaattgactcttgatgccctaaataggagaagatgtatggacagggatgttaataaggaaagccgagactgatgaaagccttggcgaaatatcttcaggaatttaagatacagagctgtgaggggcgcttaatattctttttttcccttctacttttcttagaaaagcaaaattgaggaatagctcaggttccaagggaataaaagaatgccagtgaatttggttcttgatccaactttctgctagtgtagagtgaataggaaagcttgactcttggggcaatgtttctttttcagaaaggcagagctgctaaacaacaacaaaaagcctcaggaaaaagctctcaagtctcacagagtatcctagtcaagattccagatagttgagaataagactgggaaataacaaaaaatgaattctgaaagatcccccagaaaatttgcaatatacgacatctcttcttgggtgtagcttgaagccttacatgctcacgaatttatcctttggtttaatccttcccaaagagggagcgaatgtccgagcagtaagaaatgctgtggtgttaacagcggtaatgaacatttcccctctgttcccttactgctgtctatccacacaaactgaagtggaagtcagacctctcctttcatgacaaggggcaataagagaggagaagaaaacagcaggcggtcctgtctgctcaggaagcgggactcggtgggactgtccgtaggcagagctcaaacaatgctcaggcagcctcagggaaatggagtcagtcagcactggcccgaggagggtgcaggcagtggagaggaagtggcagagggaggagcaggccctgcaccatggcctcgtccgtggccacccttatggaggctgccgtgtggcaatcagcgacggtgtagacttggaataaaaccaccactggacactcccactgtcgccactgtcacctctgctgggagcctccttagatgactccggacgtgcggtccagtcctcctgcatggtgcctaatgggcactttaaaatcctctgaccacccctctcgccgatcccacttttctgatgggatctcggtagaatttgtcatttgggatcagcggctgttaagcactactaaacaaatggaaagaaatgcatccatccgtatgcatgccccagaaaccagcgacaaagtccggctagtacagtagagctttcgtggaaagtaaatgagaacgtggtcttcattatatgcctacttgtcaataaagcttagggtggtaaaaaaagttacaggtgttcacttcaggaaaggagaacttaatggcatgtatagtgcaacctacatataaatggatcttttttcatttatattttaaaaatatggttgacatagttgacataaaacaagaattgtagttaagcaaaaagggctcataagctacacagacaacataattatttaggagaaatacaggatttaagcaagttaacttccttttaaacaaagttttaaaacatattctggagaaagccctttctagcagacatgctggagatgtgtggagatgagtgcggcggtcctctttcctccatgggacgaaccgcatgtggcctatgcagtttatgccaccccaaagcttgttcctttccccagaccaggcggttgccctggctgtgtccgcctgcccattggctgcctggcctttgactgggacagaggagcatgctccccacctcctgagtggggcccagcccaggaacatgcccactgtctgccctgtccagccctgtgcaactttgaggccttccccgttcaaccaggcagcagtctgagccagctgagcagaggaaagcacttctcagaggctgcgctgggaagcttttggggagctgcctactcataggtaggtgtctaacaggtttctttaaatgaaataaccatataagactttggggatgtcatcttgcatcatacctatttacaaggtgctgcgtctgtctgtacctgttctacatctgaattgcaatcgtggagttaattttttgtcagctttatttcttgatccggtgcttacagtagcatcagcctggggaaagctagattaatgactgtaactagagccctcttggttccggttagttcactgatctccactctgacgagctgagatggggggtggctgactcatagttgtgatgcgggggccatttaatgaaaaggagataaggttgtcagtgacctcagcattccaggcttcaaagccagcaccatgttggtcggaaattactggttactgttaataactggatctagggtgtaaagatttacccatgctggaaggaggtggcaaaaccccgaggacaggagataaagcgcctttgagtggaccgattagggactcttgtgacatcgctggcaagtggcaccctggatacaagaggaaggccgctgtgctcttgccacttagggctttctaccctcaaagcgctttatagacatcagctaattaaaccacaaaacaatcacatccaaaatgcaacttaagagattttgtatctgttgcaggtggcctctttcctagagatgaaagttctgtgcaaagcaaagtatctcggaggtaaaagctaaagtacttgtcatctggcttatctttaccccgcaccttctcatctaggaatgcctacctaggccacaggggatcctgaattgcataagaggaaggtaattttccttaagcttgtttccttctagtttgttaggaaatctacccacctcttagaaatgtccccccctccgccccaccaccactgcttcggacatgagtactacacagtacaatgtagatggggtttttttcctttgtggtttttctcaatgtatacagtatattaagtcctccaattcaacacacctcacttcaataatccttccttcctccctccctccctcactccccttcctccttctccccaatccaaatataaataacgtaacagggtcattcaaacagggtctatcaaacatatacccacaggctcctccaaatattcattccctcagccacttcttaagcaactcaaggcctagccaaacacctgaccacatccagattcttgctttttggccatttctctggggacttttatattggagaaaagattaagacaattactgtgatatctgttagcaaatttttggagaggtatggagaggagatgagcatgatgacaactctttaggtttactataattctgttatcactcatttggccacccatcatcacaggaaggctcagagggttttgtcaggtgtctatactacatggtcacctggcattccttctttacatcttcatgagaggaacaaagtcctataccgaaatgtatctgcagaggtatttcagccaagtacttgagaatgtcacaaagtcatctagtggtcaggttctgccattcctagtccagcagtcacaacactcaataggacaaaaccctctgtagaatgtgttgtaaacaatacactttacacacattaatttgagtggcaaagaggtctctaagtaatagatggtatcaacacacagaaatatcaacttaatgctggatggaaactgacacagaagagtccatattgtacatattgtatgatttgctgtatgtgaggtcccagaagaggcatccatggttatagaaacgagactggaggacaggggaggagtactgactgggaaggttcaccaaggaactttctggagtgaggaaatgctccttatatgaataggagtgtcggttacaagagtgtgtgcgtttgtcagaacagatcaaactgcagttcaacatttgtgcatttcacagtatatagattttatctcaacacaaaaacgtggccaggcatgatagctcatgcctgtaatcccagtgctttgagaggctgaggtaggaggactgcttgaggccagaagtttgagaccagcctgggcagtatggcaggaccctgtctctacaaaaaactttaaaaaattagctgggtgtggtggcacttgcctgtggtcccagctacttgggaggctgaggtgggaggactgcttgagcccaggagtttgaggctgcagtgagctatgattacaccactgtactccagcctaggtgacagaatgagacttcgcctctaaaggaagaaaaattcgtggacacaaccaacatggcggcattgctggagagacctggaatcacaacgtggctcaaccacttaactctttcttaataactctgagattcaggttttaaatctgtaaaacggggacagcaaggcttgcaaagttgtgtgagaattcaaaattgcacagctgcttttaacagctagaaccatttctaattcatcctatacaggctttccattgaggctattatttatcactaaaatgtaggaaaaacgattcttttcatttcttgcagtaacatcatggatgaagatgtaatatttttaagtgggctgttttatagtttttctttgatacttacatgcaacttttaccctgcaccccaacccttcctctaattttagataatcattttctgaatagctgtaacagagtgtagaagattttgtactctgctgtccctcaatttctgcaaacatttcacagtctcttgcttgcttgttgccacatatttactgctttaagccttggagaagcaaacgtggacaagagaaggccgtggctgtcatgaagcccatgttctagggtctggcagcacaagagttggcggagacctgagtttcggctgatgggagtgcgagggagcgactgcagagggggctggcttgttggagggcgggagggcactctgtactggctgggcggggaaggccttccacagaggtcactggatcagagatctgcacaatgtgcacgggccggtcacagaaagatctggggtgtgagggtctcttggggacactgcaggtaaaaaggccttaagggaaccccggagagaaggctgctgtgactgggcatggggagtgacggggagaggagcccatgaccacgaggctgggagggacacagaggcaggcactgttggcctcccgggtggtttctgccatggagcccaggcctttcccagcaaagccacgtggtcacaaggctctgctgtctggtcacagtgactgccttggagtatctaccgcctgcaggctgtggctggaggttggaaagctggctacctcaacctgatggagcttacaattctgactttctggtgccaatttttgaaagtatggaactgactataaactgtcatttagctgtgtgtctttttaaaaaggtggacgagtcgttcttgccctgcatggcccaactctaatacataatccctcttcccctggaaaatctgccactctttgatgtgcttggtccacctaacctaaaagcacctggcgactcaggtgctggccactgcagcgggactgcacccagctggccctgaaagacatggagactagggatcaccagaggcagtaacctggccatcctattccagcacctgctagggtgtgctgtgatagggctgtccctcttctggccaaatgaggacacgctcagcctctgaaggctactgagatgccgctccacccttcatttcctcctgcctgaagtgaagctgtgaccctgagctccccttgctggttaaaggccttctcctttcccagtagctctcaagaggatgaggcacagcactgaaacctgtctgtgttttgaaaacatttttaccatactcttgtgtgtatgtgtttttctctgtctctctctgggtgtgtctctctgtgtccatgtgcactatgtaaaagtccactcgtttacagtgagaacccgctcactttgaactccatcctttaccggcccagcacatccaatatggagtctgggctttgcttagagccacagtggggttttaagtgctgggggcatatgctgcgatgcatgagttcaaagatgcctgcagatgctgcctgtgggttagaaagaggggcaagagcaggggagagaccagctaagagactccagtcacagatgtggtgagagacgatggtggcctggacacgaggggtggggaggggacatagcgacggaaaggcgtgggtgaacttgagatgatcttggagaaagagcagaaaaggcctccctggggttggaggcggtggtgggggaaagaggactgacagagaactcctaggattttcatctgaatgagaacgtttttattgctttcaaagacattctacgaatcaacaatgccagaagcgaagttctcctagtggagtctgcgtgtgcctctcaccacagccctgccagcattacgtgtcatctcctttttcacgatttcaagattagagaacagggactcttccaaaagattacttctagagaatcacctgtgatctctcatatcattccatggagcacgccttcttgttttgatcctgatttgaggccaaagcctctctgctgagcaagtctgcttagctctgggaaaggggctccgtttcacatgtcctggctatgctcctgtgaaaggcaggctgaggggaaacagcttgtcttcttccgtgaccctggtccacgggacaggcgaggaaagggttaaggcaagctgtgtccactgcgcaaccaacatggcccactttcatcctccggctgcagcaggaggaagtccgagagggggcctttcacatgacatcataaaagcctgatttatcgccggccaccaaacatctagaaaatcataacatcctttcaggaaaatgcagtggaaaataatcaggctgactttgatgggagctttggtggggactccgagggcgacactgtgcggcgacccttggcaggtgctttgtttgccgtcggggccagcctcactgacaaggctgagggtctgtgctgtgcaaagcccaccggggggtgtggccctcaagtctgcagatgcaaacgagagcctggttcatactctgccaacttgcctaaaatgatactgcggtggatgtgaaggcgctttggaaaagacagctctatccaaatgtgagaaattactgattacagccttgtacataacccacagccactccaggcaagcagggcccagcctcggcacctccagcactgcgtctgggagctgctcttctctgctctcagctggggctatctttaggacactactgtttggttagagccctttcctcacaaggcacttttcctacgtcgcatttccagagtaacctgccaccgtggcagccctcctcatcacaaagaggactaggagacgacagaaaagagacattcccagaatgtcagcggaaatagaaataaagggatgagatccgcgtgccacgaggaatctgttccaggaatgtctgcatctcttcggtgcttctcttgctcagtaatttgatgaaaccaccagcaggaacctcttctttgatgtgcacaacatgctctccaaataaacacaggaaagagggacaagggtggcctagagtgtgggatagttctagaaatctggccacatcaattctaaaaagcctgttggcgtagaaagtaggcccatctttgcaaagtaatgcccactctgaaggtcttgggattcctgagtttggagaagacagacaatataaagattgagccagggctgacaaagggctagcctgaggctgaagttgggcaaaaatcaacccttggactcaatcaaagttactttcacttcatttaactgttatacaaggaagcgtgcagcatgaagatcactcacaagatgatcaagagactcatgtgagaacacagccaccaacacctctctggccgtcctgaaggtgcctggaaggttggtgctgatgcggcccccatggaggaacgggctcccatggagggatgagcccccaggatggagagctcagggcctagcctgacaccatgagcctaggattgggggcactggctgccacacaggcagcccttaccacgctacggttatgtccttgcaagtttgattcttacccgtaccagtgggccccggaaggtctgcccatgcctcacctgcccaaggttctgtgcaggaatgggaatggcgtggaaggcagcagggaggagaggtgaggcctaggcctggccctgtagcacaagctctgaacctgggcttgcctcacctgcacacgggggatcgctgggaccggaagaactctaacggcccctctccaagctactgcttgccattctgccaggcctgctggtgctcgcataacaccttgagactgcttcttgccttggggaccccgcactgtgcctcctagcccagcgccaggcatggctccaggcagctgtggcagcagagtggtaggactgaaggtgtcccagctgggctccatctggctcgttgtctgcactgagtctgagtcaagccaggtgtctgggggagctgggtgactcagcagattgtcaggtggcaaagggtggagaggcctcccttggccctggtctccctgcacctctgcccagtaaggcctttccaggcatctctccaggcccaggagccccgcagctgggcatgtgcttcccggccggccccgcagacagcacttgtgaggaggcaggtggcctggagggcagaggtctgactcagttctggtgtgctgaacaaggccccgaggaaactactgcttcaaactctcccccgtgaaggcacggctggacttccggggagctgtcacctgtgccaagtcaggctctctgggtgcttatgctctctcgtggctataaagcggacacttgtggcaccttattgccctgggtggagcaggtcactgaagcacttgcatcacacataaataatggcacaaggggaagcacgttccgcaccagcacagatcataaccaaatgcctgacctactgcagactgttgtggggacagaggcctccatgcagaaggctcccaaggggagttccctctgcagtgggccagtcagtccctgcactggctgttcagaatgggttttttaccagtttagacaagggttccccgagggcccttagaccagcagcaacatgccccctgtccttcagccttctaacagtcctacgaggtaggcaaggaaacggcggtgctggtaagtgggtaacttgccgtgtgccactcgaggtggatcctggattcaaacccaggcttatctgactccaaagactaggttactagcccattaacctagaccacctcccctgagggtcttctctctttagttatgtgtgctgacacttggtaacaataaatgcaaagccatgcgttcaccaccaggtagaggctgaggtgtgtaaagaaagcatttgccaacaacacggacagaagagagagaatgtgcttctgcgctacaggggtccagattagattagagcagagacaggaatggaacctaagagttagaaacaaaggtggggggcatgagagacaccaggcagaaatgagcatggtctcttcatgtcaaagccccacactaaaaaagcctgatgccgccctgggtttagagcaaaacaaaaattccactgcttttctccagctggagatgaatggtttcacagagggaaccctggctgaagaaaaagcatctttgatttggttaattaacgtagctttctcgaaaacactgatcagctcctcgagtgccagcaggatggccatgatcctgaactttatacttatgagcagcttaaacacaggccactggctgtgtgcccatggattcattctatgccccacccccccaacccccgacactatgaggccgtgagactcccagacttcctcaggcaggactgggctctggggggcattattcaaggaagtattgcctttgaggatggcaaggaacactcagagccacctgacatgggaactctggggtttgggatactaccaagggacctttgcttggtatctgttcccttcagagcactcttttctatgaaaggaacccaagtcacagaattagaaagaactctctgggtcttattaatgctaccaccatgactactaacagaaacacaaatattccttagggtgtggagactgagggagaccatgttttcaggtcaatgggacctgcatgagtagagtgagtctggaggtacataaagactttatctacaactacttagctcatgagtctggatagtgagagtgcagaaagaaagagacaccttgaaatcttcttattccatcctggccaacattcgttcatacatgcagtcagcccagaagctcaaggtcagtgatggagactgacatagatggtgatctccgacaggtacctgtgtctgcggcaggcaacaagggcaggctagcagataaggaggtgggtgcctgtggatacggggagagggctcaggcttgaagaggagcaggagcggaggagagagggctgtgtggtggcctccacaacgcaccatgttaaggatgccactgaggcacttgcagaaacagatactgggtgacgtgcctagcattttcccactgggggaagtggaaggattaagctaccttcacagtgggacgcaggaggcgctcacaggccagtgaagtgagggctcttgggaaatacttcccagagaagatattccctgagctgggttgtgaggaacgagcagaaggtagggagacgaagtgcaaggctaacagtccagatgcagacagctgttcaaggacccagtggtgttagagaacctcccagaactgccccgtttagtacggctgggggccaagtggaactctctcgtttgctgaatgtggaccccccaggtgcaaagcagtcatcgccagctgagcatgagctttggagtcagatccaagctgaggccgggcacggtggctcatgcctgtaatcccagcacctgggaggccaaggcaggtggattgcttgagctcacaagttcgagattagcctgggcaatatggtgaaagcccatctctacaaaaaccagccgggtgtggtggtgcatgcctgtaggctcagctacttgggaagctgaggtaggaggatggcttgagtccgggagacagaggctgcagtgagccaagatcataccactgcactccagcctgggtgatagagccagaccttgtctcaaaacaaaacaaaacaaaatgaaaacacagatccaagctgaattccagttctgccacttacttcctggatgccctgaacctcactgggcctaggttccatgatgtataagcctgttgaatgatatcgaccaatgctaaagatcagagataaaatcagtgcctgatgttgggtaagtgcccgacagacagcagctcctgccactgcacagtcagtgacggctctactggggcccaggggatgcagttagaccccagaaggatgtaccagtccatggcaccagctcggcagcactgttgcccaaggctcccccacatcactcttcagttctagcaatctgctgccctcctcatgcagttggttcccgacagcctggaatatgcttcctcttcttcactgaaactgtgcccgtggagaagcacatgggatttagggtcacagagacttaggttgacactagattcaccacgtttgaggtggcttggtgtcctcatcctcaggcatgccacacctgcaggtgtgttatgcacctgtcacggggtaaggccttccacgtatgctcgctctcctcctgcctcaggtccctctttaagtgttggccactccccagccttgaacctccctgacctctctgctgagcggctctctgaggctatcccatgcccgtggaacatgctggatgtggctgtgccttctaggtgcccgttttggagagaatacatttcttataaacagcagggcaggctgtctcaggtgtggttccagagcacatggaatgtgcccttgcatccccacagcgcaggcccagggctgccgacacagcagccaaccagacacacggggagctcatgttctactgtgggggcactgtcagtaaacaggcaatcaaggaaacaatcaggtggttacaaggcctctgataaaaagaaaattgggtaatggggggggtcacgaatgccaacacggtactgtttaggcagagttatgattgacagtgggggctgccctgggtaaagcttgaggtggagggagcaggctgggctagggccctgaagggccggctggttagaaaccctgaagtccagagtgaccccatggggctggggtcagggaagctgttacaggtggcgttggctccacagctgtgagaattatttctggcttcctcaggaaagatccctgtatatatttcttcctctgggtgctcattagaccctttgcctgcagatggtcttaggagttcccttggggaaactggtggctactcacatgctggagattggactggactcattttgggacatcctgagacatgctgtcattcaggggcttctggggctcagtgaggtcctcatccattcctgtgcaccctggaggtcctgaaggatgtaattcaggggctagtcttgtgttcctcagggacaatctatgtcactgtcacgttagtgaagataaatggagagaaatatgccctgccagctggtggcactcagaaagtgccatggagcagcacagcctgcgtctcagaatggacaggaaaaaagctttatcttcttcctgtcaaaggagggaaataccttgtggaaggtcagggtgccgtgcacctggcaagtgcctgcctgaccccagcctgtggcagaacctgaagggccactgcgatctttatcaggtgactcagtgcttagcactggggaagggcggagcatggagcaggcacagaaggtcccgtggagaggccctgagcagcccagacaggagcgctccattctgctgctcaaggcattacctccagcagtcaggcgcgtacagctcgcgtctctcggatgatttctctctctctctctctctctctctctcttttctatccctcttctctctccctttccttcttcaggatttaattaattgaaagtcaggtttttaaatattggtcagcctcctgttggatatttggggtctgccctggggctcccccacgcatctctctgacttaccttcatgaaaggtgaagcggaaataccccaacaactcggcacacttcttttgtcccaaacagtggaagcacactaggaagttctcagaaccccgaagaaggccctcgtttcacctgctccttcaggatgcccctgtcctttcctactggcccctggctcagaaagatcgccctgcgtagcactctccttttcatcctgtcctcgctcacttggaaccctgctcttcagaaactaaggggagcgcagcaagcctcaattctcttgaaatctgggcagtttccatctttttttttttttttttttttttttaagaaaaaaatagagtctcactctatcgcccaggctggagtgcagtggtgtgatctcggctcactgcaacctccacctcccaggttcaagagattctcctgcctcaggttcccaagcagctgggactacaggaatgtgccaccacgcccggctaatatttttgtgtctttagtagagacagggtttcaccatgttggtcaggctagtctcaaactcctgacctcaaatgatcggcccacctcggcctcccaaaatgctgggattacaggcgtgagccaccacacccggccagtttccgtctttaaacctaccccaaaggttctataactgttgctcagatttgtctgaaaattttggttttgtcagggagaaaataaatttctccttcaaaatctccaccttccccctaaggtgaaggtcaacctggtctttgtcctctaggttggagaacggggttccatggtgaccatcgtcctgagtccttatgcataacagacgtggagtaatattttgactttataaagcctgcttcatgatggcttcttgtgtctttgtgaatagcacaggtgggcagctgtgctggtcccatgtgggcgacaggcaagctgggcctggacggtctgtctctccaagtccaacaggaagatcaggatgggcctcggatctctgctcctaaagccgggccccacgaagccccttccctttactccttatggagtccccttcctcactgagttttttcccctattttaaaatagctcttcacagagaatctttgggggcttttaaacagccctggtcttagcagagttaacacaaccacatcatgagggatctgctgacgaggggggcatcctgcagagccggtccatacttccttttattttcttatcctgagtctcttcccctgagtctccccagagaaactggtgattctcaacacatcctgtggagtttgtgaaaagtggagcttggtgaggtcctcagccaggtgagatgtgccggaatctccaagggtgccctcatagaaggtgtctgaggattgattcaccagaccagacaagtgtggggggcagggacagcatctcactcagcttggtgtccctgagacccagcccatttggcaggacacacaggcattgtaaggaaatgcaatttccttacgccttcctgaaaacgaaccctgactgcccacggggcagctgagcccccgaggctctgttgctgcaactgtgctcatctccaggtggctgtcaaggtgctcatgccttcctcggctcccatggcataaatgaggcaaggagagccttcgagagtccttttagtagagtaggatgtggttaccagggccttaggcagttgtggggatgctggtcaaaggatacacacctatagctaggtggggacagcggaagttcagaatcagcagatgcatagagacaggggtggagaggtgaccacctgggccacggtgggggggacactggggactgctaatggttatggagtttttgcctccggtgatgaaaatgccctagagttgattgtggtgatggctgcacactgagcagactaaaacccattgatcatatactttaagtgggtgaactgtatgatgtgtgaattatacctcaataaaattgtttaaaaattaaaaaaagttgaaagtctcttcccagctcccctcccctctaaaaaaaaagtccttttaaaaaccctgagaggaaacaaaggagcaaagcaccctgcaggtgggccctctctagaggccaagcctgactcctcagctgacaaggctcccagggcggacggcccttacccagcccccgttgtccccagacacctcccctctgagccccagggcccagcgctgtgactgacattgccccgtgtcctcggcctgctcttctggcaaggaacccccggtctgaggtaggtcagcacggcacctcagcctgcagatactagtagcctgcagccaccagtatgaggatccactcttcctccagggacccacgcggggagggccctccaccgccaggggagacccctgattccacccgagcgaacgtgtgaacgatagcggatggcactgcagctgtgactagggcctgtcaggtggactgcagattgccacctggaagccctctgctgggcatccaaacctgccctcaacacagccagagccttcctgccttcctgttggcgtctcaccattgccataaataggctgcatatgagccgctaggctgcactccccacaggctcaaaactttgctgctgcctgcactttgctcctgcctttctcaccaccttgcactttttcctcccttcccaagttccccagctgaaattctctccactttagaagaccaaatttgtgctctaagtcagccaacatttctcagcatctcctgtcgggaggagccaggtaccgtcccacagggagctgctctaatccctgctgcccgcccaggaaggagatcccaaggtccctgatttatggcgaagaggagggactgtgaggttttctggtgaccacagagccagggttcacggccacccccactgccgtttcttgcacctgtactgtgagccttgcacccactgcaagctctgacagctttggctctcagggcctggccagcacctacattctgcagatgaggaagctgaggcttagtgagtaacttgcccagagtcacgaggttaggaagtggggtgtatcaggatgagattcagactctggtcctttttttttttttttttttaaacgagacggagtcttgctttgtcgcccagcctggagtgcagtggcgtgatcctggctcactgcaacctccacctcccaggttcaagcgattctcttgcctcagcctcatgagtagctgggattacaggcatgtgccaccacgcccagctaatttttgtatttttagtagagacggcgtttcaccatgctggtcaggctggtctcgaactcctgacctcgtaattcacccacctcggcctcccaaagtgctgggattacaggcatgagccaccgcgcccagcctgcttgattcttataccctgtcatccagcacacttccttccccaaactgaatgcaagccccccatgggcagagaatctatggtgcccattttcagtcacccgtgctgtgcctagcatagcttcctgcacccatcagcgctaaaatatcccacggatgctgtcttgatggcagaaggcacttttcaatcactgtgcaaatggcgccttctacccccatgatggcatgtgcacggcatgctcgagtgcccggggacgctcaccctgtcctcctggaggtccggagccctcgcctggtgttccctgtgctgtccttgccttgcctcacttgctcttttcctcccactctccgggtccaaccttggctttagtgtctctgctttctgcaggctctcctggggcgggcccctttctgcagacaacttcaactatggcctctatgtgaggacatcactctatcttcagcctttgcctttctcctggattccagggctgcattcttctttccagcctgacaactgcagccagtgcccatggccaccgcagcgtcaccctgtctacagcaagcatctcctgtgagaagtctccacatgcaacttcgcttctctctagcacagtgtccctctcatttctctgaggacttgttaacaatctgtggttattttgccaatccacccactaccctgtcgtctgcctccctagaacatcagtgctgagtgcactatatggacctctgtcttcaggacctggcactgtgcctggcacgcagaggcactcgatcggtatttgcagaatgcctcaagggatgtttaaaactgaagtcaatgtatctccccccaactaaatgcaattgttcttttcctgttgcactgttaccattcctctcactcactcccatccttgagatttaaaatcttagccacctttagctccttcttctctattttgccacttccagtacctctggcacccaggctttccttgcacctcttctgcatcactgctgtggcccaagccctcagttcccgtgtccttggaggatgacagcatcctcccgcttcacagaccagccctcccctgctctggggtccgtgctcattccacctagggcttttctgtgacagtcccttagtcaggaccctccattacttgccaaataaaagccaaactctcaccctgacctccaatatctgaccactgtgttttgagacagggtctggctctgtcacctaggctggagtgcagtggcacgatcatggctcactgcagcctcccaagcagccgggactacaggttcatgccacggcacgtagctaaattgtgttatgttttttttagagatggatttttgccatgttgcccgggctggtctcaaactcctgggctcaagcaatccacccactttggcctcccaaagtgctgaaattacagtcatgagccactatgcccagcccagtatctttcaatatgatcccaacctccttttccaggtttatttcccatttttttccacctatatcctgcattcaggaaaagtcagattaaccaggaatcaggcataggctgaagactccccacttctgcacatttagaaaactccctgaagaggaattcattgaatgcctgggtcctgggcaccccatgtggtggggggtggggtggggaggttagttcaaaagccaggtcagagggggcctactgggctcactcagtctcttacaaaaagaccaccttgatggctcctgtgggcacgggtggtagccaggcctcttgccccttccttgccctggctagggaggaaggatggcggaaagggctggactgctttgcataaaggtgacaagggctgctcagggcagctgggcaggtgcagagggagaagaactccatcccctcccagaggaaccagtgttctgcaagaaacaatgaccaggaagcttcgagaacaggcctgtccacgatgtggctttaaagtggtttcttaaccaagacataacccctccgctgaacacctgcagttatagaacatcttatttgctgtggaacgtaggaaatggaggctgcagggcattcggagtttcactggagccaggtgattctcagagctactggggagacatggggtttcctgctggatgggaacaggaatttaagcagcttctccccacccccaaatcctaaaaaaagagtgtccccagcaggctgaagggtctggaagctgatacctgggatactgaaataagaattaataccttcagctataccagaggatatggtcactctctcaagagatatattttgagtactcactacaggcaaataggtactagactctgaacagggtggctaatgaacaaggtcaaggggacacagacacatatgccagtaactgccatgtagtgtgacaagacactgacttagttcctgggcacagtggaaggaaagtaggaaagggtgtgagtcctcactcttgtgtggaacggaatgctctggagagaaggagtcatctgggctgagtcctgaggaatctcggacacattctcaggccggagtgggggaaggacaagcccttccttcctcctggaatgtccttctcagcatccggacctaccgacactgtactgatccctccagtgccagccgaatgccacctcctctcagagtacaacgatgctagcggtctggtcttcccttgaaccacagctgttctcatctcagggaccagcacagttcccacatccctgatgctcgggtgctctgtacctgcaggggcttctcgacggtaaaggaactcggtcttgttcattagccaccctgttcagagcccatacctatttgcctatagtgaggactcaaaatatatctcttgagagagtgaggacatcctcgcctaaagctctttctcctgattagatggaataggcctggggctctgtaatttgggcaatggcttatcatatcctctctcctcaggatctcctcactattactcttcagaagtgacaatataaacagtgtggttgttctgtgtggcagatagcagtggaagttacgctggatacatttcatgtttccaatatatctggacatttcaggttctaccttggtcggaaggaaacctttctctccagcgtcatgctttctgatgtagctgcccacttatttgaagctgcctatgatctgtactcagtaacacaagagactctaaagattattttacatcaccactaagggcagctccataaagtatggcttaatttcacaactagcctcacaatgctactgtaatttatgtggggaaaacttagaacaagtatcaatagcaaggaatcattttgaacacgtaaagaatatgcgatgaagtcttcctctgcacacaaaaaagcatggctcttgcctccttctttgcaaagagaactgtcagatccgttagtttcataatactttaatcatacattgtctagctaattaccactcccaaataatgaaacgtaactttcaacgatttagaatgccacagttttttgtaaaatagctccgttttactggtctaagtttaaactattacggcgatcactggcctgctgcctccctgtttgatttctccactagctgtcccagagatcttgctgataaaagatctaaaacatacagtcttccgagagctcttatttgacttttttgctccacatttccagatataatggttctcaaggcaacactatacagaatcagagagagaacatgagcttacgtttaaggcagtcattcacatttacacacatataattacaactcttatttttaaaaagtgtaaatttatgacactgtccttcaaatattattcatacatcaggttttgggttatgctgcaaatcacttgccagtaagtctagggttcatggggcaggaatgacacgttaaccctgtctagccactgggggtcctggtttggaataatactgtgatgtactgtcaggaagtaagcttgggtactaggaagacattagccgattactcttttggggttttatacagtcttgctgtgattcacctcaacccgtgtttcaagtgtatgtcattaactcttcacagacaggaaaactcagtctcagaggtcaatgacttgcctttagttcaaattgaggtcagaatatctgataatttcccaactctaaatttaactcatgatacttatgccatgaacattaaaactgactgtacactgtgcatccagcctatttcaggacacatttaataatacactttaattttgctcataatacgccattaaagcaagagtcctagaggaattgaaatctgctatctttgcaccttgtaacatgaaggcacgttatccaaggcacagatgcactagatccaaatgctcctgccctaattactgcatctttatgtgcaggccaaagggcatctttttccctttgctacattccaactcattctcaaacacaaggccaatgaccccaggttctttccaaactgtctcttctttagttttaaagaaagtttattgcctccttctccaatcaagacatttttactgcacttcgaagacaccccttagatatcatgctcctgacagctctgcaggaaaacagttttaggtgacttgtcactttatgagggtggccagtgcctggcttcacagttttctaaatccctctgtcaagagaggccttgaaagagcagactggaactttccagcagtctcctggccagtgaatgtgcaccttgccttctgaaagtaacttccgaagtgatgatcttgccgtctgaccttgggcaagcaacgacttccacggcctcagtttcttcagctgtaaagtggcaatgctggccgtaatcatctaggttccctcggccacgcagctctgagatggcctccttttcctttcctcatctagctcgtggggactggtgccaatactatcagcaactgcatttatcgtaccaagagttttaactttcagggcagccgtgagcccagcaaagactgacaggatcatctcctgcccatggctctgacagctctcttttgatccaactcatgcccaggaaaaaaaaaaccaaccattaattatatgcttatttcttcctttaaagacataagagactccttaggttctcagccctcctggtgtgtcccatcagatggcttggtacagtggcaccttttaagaacgtgtgaaatattccagtccgttcagattcaggcagaatccaaatcactcaaagccttctcctaccaattcttcgttcattttaatggtcaagcacagaggaaaaaccctcttaacccttactgtctactgattaaacacatttatttacttatttattttgatatagggtctcgctctgtcacccaggctggagtatagtggtgtgatctcagctcactgcaacctccgcctcccaggttcaagtgattctcccacctcagcctctcgagtagctggattacaggtgtgcatcaccatgcctggctaatttttttttgtatttttagtagagatgggggtttcgccatgttgtccaggctgatcttgaactcctgacctgaagtgatccacctgccttggcctcccaaactgttgggattagagccgtgaaccactgtgcccagccaattttctattctcatcctctgactcttaagattaaatgctctaaagaataaaacagtcttgttagattgaaaagcaaatgagtagatgaatgaaacagaaaagtactcggcaaccctgccatgtcccctgagaaggcagggccagctctacagtgaagattggtgagtggttttcctgggccctgcatgggaggaaaattaggcttgtcctgagtgggtgcacctgccctgctgagctgctatctggatgacgatggccatgctgggccgcagctccaccaggagtgtggcattgtgcttggtttgatggagcagcccacaccagtggcagcatgcaccccttctcactgggtcatcagctcacacccatcatgctggtttggaaaattcaatgacaagttcaaagagtccggctggtgtgagggagcagcctggcatggctcactaaggcccagcatggtgtctcacaggaatagttctgtgcacactgtcctgggactggcatctcaaccttcctggcaaagaacagggaagggaggtagatgttctcctggagcctccttctcagatgctctgtgcatcttcacttccagggctggtgtcaccagggtcctggccatcccatgggcacaccctcctttaactagaagaacagttgttgggggccgcacccagggcgtgggacatacttggctcatcctgtccaggtctgaagctagacttttgccctggccctcatctctgttctgggagaaaacagattcagatgtgagcctgtggttggcatcacacaaatgtgactgttcagtttttaccatctttgaggtgatctccgtgccaacctctccatccttagatagacccatgagccctaccccacagagttgtaaggaagtaaatgagataatgtgtatgcaaaagccctacacctggcactcgataaacaacaatattcgcttgttcctatttaaaagtatagctgcccaaatgccttgtttttcaagggtgctttagagatagaaacaatgaacttcaacatcacacactcagtcgggtgtctcctgcactggcacgtgctggggaatgaaagttccttgtttgatgttttctctgctggcagcagtgcagaactcagaaacgttaatctgagctttctcttggtggaactgagagagctaagatcagaaatcttctaagattatccttaacaggccgggtgtggtggctcatgtctgtaatcccagcactttgggaggcgaggcgggtggatcatctgaggtcaagagttcgagaccagcctggccaacatggtgaaaccctgtctctactaaaaatacaaaaattagcctgctgtggtggcaggcacctgtaatcccagctacttgggaggctgaggcaggagaatctcttgaacccaggaggcagaggttgcagtgagctgagatcgtgccattgcactccagcctgggtgacaagagtgaaactccgctaaaaaaaaaaatatatatatattatatatatatatatattatatataatatatatataatatattatatatatttatatattatttatatataatatattatatatattatatataatatatattatttatataatatattatatatatttatatataatatatattatttatatataatatattatatatattatatataatatatattatttatatataatatattatatataatatatataatatatattatttatatataatatatataatatatattatttatatataatatatataatatatattatttatatataatatattatatatatatatatatatatagagagagagagagagagagagacagacagacagacagacagacagacagacaccttaataaactggatttctttctggccagctcagacactgaggtctccctcctgtccggacctgctgtttgtcctgcttctgcttgtgggatgtgtacaggctgccacactcatgtgtgcttgctggccttcttcctgccctcctgggtcacgtgtgtctgtgtatgtccctctcgatccctcaggcctgcattgtattttggccttccgggccacctgcagtcacccaggtctccgacccactagacacctggcccgcgtggctcctgttgtctcccacaggtcctactgctcggcagccttgaggagcacagatgcatgcctccctccacagacccccgtggcacgtccccaaggtgccagtgtcacttcccatctacactcttatttgtacaatttgtcttattgtttaaactggactgtacactgccgtaggaaaaagattaaattatttttccatgaccacatatacttcacttacaagtacttcacttataataggccttcaaatgcaagttgcaaaagacaccaataaatgcaaagacaacttgtgttcacggactggaagacttactattgttagggtaaagatcattacacaaagtgatctacagattcagtgcaatccctatcaaaatcccaatgatgtttttgcagaaatagaaatccatcttgaaatttacatggaatctcaagggactctgaatagccagaagaattttgaaaacaacaacaacaaacaatagcaaagttggagagctcacatttcctgatttgaaaactacaaagatacagtaatcacaacagtgtggaaccagcataaagacagacgcggatacgaaggatggaacagaaaacccagatgtaaaccctaatatacccggccaattgattttcaacaagggtaccaagaccacactacggggaaagaacagtctcttcaacgaatggtactggaaaactggatatccacatgcgaaagaacacagctggacccttaccttacatcgtacataaaagtcacctcaaatagattgaagacctatacataagacttaaatctataaaactctgagaagaaaacaggagaacagcttcatgacattgggtttggcaatgatttcttagatatgacaccaaaagcatgggcaacacgagtaaaagcagacaaagtggactcctacaacttaacaacaacaacaacaaaagaaagaacaagcaaataagagagtgcccaacatcgctactcattagggaaatgcaagtcaaaaccaccatgagataccatctcatacccattaggaggtttactatcaaaaaacccagaaaataataagtattggggaagaatatgtagaaactggaatccttgtgctctgatgattggaatgtaaaactctgcagtcgtaatggaaaacgagtatggtagttcctcaaaaaattaaatatagaattaccatatgatctggcatttccacttctgggctagtaaccagaagaactgaaagctgagtctcaaatagacacttgtccactcatatttacagcagcattattcaaaacagccagaatgtggagggaacctaagtgtccgttgacagattaatgaatcgacagactgtggtaatatttgctatggaatattattcctccttaaggaggaagacaattttgacacctgctacaacatggataaatcatgcatcgactatgctgtaagtgaaataagcccattatgaaaagacaaatactccatggttccacttacgtgaagttcctagagtagtcaaattcataaagatggaaaaaatggtggttgccagagcttggggtggagaaaatggggtagagttttagttttagaggaaaaaagagtcctggagatgggtggtggtgatggctgcacaacactgtgaatgtacttaatgccacggaactgcacacttgaaaatggttaagatgtaagttttatgtgtactttaccattatttaaaaaatatcccactgggccaggcatggtggcacaagcctgtaattccagcactttgggagctcgaggtgggcggatcatgaggtcaagagattgagactatcctggccaacatggtgaaaccccatctctactaaaaatacaaacattagctgggcgtggtggtgcgcacttgtagtaccagctactcgggagactgaggcaggagaatcacttgaacccgggaggcagaggctgcagtgagccaagatcacaccactgcactccagcctggtgacagagtgagataccgtctcaaaaaaaaaaaaaaaaaaattccactgatacttaacttgaaaaataaaataactcactatactgaatcactaactctcatttttcttttcaaaaaggagattaaaagtatattttcaaaaaagacaaaaagtgtcacactagagctacttccttgggggtatctgagccttaattgttgtatcattagtgcctagcacagtgctggttacatcacgggaactgggtaaacgaaattttaaaaataatgtgcagggatgaatacgtgggttctgattattcttttcttaaatttctaaggctactcactaagctatttcatattgcactgacatgtatatattcttttttcaattgacacattttcctatttatgtaaaatatttacattagtttttttccttacgtttgaaagccttacacacacacacacacacatacacacacacacacacacacacatattttttttttttgagacggagtctcgctctgttgcccagctggagtgcagtggctctctgcagcctccgcctcccaggttcaaacaattctcccgcctcagcctcctgagtagctgggattacaggcgccagccaccacgccttgctaatcttttgtactttcagtagagacagggtttcaccatgttggccaggttggtctcaaacttctgatctcaggtgatctgcccacctcagcctcccaaagtgctgggattacaggtgtgagccaccgcgcctggctgtctttaacatatttttatacaaaaccggagacaagagcatgatgagcctgcggatacattcccagattcaacaactcatgatttctaatttggccacagtgtatatgtgttaatgataatgtcctcagagtcagaatcacattgtgatgtcacgcacaccccacagccaggtcatacatgtggaggctgaggcacatagaggtgagcaactggacccaggtcacacagagagtgcgtggtggagctgatgctggaacccagaacacctgtctccatggccctggctctaggacatctgccaaatgtattagcctgaattttatttatacaagttgatcttaactaataagattaattttccaaaacttagcccatttttcagataaggttaatggaactttctaaaacagaaaataaatgccttatgagtcagtggtctcctggccccggtgtttgagcctttgaaatgtcactactgtctccaagagctccaaaaatggtttttgccctctttctttttcacgctgttcaccagacagatttgccatcacaaattcaggctcaaaggagacaacatctgtgaagagttccataaatggtgaatcagtatacatggtcatgtaggattgatatgattgttggaaaacacaaaaaaacacaaattcacattttctggggccgggagtggtggctcatgcctgtaatcccagcactttgggaggctgaagtgggcagatcacgaggtcaggagttcgagaccagcctgaccaacatggtgaaaccccgtctctactaaaaaaatacaaaaattagctgggtgtggtggtgtgtgcctgtaatcccaagtgctcaggaggctgaggcaggagaatcgcttgaacctgggaggtaaaggttgcagtgagccgagatcgcgccactgcactccagcctgggcgacagagcgagactctgtctcaaaaaaaaaaaaaaattacatcttctggatctgggcttggctcctggctgtacacggtgcctccttctaccgtataactgagatactacctgtacaggactttgttggagaagtgctgagtgtcccttcaagcagcctcttccccaggaggcaatctttaccttcactagccacaaggaaagactgaagtctggcgccaagagcaccatgctggaggtctcagtggcggggggcacatctcacccaaggccactctgccctgtccacttgcagaggggctccttggtgtggggacagcaagagggtttcttttgccacaggatgaccattggctccttgggagccttggtcctcttgactgattcatggatggctgaccacgaatcctcttaaagagatctttgatgccactagactactgacaagcatgaagtccctgacgatgtgtcatgggcctgctggaatctctgtttcaaggacattcttccccagacagagtggagagtgaggactgaagggagaaagagacagcgcaggtgcaaggtggacagcacccatcgacctctgtgctggaagcggtgcttatgcacttaggcaggtgctgaaatgagagaggctgtgcctgaagacagcaggtcaagtctcagtatgacagcaacatggcagattataaaaaccagatgagccagcagatagccgctgtatggtaactcgtgccacaataaaaatgtcagttttctgtattattttacagcattgactagcctaggaatgctttcaagcaggacactgataccctccattgttaaagacagacataggcatttattaactggtgttcacacggctctttcactggctgagtttgtgaggcgagaccagatttcctgtcctaagtattcctgtgggagcagcaaccatgtgggcgcctcaaaacgtttccatcagaaatgacagtcgggggcaggtgccccgcactcaccaatttctatcccacttactttctctctccctggagagttgggcaaaattctctgtcatttcttttattctttactcctaaaagatccttgtaacaaagaactcaagcaaaaaaaaaaaaaaaagaaaaagaaaatcccataattagactaagtggcatcccatccccctcccctttttaaagtgaagtgagctctgcgcatggcagcaaactggctgcctctacaggcctgccttgcgtagcgccggggtctggagtttctggagcattctcttggaactgctcagaggcagggagtgccgggggtgtgtgtttgcaaatagatacctgaatgattatctagaaaacgtgcctctgaattccaagtgaaaagacataattttgagggttatttgccttcaatttgggtggtccatcgtgagctgcctttatacatgccactgtccttcctactgaaggtgtccacagcatgatctcttcaccgggattgggatgaaaacaccagtcatcacccagcagatgttgcttctctactgaggacccttcaacttgttcactgtttcaaagctgaagctgcaatttgcgaagtcgcattttcccgaaggctttcccacctgggccttgctgaggaacataagagtatcatcccaccgactgctggcattcggccctgcgcccacacagcccagcgctctgcctacctgtgtccaggtgagagtgcatcacaggcatcctcctggacaggcagagggaagctctccatcattatggaatgcttcctctactgtatgacacactcagttgaatgaaaagaaacatcagtctttctgaatgggtaatgatattgttttcttaaagaatactttcacagaaaaataaaaaaatacttctagagtaagatttaaaaaatcaacatatacatttggaattatttgtctcaaatcacagactctagaatatttaagttgcttgagactatttagctcggctttctgctcacagacaggaactgaggcacacgcttgggaaggccaacattctgactattgtcaccttgccggcatggcactgttgccccagccaagctcgcagttacaaacatccagggagcaatgagagtttgcttagagaaaagagacgtcctggaatacctgaacggctctcacaaggctgtgaggggctggaactacttggggtagatatatgtagaagtcacgtgaggcaggtttgagtttaataggaaaaaaaacccaaaacaactttctgatggccttctgagagtggaaaaggcagccttgtgggccagtggcaaactcctcatgaaccatgggcctctgtggggcgtatgcagttcctgctattcctcatgaaccatgggcctctgtggggtgtatgcagttcctgctctgtggagggaggctgggcaggggacactggatgctgtgggctcttcggtggcagggccttttttttttttttaaacatcactgttgcatgttttacatatcataaaattcactcgtttcaactgcacgattcagtggcctttagtaactttaccacattgtgcaagcttcatgatacatcagtgtcagaacctttcatcccaatgaggtcccatggggacagagtttcaactaaagcaggtctcttgggactatggctgtctcgggaggggcctgtctcacatgcattccatcccagtcctcccagttacagcctgggtaccttgctttgggtgtgatagggtgttgtaccaataagcaatatccatactgtctacccagataggttcaggcaaggaaggggctgggtggacaggaaaaggttggcagctgggtgatagcacccagtggaccaagggcagatgccactgagggggcaacaggatagggtagctgcttctctcactgcccccctgccccatactcccatatagtgaatctgtttcgggcagaggacacttttcaccctgaccatgtatcataataaacttcaatggttctctcagcaacactgaattacttgagaaagactttgttattcaggaaactgagtaactgaagctcagaaacttctagtaaaaagatgatcataattgttacataatatccattaaaaaaaaaagaaagagtaacagccattttaaacccaattagtttccctgacatgttaatatatgttaaccagaaaaaggaagtcctttttaaacctgggctccctgtggtgcaccccaaaaggaagtctcggtggcctagactccaacgtccagtgagagacaccctgcatgcgtcacgtggctccccagccgcggacctgcttgtgttcttacaggaggtgcctaagtggcaccttgaagaagatgatatgcttgctgtgttatgtacacccgcatccttccttgctaaagcattcctggaaagcccctgctgaccatatctgggggtaatcatcatgggatgggccaggcaaagccaccaaaccatgtgccaattacatttcaagcaaggggtcctattggcaccagcatcatttttttaaggcaaagtctaggatttcagctgtaggaatttaaaaacatccagagttaatttttcacacaaatcttgaagagtgggggcttttagtgtctttaggttgacagcatccaaaatccaaaagaaacaaaaacaacacaatgtgcccagaaaactaagaacgccattttggctttctgaaactttgacaatactgcagacacgggatgagtttctgcggagaggccggggaggagaacggatgtagggggtcacatgtggctcatccagtaggagaaaatgaaaacatgtgtcaatgaggaaaaggcacaggaatcacacctccggttcaagtagtcaggcagtgtgatgaaagctgcgagacgcggggatgcagatcaactgaataagaggcatatctcaaacaagatgtgggagtggattctctctgttctgattattagtatctagtatctgaattcaacctactgatttagtttgtgaagtacaggcaatacgagatgacaggagatgttggcggcaaagaatattctcatgcggacctggagtctttgagagctgcctagaagacaaccatggtagtaattccttctttccagcatagttccacaggtttgtaaatgaatcacagctgatcacaacagatggcctccatttcctcccatcatgaccttgagatatggcccaagcagatcacaagtcccagcaagcagttttcaatccatatctgagcagcgccacataaaagatgtggcttgggtgactggtaccttggcatctaaggatcagagttcccacgtgattacaacgaacaccatttgcagcaaataccatggggcagtcctctcggcttctggaaaactgctacggagcgctgtaactggcctgaagtctgcgtacaggcctcactgatacctttttcaattatccatttgggttaaatcctcatgggtcgtgccatagatccctgagtggattgcacagcaggtgctattagatcctagttgtaatcagtgagtgatggtccaggaacctgggaaggttctaataacacgcaaggactatcatcagaatacctcaacatttaagcagctttgcatcttcaaagctcactacaaacattaattaattaatatagacgacacccctgtgatgtcgttaagtatgattacctccatttgacatataaggaaacaggttaagcggcttgcttgaggccacacaagcccgagtgggtctgggaatgtagtttggaagcacctgatccagcacacacggaggcgtgctagtggcaggtcaagaagctcacccactccccagccctcgccatccccagcaagtgggactgtggctgcaggagatctgctgacaggctgtccgaggaccctgcccggatcttcctcaaccacgttccaacccaaaagagttagtaagagtctgacagagagcgagtgagcaagagcaagctctagcaaatccactgctgggtccagctgcagtgatggggggtgcagcccttgcttcagcattccctgctgctgaggcggactaggcagtggacagtcggatgtcattgttaaggggcgggtgggtgcctgagggggcagaaaatggaggaagcatggaggaggctatcatctgagggtcatcaaaaacccatgacagacagctacactggggagatggaggaaggacctgagaactagatgaaatcctacagcaggagcaccgggagtcacaaatggcgactcgccttggctccgaagctgctggtggagagagaggaactgcgtggctggaaggcattgtgcgggactgggaaaggaaggaagggagccagcacttctcggtgccttctgtgttccagacctttacagcattcacttatttaatcctcagatcagctcccccaggtgaacattacttcatcttattcttatcttagcactgggaaactgaggtggcaatggtgagttttcaggcaggatcagaatcgagtccatgtgtggatgatgacagtgatcccacaccaccacagacaggtaaggactctggacgttggaaacagtgacatggcaggagggcctctgggaagagctgcagaaggtgcagacttgggaacagctggagaaatgatagcagcaccgtgtgtgctgggggctccactttgaattctggaacctgtggcatgggtgaccagtaccttggaatccaaggattagagttcccacacaaagaagtacagttgatctgaggacagtctcagagaggtggggagggcccagaggtgggagtgggaggtccaggcctgtctgtaccactggaacatccaaggagaagcaggcaagtggactctgtatatgacatcagctgctttatgttgatgtatataaactgtcctgagagccaagggaaatgccttaaattctcaacaaagatgagctgaaaaaaatcattccaacattttcccaattatttgacagaaacacaaatttagggcttactgctgcataacattttgtgttctctcctgccaagatgctgagggcagtcagctgggaggaatgctactttggggatgaattaaagtttgttgaataaagaatgagcacagattcagaagcaaaacttccatagtgcatgaatcctcccaacgagactgtcagaataaggatataggtttgcatttatttattttactaaaagcttcctacttccctcctttctggatatcgtaaggggtttgacctttctgtttcaaatatgacatttctttctctgatttcctttagccagatgtcaaacctaaaatagaatttcttagaacttactgctcaaatatgatacttaggagcagactgtagcttttcatagtgtcttatggcttttctagaacatgcactgataaggaaagggagagaaattcaacttggggtgtctctgcacccttcgttagggatgctgggaagtgatggcaacgcacagaagcaccgtgcaggtcgttggctcagaaaaggcagccactgttttcatttaggagcccagctcagtctgaactgtgggacctccttcaccaaagcacccccatattgcttcttgttctcacctacttaactgaaacgtcccaaagttccctagaagagattttagctatcatctctcctagaagagcaggaaaccaagctcccttttccttgcttttatccttgcccctgcggaatttttccaaaggtaccagtgatgtttttgtgaatgcaagtacacggcggccctcctcctcacagcctggaaccccaaaccctaccactggcctgcaccgccttatgtgactgcttgtggctactgccctcaccatttctctgtgccaggaatactggccccactgctgttccttcaactggcaaagcatacacctgccacagggcctttgcacaggagtcccccggtgactggtgaagatccgtgtgccctgctccctcatttccttcatggctctgctgaaatgtctcatcagagaggccttccttgatcacctttaccctgctttatttttcttcatggcacagatctcctcctgacatgttattaacatgtttgtggtctgtgccctcctgtatgaatgggagcatgtaatttatttgttgtaatttgttggaataagtcacctactggcttagcaccctcaggacccagagcagtgcctggcacacggtaggcacccagtaagaatttgttggataagtgcttacatttatttcaacaaataaatcacatgcatgccccgttatagttctttacaataattaggctaaaagttgcttataaaaagaaaaagaagtaacctagtcaaattttactttggtgtttcttaaatgttacccattcttactgcaaaaatcaactcttggaatctttatcatttctctgtaaggccgagaatctgccctttgctacttgaatcttgtgtcagccttcagtcaaaactaatgaaagtctgggccaatgagctggccccagatttctggatcatccaagcatctccttcactctctggaccctctcacctgcccaccccctggaaccacactgtcctctgtcaccaacagtgaggtgggggagtgttcttacaacttcatcgttcactcacatgggagaccgtgagtattctcttcagaggagaggaattgtttctccttagagaggcgtgagatgaatgagtgtcctgttctccctagagtccccgattcatggtgtctggccactcctacaggcacagcacggacaatcacataacgaagctgaaagcaatgtgcttttgagtataagccatactggttagaggtgatttactgtgtcactctgtcacattgacatgtttgagactcatgtaaactattccctgatcagccacagttctggcctaacagggggcaatgctaatgtttaataatgtaagcataatatttaatttggaaagtactagtgattatatagtagtaaagaggcttcacatgtgggtagagattttttaaaaatctcattgataccaaggtatagtgcagtagaaacattttgaaactaaagttagaagcgtcctaactgtagaatgaacatattcacgtcactattgttcaccaggatcgctctcacacaccacacgtgctatgtgaatacagatagacttctgcatactcagctggctttgcacatctctaccacagagtacgtgtatctcttggacagagtatgactggtggaagtggcagttggcagtttatctttgatcactatattcagaggtggcttatactttttaattttttttattattatactttaagttctagggtacatgtgcacaatgtgcaggttagttacatatgtatacatgtgccatgttggtgtgctgcacccattaactcgtcatttaacattaggtatatctcctaatgctatctctcccccctcctggcttatacttttaagggcacaaaatatataaccatgattgcttgaaagggatttgtttcaattccttgtttgaaggaggtaatgggccagcctaagaatcaaaagtgacaatgaaatataaaatgtataaccatgattgctttaaagagatttgtttcagttccttgtttgagggaggtaatgggccagcctaagaatcgaaagtgacaatgaaatatgaatgtaaaagaggaagggagacagacctctggcttgttagtacaacagaatacttacttggggttcactttatacattactttcccccattttcctacccatttgggtaggaatgagatctgccaggaaggtgcacggggcagaaggctttgctgttgttttccatgtcttggtttccttcctttaccaggaccagagcaggaggcctcctttctgctctctgggggccacatactcctgcctcgatgggccacaactggatgaaggaggatacacgtgtgccttgctacacataatagctaaacagccctagaaaaacagggtctgtgtacatatcatcatgtcttcaggctacaaggaagcccgctgtgtgaaaaagctctcctgagctcaaataagaactactttctaaatatcaccttaatatatctggtaggtttggatttggtatgtcaagttgagtcctataatacatagactatttccttctggagaccgtatttttaatttcagcgacttggaggagttaaactcgacctctgggcacactgacagccaagtgggtcatcagcagaggagtgacaacgacacttccattcatgtagggcttccggtctacaggagggctttcatataagtgggctgagtgtatgggaagtgaactgattaggcatttgccccttgttatggatgaagcagcaaaggccgtgagagtccctgagggtcaagtcgctctgagatcctagagacgggagtcctgctctgcccagcatcctctcccctgcaccacagtacctgcatcccctccttttctgtgccgtctttattttacagtgtggatctggtgggctagggttcctctcctgttggtcctgatgatgcaccaagaccaagaatatttcttatttatggaggaaatatggttaagtgctaagtgtacagccctgacccttcctctaccctctcagcctagttacaccagggaggtaaatccctacctgtttgtctacctacttgtttatattaaaagttcttgcaaatttaaaaggttatacactcaatgatccaaaggtgaagttgagaagactataaaagaccttaggcaatatgaaattatacagtcagcttttcacgtgacggtggtgtgatcactaatggaatcaccgagtttccacagaatgaaaaggacccttgggatccggagctacagtttaagctggtccctctctggaggtgttgcgtagtaggcttctcctgtaacgtctacggctgacttatgacatttacatttttggtcctcaaggtcacagtgtccttctaagcggaacgatagtggagactgggaactaacttcttcatctcctctctttgacagcctgaactcagcttggcactggctttctatccaccttctgcccagcagtgaatggagtcaactctcccattaatggagcaccctctgggggaagggcactgtgttttctgctgagcgctaggaccttcacagtctccacagagcaacaaaccagaactcagcgagaagagcaatgccaaagaggaggcctagcgtgcagacacacatgagcctagagcagctgtgcccaccccatgcctctaccattgactcaatgaggacagctgtctttgagagtggtgacggtagggttctatagaagaagcaggtctgttaagcaatctgcgagatggccggcctcagaccaatcaaagtctaccattttgtcttatctatctagaaccataactcaaaaatgaaattgccccagcttttctcctcccaccattaaattccattcaatcatagcaggcaaaatgcagtcacgctcaagcagccagatgttatcattacagactgctctttataaacccatgctgaaacctgagtggttgatgagaccagctaagcagttgtacctttgacccaattgcattaaacttgccctatcaatttaagctcagtataaacaccatttcccagagcccctcgtgaagtcagcagtgagaagaagctgactaagcctaaacattttttaacagcaatcttgtcttacaacaccaaggggatttgctgggtatctggggctttataaaaccatatgaacatgctgaaagaattaaaatcctttaaaaatgaaaaattgatggtgacagtcctgtctgaagactaactggtctaatggcaacatggaatgggcacttttgtatttttttttcttttttttttggtctgagacacttttgtattgttttgtaagtaatatatttgtattatttttcttcttctcaaatgtttgccttaaggtggccattccaattttttttaaatgaaaaaaaatgtgccccacttatcagtaaattggacattttaagaggaattgaacatatttactgtcctggttaagtttctttctaatgaagactgggaccctctccgtattcaaacatttcagataataagatcacagttatctccacatcacatgcggctgacatcccgggagtctggcctatgcacaagtcccagggtgaatgaagggagtgatcgtacctggctattgatttgctaatatttcaataaaacttagatgttctataaaaatgtaagcatatatttgtctttgtaaataaatatacctcagtgtaaaggtatttcaaaagagaaggctgatcttagaggtgtttacttttttctttttttgctttgtataaaaagtttattcagttactttgtggctgagtttccaaataagtaggatactgttactttctgttaaaatgctaaaataggatactggagaacaaataaatgttgaagatttataaactcttttagaaatgacttcgtaatatatcttaataagataaaaaggcctttgaattataaactgtagattataaaaattaggtagaaaatgtaatattttaagacacactgggggccaggcgcaatggctcatgcctgtaatcccagcacttcaggagaccaaggcaggcggatcacctgaggtcagaagtttgagaccagcttggccaacatggtgaaaccccatttctactaaaaatacaaaaattagctgggtgtggtggtgcacgcctgtaatcccagctacttgggaggctgaggcagaactgcttgaccctgggagtcggagtttgcagtaagctgagaccgcactactgcactccagactgggcaacagagtaagactctgtctaaacaaacaaacaaacaaacaaaaaaaaccactgggaataaaaaggagccaaaacattaaaacagaacactctccattaaggggaagaaaacaatgctacgaatttagaaataaactttcttgaaatatgtgtaaagatgtataactagacaaagcaacacatcaggtaattctggccaaatcagagaagtaccaaggtatcagctcaggagaacagagccagtgagttgccaaagagacttttacactgaacttgacacaccctggaattagtgaagactcacagacctgaatggaatatatttctaacatatgtcagtactgttttcactagtgaagaactctctgcaacattaaaatctaataccaaggtctaaggaaactttgtcaaatgtcttgctgccctgattaaaagaattattataatttttctctggaaggaagagacagaagacattgatttcacacaataatggaaaaaagcgcaaagcagggttgggcaggctgggacaagggttggctatcatagtctggggtgctttttgggaatttcagcctttttggggcttagcctcctcagccaagcatgcacttcagaggagatggcctctggggttcattcaggctccactactctgagtctacactctggaggcacacatactctctgggatacacttcagaatcagtcatctctgaggttcttcccatttttaggattcaataaatgtatgaaacgtttgtttagagagaaaaacgcactttgtggatgacaccttcctatgtcatgtaaatagaaacacatattgcatgttttgccataaaaatgggggtgctgaaaatgagatcgtcatgtgctgagcacttcaccgcagctcaggcacctctgtgttcaaacaggggcttggcatcaagagctgtcaccagctgggtacagtggctcatgcctgtaatcccagcactttgggaggctgaggcaggcggatcacttgaggtcaggagttcaagaccagcctggccaacatggtgaaactccatctctactaaaaatacaaaaattagccaggtgtggtggcaggcgcctgtaatcaaagctactagtgaggctgaggcaggagaatcacttgaacctgggaggcggaggttggagtgagccgagatcgcgccactgcactccaacctgggtgaaaaagcgagacgagactccatctcaaaaaaaaaaaaaaaaaaaaaaagctgtcaccgccggtcccatgatggctgggtgaccggagaggtcacagggcttccttgggaatgcaggtggtcgggaggggctgggtgggctccataggaacatcttggtgtcacaaacgaggggagatcttgcacactgttttgaaacccatcacgtctcctggaagcctcaagtcagagcgctgcgcacgtgcaccgcactgccccaccccctcaactcctccctgtggcaccagcagctcggggacttctgcccagcagccttccgggacaagggggtgagagggtgtgaaatgactgtaatgaggaccacagacaagaagggatgcgctggttacaggtgttgcatacgactttcagaagtaatatttttcttgccctgatttgaaagagctacttcaaaatcaagtgtttctgggttttttttggttttttttttttttcacctgcactaaaaatgaggacagcattagacaaatcttttccacttaatgtaacacatgctggaatgtggaattttgtgtttttgaggactcatgaacggtaactaatgctgagtttttcttaattaatgagcagctcagatatgtaaaagaaattggcttatctacaccgggataagacagagaagaaaacactgatatgaaaagctagaatattttctaagtggctctgtaattaaaaagaacatttaaaatgaggaaaagttaatagacttccatgctctaaatatattcttcctaaggtaatagttcagtagtgctagagagaaagataaccatctcctcgtgccttttgtcttcagccatacttttagttttcattctgcattccatagttccaaacgttgaagtcatctgcaggtcaaaccatggcctcgggtaagtacctagtacgtttttaaaaaatgcatcttcattctgaaaacatgaaaactcttgctctgaggctggattcaatgaaccacacctcttacaagttgttcatagttccctgctcgcccggacttttgctcagagttttgctgtcacctcatggctgcagggctttttgaaattctagacaatgaagctcatttccatgttgctccccttgcagcgactgtgggggccttcagaaggcttgagcctacagactcaggcaaagatctgatggcagctcccctgcaaaccacagtaacccacgaaggccacagaacaatgtaactgctccaagtgtcaatcagcggcactgagcttagctttctcggcaacctgtgacctacaaagacgcctgcccttcagagtctggtggcggcttatcactctcaattaggagtttacagacacattcatgttggtgcatgtgttcaggaggctgcttctcactcgacgccctgtttagaggaagcagcgactgaagactgctcccctgctggggtgctctctgggaagccccacaatcttcagcaggttgaatgccttgcttttgggatcaagccaaaaacaacacccacccccacgcaccccaccacaaaaggctactctactaaagggcattattattttctgggtttacagtcacaatgtatataaatgtaaaccaccaagcaaatacgtagaaacacggaatcaacgatatcattctgagaatttgagaggaaagcattttgtccatccctaagtatgtataagatattaaggttggtgcaaaagtaatcttggtttttgccatacttttaattactttttttttttttttttgagacggaatctcactgtgtcgccaggctggagtgcagtggtgtgatcttggctcgctgcaacctctgccccccgggttcaactgattctcctgcctcagcctcccgaatagctgggattacaggtgtgcgccaccacacccggctaatttttgtatttttagtagagacagggtttcaccatgttggccaggatggccttgatctcccagcctcatgatctgcccaccttggcttcccaaattgctaggattacaggcgtgaaccaccgcgcctggcctatttttaattactttctgccattacttttagtggcaaaaattgtgattatttttgcatcaacccaataaatttcaaaatgacaaaactgcagatccagcaccacccacactgtcttattatatttctacaaaagagtgttttttcctggattagacaatgcccagtaatcaccaagacaactacatttgggtctggcttcagagacgacgactgtggagcatttgagacgtctgacaaacttgaggccattgctgcgccatgttttcccaaatgataaaggcagcacaagtgtccaagccgtgatgcgtgaatgagagtcaggatagacatggagtggaagaacagggaaggtcatagagaaaagtgggtagctatgatagaaggctgtccacaagccgctgattagggcctctctgtgtgtctgcaggcatgtgtaaacagagatcaagtgttttttgcagttcctgcaggagagtgatgattcttccaacaaaagtctctgaaatttcccgctctatgtctaacattctctgccactatttatgtctttcagattagtgtagaaaggagcatttcacaatgcctggtttccttaataagcaaaatctgatgctgggagataattctaagattggttaagaggattccaagaaatggcagactgcagagggttcacccgggagtacagagagaaaacctgtttcatcaccaccagactgggtacctttccagaaagtgaaaaccctcctgttcaaataggtttgccagagaatctaagcacctcaccaggcaatggaacagtggtgatgcaaaattctggggttaactgtgctctgtctgacgctgcattcttctgaccctttcttaggaaactgccctgagatgctagtcagatgctggagatgtcacagggctggaataaaggcattccctggtgtcctttctggatgtgacaaaagaaacatctaattgctggctgtgcactcccaccactcccagccgggcatttcagcgaggattgggaattgcgaagtctatactgtattttcaaacagcatgaaacaaacattgatcagccaacagcagctggcagcggatccagcaggcccaccagtggcttgaacttcagtgaaaagagatgaggtttaagatctcagagaggtctctccagtttcagacagtcaccaatgccagctctgttttctagtatctcaggctgtccagcctgctcatcctcagctgaccgatgcctgcacaacactgtggctgcttggttcaacaaattgcagggccaagtgatcaggggaccacatccattcccctccatcccactacttttttggcatgaggagactcagtttttttcaacttcgtgacttctcctcagttaggttaccaaagggctttttttttttttaaatagacttagtatttttagagcagttttagctttatagaaaaactacacagaaagtacagagagttctcacaggacctttcctccaccccactcttgcacaatttcccctattaacaatatatctcagagtgttatatttgttataactgatgaactgatattattattacctaaaatccatagatttttacattagggttcactccatggcatgagtctacagattttgacaaacgtataatgtcatgtatccaccattactatatcatatagaatagttctgctgccacaaaagccccctgtgctcttcctctatccctcccctggaccctgggcaaacactgatcttttaactctctccatagtttcgcctttcccagaatgtcatatagctggaatcatacagtactcagctttttcagactggcttctttcatttagcgacatacatttaaggttcctccatggcctttcatggcttgatagctcatttccttttatcactgaagagcattccattggatgaacgtaccagaagttgatccattagaaggatgtcttgcttgcttccagtttaggttgattattaataatgctgctataaacatctatgcgcaggtttttctgaggacatgttttcaacttaattgggtaaatacatagccgcgaggttgctgattgcgtagtgaaaccatcgtgctatttatgaaattgcaaacattcgtgcaaagtgtctaaaccttttgcattcccactagcaatgaacaagagttcctgctgctcctcctcctagtcagcatttgatgttagtattctaatgttttgccattctaataggattgtagtggtatctcatggttgttttagtttaaattccctagtgacgtatgacgctgagcatattttcatatgcttacttgccatctgtatatcttctttggtgaggtgtctattagctcatttttaaatcaggttgttcattttcttgtggttgagttttaagagttctttgtacattctagataatcagtcctttactgactatgtgtattgcaaagcttcttctcccagtcttgacttgtctacttgtcttttcacactcttaacagtgtctttcatggagcagaagtttttaatttttctgaagttccaactcatcaactctctctctctctcttttttttttttttttttttttttgacatagtcttgctctatcgcccaggctggagcgcagtgatgcattcacacggctcattgcagcctcaacctcccgggctcaagctattctcccacctcagtctcccaggtagctgggacacccagctaatttttttttttttttaatagagatggatttttaccatgttgcccaggctggtcttgaactcctgggctcaagcaatctgcctgccttggcctccaaaagtactggaattgcaggtgtgagccaacatggctggcccttcaaatagatcttacacataatttttagacttacaactatttcttttttgggggtgttaatgtaaattacattgttttaaatttctttctttttttcttttttgagacagagttttgctcttgttgcccaggctggagtgcaatgatgcgatctcggctcactgcaacctccacctcccaggttcaagcgattctcctgcctcagcctcccaagtagctgggattacaggtatgcaacaccacgcctggctaattttgtatttttagtagagacggagtttctccatgttggtcaggctggtctccaactcctgacctcaggtgatctgcctgcctcggcctcccaaagtgctgatacattgttttaaatttaaaattgcactcgttcgttgttagaatatggaaaaccaattgactgttgtatattaaacttgtatcgtgcaaccttgctataaattagttccaggatttttttttttttttggttgtttcttcgggattttctatatagaccattatgtcacttgtgaaagacaaagacagtgttatttcttccttcccaaatctgcaagccttttattccttttcttacattattgtattagaaagggcttccagtgcaacactgaatcatggtggtggaagaagggacatccttaccttgttcctgatcttgggggaaagcatctagtttctcaccatcaagtataatgttagctggctgggtgcggtggctcatgcctgtaatcccagcactttgggaggccgaggcgggtggatcacgaagtcaggagattgagaccatcctggctaacacagtgaaaccccatctctactaaaaatataaaaaaattagccgggtgtgatggcaggtgcctgtagtcccagctactcgggaagctgaggcaggagaatggcgtgaactcgggaggtggaggttgcagtgagccgagatcacgccactgcactccaacctgggccacacagtgagactctgtctcaaaaaaaaaaaaaatgataaaggggatatcaccaccgattccacagaaatacaaactaccatcagagaatactataaacacctctacacaaataaactagaaaatctagaagaaatggatacattcttggacacatacaccctctcaagactaaaccaagaagaagttatttggaaaaccccattgtctcagcccaaaatctcctcaagctgataagcaactgcagcaaagtctcaggatacaaaatcaatgtgcaaaaatcacaagcattcttatacaccaataacagacaaacagagagccaaatcatgagtgaactcccattcacaattgcttcaaagagaataaaatacttaggaatccaacttacaaggaatgtgaaggacctcttcaaggagaactacaaaccactgctcagcaaaataaaagaggacacaaacaaatggaagaacattccatgctcatggataggaagaatcaatatcgtgaaaatggccacactgcccaaggtaatttatagattcaatgccatccccatcaagctaccaatgactttcttcatagaattggaaaaaactactttaaacttcatatggaaccaaaaaagagcccgcattgctaagacaatcctaagcaaaaagaacaaagctggaggcatcacactacctgacttcaaactatactgcaaggctacagtaaccaaaacagcatgctactggtaccaaaacagagatatagaccaatggaacagaatagagtccctgaaataataccacacatctacaaccatctgatctttgacaaacctgacaaaaacaagaaatggggaaaggattccctatttaataaacggtgctgggaaaactggctagccatatgtagaaagctgaaactggatcccttccttacatcttatagaaaaattaattcaagatggattaaagacttaaatgttagacctaaaaccataaaaaccctagaagaaaacctaggcaataccattcaggacataggcatgggcaaggacttcatgactaaaacaccaaaagcaatggcaacaaaagccaaaatagacaaatgggatctaattaaacgaaagagcttctgcacagcaaaagaaactaacagagtgaacaggcaacccacagaatgggagaaaatgtttgcaatctacccatctgacaaagggctaatatacagaatctacaaagaacttaaacaaatttacaagaaaaaatcaaacaaccctatcaaaaagtgggcaaaggatacgaacagacacttctcaaaagaagatatttatgcagccgacagacacatgaaaaaatgctcatcatcactggccatcagagaaatgcaaatcaaaaccacaatgagataccatctcacaccagttaggatggcgatcattaaaaagtcaggaaacaacaggtctggagaggatgtgctggagaggatgtggagaaataggatgtggagaaatacactgttggtgggactgtaaactagttcaaccattgtggaagacagtgtggcgattcctcagggatctagaactagaaataccatttgacccagccatcccattactgggcatatacccacaggattataaatcatgctgctataaagacacatgcacacgtatgtttattgtggcactattcacaatagcaaagacttggaaccaacccaaatgtccatcaatgatagactggattaagaaaatgtggcacatatacatcatggaatactttgcagccataaaaaaggatgagttcatgtcttttgcagggacatggatgaagctggaaaccatcattctgagcaaacgatcgcaaggacagaaaaccaagcaccgcatgttctcactcataggtgggaattgaacaatgagaacacttggacacagggtgcggaacatcacacaccggtacctgtcgtggggtggggggaggggggagggatagcattaggagatatacctaatgtaaatgacgcgttaatgggtacaacacaccaacatggcacatgtctacatatgtaacaaacctgcacgttgtacacatgcaccctagaacttaaagtataataaaaaaataaataaaaacatttgaataaaaaaattcctttgttagccttctcatatcgatgggattaatagtgatggaacttctttaactttttatatttgtaatttcctgttttcatttttattaattgctgctctggtttttattagcttgagagatcaaaaactcttggtggccagccttaggagggaccccacaacttgcgtgagttttaccccttagtaggttctcaaggcgaagatcaggaaaaaatcccctgtgcttctggcaggaggaggagaaaagtaaccattttgaaatatacccagaggactctgttctccctaacaaaggtctcccctcaagctagtccacaccgcgtctgtagcccttagtcaatcaccctcccaatgttcccacccaatgctggctccagtggcagctgctgctcctggcaagctctgattctttgtatccatcgatctctcagatttgagcagcctggttccctggtgaccttgattcactaaaggaaccaggaagagctgctgattttcagtgtgtttggctttcttcttgttgtgggggctgagtgacaacttccttgctccttacaagttgggctggaatcagaagtgagttcaatggacttttatttttttttttctcctcaactaaatgcaactcagatcaacatggaaaggtaacacgtaaagcagggacagtggcaaaaaccagacaggatgccgggaagaatattttaacttaagattcagtcagagataaaagattaaaataaactttgtaattatctttccacatgacacatttataaattcctgtaatttcctgtgccaaaatatattttcaggcatctcttttgatcatttaaacttatttttaaaagctttacatatttccttttacacaagtaatggaacacagaccagtcagctgtattgctaaacattacaaggatattattacttgttttaaacaagtacctgccatagcacattctgatatctggaatatgattctgacagcaaagcaaactgactaaatgagtcccatttactgaaacgacactagacaaaactgcttctcagatttatgtagctccaaacatgtgcatgcgtacagagtcctctctctccgcacacacacagttgttacgcacacaatggaagacatcactgtgcttgtgaaacctgtgttgagagcagacagatggcggttatcaaatactttggcactcatacacaggagacagttacatctcagaggagtgtaacttgtgtgaaggctaacgctggcactggatccaaacctgtgcaaatagccctgtgacaccctcttctactgaaatatatgaattgttttaggccatcggggtgggctgggaaagagttttaaaatataaatagagaccaggacaatgactatatttatttagaggtgacaacatccttaaataatttaggtcagctgacgcaagcgctgagaagctgaacaactggcatggtgctctatcttcactgccaggccaggcaagggggccccagctaatgctgctccgtgctgatctgctctctgctcctcatacctgttggtatcgaccttgtaagaaggttcagatccatgagtggcccgtgatgactgaacactaaatggatgttgggagaagctcatctctctgtggatgctctctactcacgcaggccacctcgaaggagaagtctgattactgcaagttgttacagttcagtgtatacgatattttgataatacacagagagtgtttcattgcagtcaaataatatcttgagctctcacaacagcaaacttcaggaacttcaaaggaattccagtccaactggaaccgtcattacaaaacaaatcttagctttattgttagccagaccacaaaggggcagagactgtgccaaagtaaatgctcttgagatctctatatattacctttgaacaattaattggtctcctggagacaaggaaaaaaaaggaaagaaaacaaaataaaagattgacaatgaaatatattgttcttggatgtcacagcctggataagccatagccacattgaacaaatacctgccaaattgatcattaatttcaactagtctgtaatttcacacattaggctaagtcttgtacactgaaattacgcgcactttgtagatgatattttcagctggtcacaaagaggaaattctactgcctaagaaaataggcatccagatattcaaagaccgggcctcagaggtgaacttcacttatatgaggcatttctctgtgctaccatgaattcttgatgtgcgcccttcatccacctgcttcctcgtggcaccttccaaaccatccagacatgactctaagtcatcaggttaatgaacaggacaggcagagagctgagtggcagtaaataaacagggcctgacccctatcagaatttaaatgttttgggatcctgaccccaactatcagcatttgccaacattgctagttctcctcttatacctctgccttccaaagtaccacaccaatgagggtgcaggccaggtgttagttctgatccggcaccgtgacctgacttctcacacggaaagcagcgtggaccttctggcctccctcccttgggcgcccggccaggacacgcaaggtcatactgctgaggccctttgagatcctcgagttaaaggggcccataaaggcaaagtgtcatgaacggcgtatgttccaggtgcatcacttgagccgccagagccacataatggtttgcctggtaagtgcctttgcccagcatgtgcccattgaacaaaccacaaaaagatgactgcaaaggggtcttcttataatagggcctggtgcctggtggatgcccagagcccttgccatttctgaaatggacataagtgacctaaaaggcagcttttcatgacaggttaccctggatgatgtttcctaaagaaaagtcacatcagtgggtgagacagaatgtaacaactagtctgttctctctcaccgttcacatttactgttgcctcctcggcagggaggataaaaagaaagaagtaacacaaatatactctcacatacatcgaatatacatacacatgctcacacatacacacacaagtgcacaacacactcatacacatacgtacacctacaaatacacacacttacagatacacacacctatatacacacacacacacctcccccaccgagaggcgatgagcacagggcatgtgccaatgcagaagaggactgtgtctacacacctgcctcctcacagtgtcctgccaccctgccgccaagacacgctggtacttgttgggctgtgataaaagcttctgcttggctgccatgggtgacatcttactacagattctgttacatggtgggatatgtcactgcattttcaatctgctgtgttctagcatctacagtcccaaaatggctcaagaagaaagtggtcctacagaggtcagaatctgaggttgtaagaaattatgaaagctctgccattcaggacaagatggaaatcagtgtggctccaggtgaggaggaccaggcggtagacccaggcgcacagtgggaacagtctacgactgccagggaaggcctccggtggagagtggcatccgccagctccctggcagccccaggcagagaggccaggggatctcaccagcaacccccaccataaagtgctggaaggtgctaaagagaatgccgtgaatctgattttcaaaacaccactcagtgtgtctgtgcagaaatgcactaaggctggagtgcagtggcacgatcacagctcactgcagttttgacctccctgcacgctggtgatcctcccatttcagcctcctgagtagatgggactataggcacgcaccacagtgtgcggctaatttttgtatttcttatagagacaaggtcttgctatgttgcccaggctggtctcaattcttgggctcaagtgattcatctgccttcgcctcccaaagtgttgggattacaggcgtgaaccactgtgcctggctttttttttttcttaatatggaaagatatgagatttagatttagaagacctggctccacggtatggccccttcacttacaagtctcctggccttcagtattgcgtatgtctaggtttatgaaatgccttttcctcccaaaactttgatgtttgttaaatacctatgttttaccttcccaagtaatgcaattatgagtaatttcatgatatgtctttattttattctataatttattttatgacaaatacaaaggaaggagtaaaaggaatctatgtcccaaaagataggtacacttcataacaccttcagacagaaagaggcagcagtgtctgagcccaaacgagctcctctgccaacccccgcctcctcaggcctccactgctaccaagctcagcctcactgctggcatttctggtcagcccacatgaaagagattgaggcttgtgccctctggccatgctggtgccattgccactgggaggaccggggactctgtgtgcccactaggccaggcaggcgggcaggccagtcagtgaggaatctgccccagtgctgatggcctttcatttttttttttttttttttttttttttgagacggagtctcgctctgtcgcccaggctggagtgcagtggcgcaatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggcctcatttttttagaaagggaaatctggatatttgggtgaaatttactgacattttaattcaattaaagaaagcacttctattggcctagttggtcctagaagcccccaatataagacccgtggctgggtcatggagacggggtaaaaccacgcacgtgggtgagcacgtgggagtctcactatgccgacgtcgacatcctgtctctttgggactggctcctacagcacacattttactccagggatggctctaggtttcttttgtttgttttttgagtcagagtcttgctctgttgcccaggctggagtgcagtggtgcaatctcggctcactgcaagctctgcctcccgggttcacaccattctcctgcctcagcctcccgagtagctgggactacaggcgcccgccaccacgcccggctagttttttgtatttttagtagagaccgggtttcaccgtgttagccaggatggtctccatctcctgacctcgtgatttgtccgcctcggcctcccaaagtgctgggattacaggcgtgagccaccgcgcgcggcctggatggctctagttttaaaggtcttaggatatctgcctcaagccctgtcataatggagaaattattttaacccaagaaactctggtgggaaacatgtgagagggccaggaatcccgggtctgatgcaccatcttctcccacctttagcaaataggatgtgaccactgccctcatggctttcaaggatgaggatcggttattacatagaaatgacacgatacacgcatttgggggaaaaacctttagacatgagaggtgcttttgtctcacttgtgtttttcctaaacttgatttttagttagtttagaaagttcccttggacacgttcaacttttcataactcgtgagatgaagtagtaggctcttggcttctgacattcaggtaatcacactgcacctgtcctaatgtcctctaggttatgaacagaagtttttctaagttgaggcataacacattttatactgtaatagaaagagggtgggttttgcgatcggtaggcctggatccgccctctatcagctatgagggtggggtttgccatcggtaggcctggatccgccctctatcagctatgagggtgggttttgccatcgggaggcctggatccgccctctatcagctatgagggtgggttttgccatcagtagacctggatccgccctctatcagctattttttttgtattttacaccactcactctcttcaggcctcagcttcctccttggtgaagtgggagtcacagaagtagtgacttcaccgtgctgtgtgagcatccgctgaagtcgtatggaaacaccaggatgtggggcggctggaagtctcccgtgttgctggtgggaatgcaacagggcagagcggttgtggaaaacagcctgagcctggccacagacatacttcccagatgaaccgtgggctcactcaaacgtatgtaaccagagcaataaaaacacatgtccacacaaaccaggaatgcaaatgttcacagcagcaacattcgtatcatccccaaaggaaacaacccaaatgagcttcaggtgaacggctgtgcggcaatgcatccacacgaacgaagactatgaaatgaatgaaaaggaacgaacagacacaccggggaacatggtaaatctcaatgacattgtgccaggtaaaggaaggccagcacaaaagacacatactgaaggattccatttacacaacattctaaacttacagtgaccagaaaaggggcggtgttgggggcaggactgactacaaagcaggaggagcgagctttttgctggggctggagatggtcctgtcttggctgtggtgatggttacacaactgtatatggccaaaactcatcaaatgtacacccttagtgggtgatttttattttaaataaattatacctcattaaagctgggggttaaaccgagtccagcacctggcaccaagtaaatatacacagtaaattattcatcctcttcctgttagttgccatttagaattatcaacctgtgcctgccactgaagccacaatgatgtcaggcttaagtgttgcttttctccttcaaatactatgacacaaaactgctccctctctcccccccctttttttttaactacttacccaccttaaaaaaaaggtagacttaattaacacttgtaaagcaccttgagacacttgaattaaaaagtaatagaggaggctgagtgcggtggctcatgcctgtaatcctagcactttgggaggccgaggtgggcagatcacttgaggtcaagagttcgagatcagcctggtcaacatggtgagacccccgtctctactataaacagcaaaaaaattagcccagtgtggtggtacatgcctgtaatccaagctacttgggaggctgaggccggagccgagatcacgccactgcactccagcctgggtgacagagcgagactccatctcaaaaacaaaaaacaacaaacaaacaaagtaatagaggagtatctggcactgctattgctcttctgttttcaatgatgcaaacagtatagctctttgtttgctaagcgactttagtaagggtttttttttaattaaaaaaaactgtttaatctgaaaatgaaattcaaaggcctgctgacaatatattcctcgtctccattcatgccaacaatgactatgccagcgtttgcagatttatgcccatggattcccagattgggagacaggaaatgggtgtccatcctcccccacctgcagttccaagctggccgcacagagcacagggaggttggttgctcagaacgtggccataacatttaccaggaaaaacggagtgaagaggaaggatgggaaggaatggaggggcacaggatggagattttcccaatcaagttggggaaaagtatggctgtttcactcagcatttctctgcttcactaattaaaaatgattttaagagctaacaattgcaaaaatcttcttaagcttatcagtgaattcctgaatatcccctggtgaagtcttcctttggcatagacgtgcatgcccgaatcttaatttctctctagcattctgggtgatcatgccataaagcacaggccgtggagtcattttctgagacaagaagtcgctccacattgggctttctggctggttctttttggccgtgggtctggttacagtggtggcagaagaagcgaagtctgtagccctcattacagaccctttgctggctgggggcatgtggctgtgagagaggagcagaactgaagccagtttctcctgctctgcactctgaaacccgagatgacgcggcctctttcccgcacaacagtgtagagcgttcagttggtgttatgacttgtctggttcccacagaggaaggaatcctgccaaatatttgtaatctgcacttaagtatgcaatcagggaaaccacacccagaagcaagtgcatggctacataattaaaatggtcttgctggaagaccaactggaaatggttggagagggtgtggggggaagctgatgagtgagtgtcactgggatctctgacactttggccatcattctctgcaaaacattttctccttagactctagcaagcacgcatctttctctgtgtccactgattagtcacagtatttgtctttgtataaccatttaagaaaatatttgcatctatttaaaggatctaaatagatcccccccgggttggcttgtatttatggcataagccataatggaatgtacttatatgcaaaccatctttccctctgagtaaagcattttggcacattttctatgacagcactgagtcacagtgcacagtacattaacgcagcaacttctgaaattgagctgcccaggttgcagggctggcaatgctttataaaagggttaaaaccattcactctgaggtactggtaagataaaggactaaacaaactaatgtgttatccttggaggcaatacaatttttttaaatgaaattactgaaattagtaaggattaaatttaatttttatagtcagataatagctaccagcagcgccatctgttgaaatattccaaaacttcatttcctgcatcccaaataatatttacttaaaggaagatacaaatgtttaaaatcacaagtaggactggaactccatcctcagttttaggcaaaatcacaactataatattttccaggacaagaggcgccaccccgtttgtcaggccccagagatgtccttacctacatcagtaaccccttcaaggttcacgaaccttctcactgacaaaaaactcccataacagaaacgaaagagctcctgttcaactacagcaacacccccaaggcttgaacatcaggaaggacgtgaacagcacctgctacctagactctcccgcacttcacgggctggttgggtttcagacctggaagtggcgcaggcctccaacctccaggggaggaggatgaggccaatgttctaggtcaaggtcttgcctaagatcagacaggtggtaggtatcaaggtcaggagctgcattcaggccccaggtgttctgaatttcagcccagaacgcttcccattggattccagggccaatactaactcctccactcagcaggccatcagcaagctcctgtgttccaggcaccgtccttctcctgtgttccaggcaccgtccttgacactagggagagagttgccagcacaatggacagggcccttagccatgcagcttccattctagcgggaggagagacacaaagaggcaggtgaagaacgtgaggggggttcagagaagccacggaggcttctctgatgcagagactgaaagagtgtggggagcagtcctgccctctaactttctgggggaggagcaggtgtcagtgccccaaggtgaagctgaagggtcagtgtggttggagagagggcatgggggtaagagggcaggagctaagcggggtgaggttggggcggggcaggtcatggagaacactgtaagctgcgggaaggacctggaattccactgagagagctgtaaagccacaggtgggttctgaatgagaggtaatgtggtctcacttacgtaaaaagtgccactatcttcacaatgggctgtaggagggcaagaatggaggccgtgaggctcttaaatccacagcagagaggatggcggctttgtttagcggggcttgggaggctggtgagacacagctggattctgggttgatttccgaaggagagtgagtgaaccgttcgctgatggataagttgtggggtgtgagagagggaggggagtcaatgttgactctgatgctttggggtttcagcaaaaagaataccagcatttgctgagcacctactaagtgtcaagcatattttctctaccagtctcagaaactctcaagtgtgggcatttgcccccattacacagatgaacgacggctcgtggaaaccccgcaccttgctatggtcacgcacgtggagcgtgctgtgtggaatacaagctggtctacctctttttcttcctcctacttggatctgcttccagcaatcaagcaactccagttccctccaccttctaaagtttgtgtgtgtttctacattacatcctctccgtgattctcctctgaaacctctccacgctcttcaaagcatatatttagctattgagtcacaaatccactgcagctctcatgaggtctttatcttaaataccagccaaaaagaaagaatttgcctggggacttaatactcccatgtagagtttaatttatgttaaacgtatttctgtaatggtcttcattagaggcaccaagatgggatacagtagctattatataaagatagccagctaacacttgtgaggtatatgcagattttgggggtactgccttttccaattgacagcatctgtttgaggaatgtgagtttattttatttttttaaagtcagctctctacatattcctgcaagttttggaagggaaataaatgatagcacttcaacatcagccattttccctaaaaatcacttaaaactgacattagagaatgcagatgtggatgatcattactgtagaggttactttcttataacatgttcttgctatgagggttgcattgaaaaatgaggctctgaaacgataacctttgggccataataagcaccagtgaccttttacatggacagacacaaagttatttttattaaatcaagctgaggttgtggttgtgtcagatatatatttttaaccatggtagagttgcaggaggaatggcctgtgtgggattccatacttcaaacttggtagaatacagttagggaaggattctgcaaccacttctctcttcctcttcatcggactgctccacacccaatactgcaaacatgagtcaagagagcccataaaattacccaagtgtaggcctacctcacaatgaatacttgaaagctttcactagcattataaagtaacttttcattctttgaatgatctgtctcatgagtaatgtcatctagcaatgtagcaaggtaggacactccccctgaataacaagcagtgtggaactgaaatagagatataatgttagaaatgacaccacctctttgaatcagatacatttgtatcttctggtataagacaatggatattaggagtaaatatgttcctggcaaccctaagtaaacttgaaaattcagggttgagcccatccctcactgacacacaaatctccttcttattgcttttctgtcctgcaactatttatcttcccaggatttttgtccaacaacattgtctacaattctaattcaacggtcaccttggcaaaggattaatatactgtaatgtctagcaaatgatcacctcataaacgtcttctgaaaaattgtaataaagtgaagacgcgtgatttccttaggtcaagaggagcatacctggattaatcataaatgagtattcacactggcttacaacagcatagaaaacaagttgaaatatatgtagataacataaagcatgaccactgattaataagattgcttttattaatcaaaataaaactgggtacccatctgtaatcccacctactagggaggctaaggcaggagaatctcttgaacccgggaggcagaggctgtagtgaaccgagatcgcatcactgcactccagcctgggagacagagtaagaccttgtctcaagaataacaataacaaacaaaccaacccacaaaaaactgggcacccatttacatatacaaataatttgagcatcatttgttttaaagaaaacatcttttgctgtgcaaaagctctttagtttaattagatcccatttgtcaatttttgcttttgttgcaactgcttttgacgtttttgtcatgaaatctttgcccgtgcctatgtatggtattgcctagattttcttctagggttttatagttcgagattttacatttaagtctttaatccatcttgagttaatttctgtgtaaggtataaggaaggggtcaagtttcaattttttgcatatagctagccagttctcccaatactttatgaaatagggaatccttcccccattgtttgtttttgtcaggtctgttgaagatcagacggttgtagacgtgcagtcttattcctgagtccccatcagagtgaacagacaacctacggaatgggagaaaagttttgcaatctatccatctgacaaaggtctaatatgcagagtctacacggaacctaaacaaatttacaagaaaaaaaccaaacaactccattaaaaagtgggcaaaggacacaaacacacacttctcaaaagaagacatttatgcagccaacaaacatataaaaagaagctcaacatcgctgatcattagtgaaatgcaaatcaaaaccacagtgagataccatctcaaaccagtcagaatggtgattattaaagtcaagaaaccacagatgttggcaaggctgtggagagatagggacgcttttacactgttggtgggaatgtaaattagttcaaccattgtggatgacagtgtggcaatttctcaaagacctagaggaagaaatagcatttgacccagcaatccaattactgggtatatacccaaaggaacataaaccattctattataaaaatatatgcacacatatgttcattgcagtgctagtcacaatagcaaagacatggactcaacccaaatgctaatcaatgatagactggataaagaaaatgtagtacatatataccatggaatactacgaaaacataaaaaggaatgagttcatgtcctttgcagggacatcgatgaagctggaagccattaccctcagcaaactaatgcaggaacagaaaaccaaacaccacatgttctcactcgtaagtgggagctgaacaatgagaacacatggacacggggaggggcacacacactggggcctgttgcggggggtgtgggggagggagagcatcaggaaaaatagctaatgcatgctggccttaatacttaggtgatgggttgacaggtgcagcaaaccaccatggcatacgttcacctaagtaacaaacctgcacatcctgcacatggtccccggaatttaaaataaaataaaaataaaaataaagtgatcttagaagtctactattacctataccagtcttggttcaaaatacgtcttaagtgtccctttgggaactgccttaacagtgggtctacaaggcacattagaaaagcagttttatatggtatagttacagtgttctaaaatttattttgccctaacagctttattaaggtatataattaacatacaataaagagatggcatcctatctgtgctcctatgtaaacatatcatgtcctttttctctggctacctttaacatttttgtttatcactggttttgtgctgtatgattatgaaggacctcagtgcagtttttttcatgtttcttttgttgggatttgtggtggttaatactgaatgtcaacttgactggattgaaggatgcaaagtattgttcctgggtgtgtctgtgagggagttgccaaaggagatcaacatttgagtccgtggactgggagaagcagacccaccctcagtctgggtggtcagcatctaatcagctgccagtgtaaaagcagacatgggaagggcagacttgctgagccttctggcctccatcttcctcccatgctagatgcttcctgccctggaacatcagactccaagttcttcagcttttgaactcttggacttatactagtgatttgccaggggctcttgggccttcggccacagactgaaggctgcactataggcttccctgcttttaaggttttgggactcggactggcttcctggttcctcggcttgcagacagcctatggtgggacttcaccctgtgaccatgtgagtcagttctcctaataaactacccttcatatattcatctatcctattagttctgtccctctagagaatgctgactaatacagggtttgttgagcttcttggatatttgtgttcgtagttttcatgaaatttggaaaaaaatgtttagcattatttcttcaaatatcttttctgtcctcccctcctttttggggactccaattacacacatacattagggcattggaagttgtcctccagaactgattctctgttaatttttttaaaattctgtttttctgtttcatattacatagtccctattgctacgtcttcaagttcactaatcttttcttttacaatgtctaatacgccattaattatgtcaatgtaattttcatgacagacattatagatttcatctttaagttcaatctgagtgtcttctttatatcttccttctacttaactttcttaacatacagaataaggttctaaaaattagtttaacatctctactgctaattctaacatctgcatcagttctgggttgattttgattggttctttttctcttgtttaggggatatattttcctgcttctttgcaagcttggtaattttttattggatgccattaattgtgaaatttatcttctggggcagtagatatttttgtattcctgtacatactcttgaacttcgtttctgggacccagttatgttacttggaagcagcggtacttttggctcctcctttcgtgatttgttaggcaggtctggagcagccagtgccccttctaagaggcaagacccttccgaacaccctaccaatgccctgtggattttaatcttttccagtctggctggtggaaacaggccaccttcccagccctgtgtgaacattcagtactgttccctctaatccttttggatggttgttccccagccttaggtagtttcctcctgtgctgatcagcactgccctgactgctccaggggcacctctgcagatctctggagcaatcactgcaattctcctcacctctgccctgcgttctcttaccagtccggctgccctgaactctgtcctctaagcttagggaacttgctgggctctgcccgaatcctgtccccatgcctcatcctgttcagtctcccagcagtgagctagggtactcgaagggctcacctcatttgtttcctgtatctcagaggttactgtcctccgttgcctgacatccagtgtgtactaaaaaacatatttccatatatttttgttgttgttgttgttgttttgtcttttgggcaggagggcaaatctgtccctgtcactccatcttggctggaagtggctgtcttaatgctagtgtttagtatcactcaatgcggccatcaacttggcaagggttgactttggattactttttcttatttcaggaaaataaaatggcaaagataaagttctgttactagcaagcacagttactagtttgttttctctgttatcatttactgagcacgtgctatgtaccctccaagtaggctgtgctttatgtacatttttcttattttaatctaacaaacttataaaacaaatactatgagttttattttatataagaggaaactggaacttagagagtcaaataacttgcccaaggttatacaactagcaggtgacagggctgagttgaaaacaagtttctccaattccaaagactgtttttattcactgcagttctgaaggcactaaagagaagatcctgggcccccaaagtgtgtttgaacaatggtagcattgttaaaatacataattctctgatgacttgacaaagcataatgatgccaattactctcttttactgattctactatgctacggattgtaagaggtactattattttatctgtccgtaagaaggaaaaaaatctacccattaaaccacagcatagtgttttagatgccgttaattttagggtggatctcaattttagcattgttaaaaaagaaacaatatgcatattaaaatcaataaaatgatacagtatcatgtactgggtactactgttgcttttgattctttcaacaaccctaaaaggtagtcattgtggtatgcatttacagaagtagaaactgaggctcaggctcaagggtaggtgacatgtctaaggtcacactgcagtaaatggcagtgccagacttttgctacttcttatatgcttgtcaaaaaaatcagtcctattaaaatcaaacatatgcttttaatggcatgtcaagcccatgtgtgtatacacacacgtctgcacacatgtatatgcctaggtgctccctaggagttatatttgctttagtagcatagcaagaggtggaaataggataaatgagtgtgttggcagaatgacatttctcatctgcccacaatctagtgaataaacaattacgtcgtgaaggttacataaacttagaaaaagcttatagtatttattgcagcaataaccaaattttaaactaggacatacacctgtccaaatgaaaagtacctattacttttatagattcctacctagttttgtgcagtaagacccagagccaaccctgctttggaaggtgtttgtctaacgttctttgagtaaggaatgcttcctcacaataccacagaggagggtgccatttcaagtagaatttctttgttttcttgttaattctgtatctcttcagtgtaaaacacagagaacagagtcatatttctttctatgagcaaattaaaaaaaaataacaaacttccctgaggataaaagtgtgaggacggtcatttacttggattgacaaatgcagcccatgacggggtccaggaaagctcgtctgcacaatataccaccagttcactaggtgacgtggagaatcctgaagagtctggctactgtttaagatcctcatttctgatatgagttagaaatctccacagtgagtgaatcttaaatttggagtcttctgtaaaaactgaaccaatgaatagcattgaaacggtagaatgaaattcaactacctttgaggcctcacatcagtaatcccctctacaaaatcatagttatcttaatgcaaagactgctgtaatcctggccttgcaatgcactatttttcatctgaatggttcaactgtgtgtcctatttcagaagaggaaggggtgacagtgacatacagggcacagattttctgtatgttatattggtaatcatagagggctctctcatgcagcagtagataacgtctaacagccagttctttctcaacatcagcatcagcatgtggccatgacaaatgaagtctggaagtagctcttggcagaatccttaaggctgcaacagaagatgtgtgcttttccctgcaaggcccctgtgtgcagggaccctgccctgtcactctgaggtcctggcaccgcctcttcagagtcccacgtgttcttttccaggctcaaacttaagagcctggtttccagtgacttggccctgagaacaaacagtgctgagatgaagcctgtggctccatgagcaagctgaacgtggccagaaggcaatcacaacattcttttctgtcttggtttttttttttttttctttttttttttttttaattttagctttgatgacaaaaacaatgctggaggagagtgagagcaccaagttgaacccacgtggaccagctttgacgatgaagctacaggcagccaagtcaactcacacatagagaaagtggaaaaagaacagaaaagcaggagacagaaacaaaaacatgcaggagagggtgattctgttccatgatcttggctcagtgctccagggttcctaatgtttcagcaaaaagaaaatcactgtaatgaaatgtaatgagaccctttgacactgaggaagtgacaactcaggcttggccttctaccacacacctataatctgtgacttgcaacagaacttttcccgaagagcgcagtcctccctgagcaaaatggctagggcctacgccgtgatttgctgctctggaatgggacacacatgttgctaatccttgcaaaaccagctgaagaaccattttcctcctgagaattttcttctgttcactgctaattttggctactttagttgctttgtttctcctccacttaagtaaatattcctcgagttgatgtgccaaacctctcttttggaataacagaaggtttaacacatatatgctcacagggacagcgctttcacacgttactgacagcttcatagacatcatttctatttctcctcaagacaagctaaggcagaaggtaaggcagacattatgatgtccatttcacagatgcggaaagtgaggctcagaggggttaaaagatgacctgatacaagtcatagagccggtatctggaagaagcaggagcaaagtccaggcatcctgatccaagctaggtccactgccttccactctggagaggcttcatctccaacagaggaagggacgtgagtggctggaaaatctcatggatgaagagcctcagatttcatgctccttggagtcacatggtaaaacaacaagtgtttggcctgtggttctgtcacttttaccatctgtgaccctggggtaaataatggcatctttaagcatttgtttttgaaagatggaaatgatgataattagctgattgggctgcagtgagaagaaaacaggctggtacatggatgatgcagagaagtatgtctgtcacaccgtaggagcccaacagcccatgcgttacttcagacaatggcagctgtttggctgtgtgagcccaaatgccataagtgggcatgtttaaggtggatgtgattcctacgtatgcctcctgaggaacaattaacatccctaaagattgttgcagtgcgttgacggcaggtgtcccccaaactctaagtgtcctgtggaacctggggcaacacactcacagcctttcccacagggcttcctccgagccagataccagcaatgtagacaaagcatttgggaagttggatcaatagtgaaggtggccaattcatcccaggttgcccaggactttctcattttcagcaagaataatcctgtgccccagggcaaactgggacagctggtcaccctgtcaatcatagagtctaggctggtaacaaaattaaaaagctagaaacctatttcttataggctattccttaatagaaaacaatgcaaaaaccttggcgcgctgcagcctcatgttctgaaccaatggttctcaaagtatggtccccaaaccaggccagcagcatcagcgtcacatgagaacttgttagaaaaacaaatttggggcaccatgcacacctcacgagtcagaaactgtgggaatcaggcctaggaatctgggtttgaatgagccttctgggtgtttctgatgcttgtgcaagtctgagaaccactggtccagaccataagtagaagtcagactagatgccaaggagaactaaaacaatgcaagctcacgagaggaagctttcttcctttgtcatgatccctccattttggattgctcaaactgaacggggaaaatatgatggaagcacttcctgctctcttgttccatgggaatccagtatggctgcggacgatcaaggttaaagtatctccgtaaagtaacacactgacaagaaaggcacctttaggggagtcaagcatatcatttcatctgtggccacatgtgaatgctagctatgtatatgttctaaaaagcaaagagtagacaaagaggagcgccgcccagcctcccaacaccagagtctcacttcctctcctcagctggcgctctggggccggactccagtaataacagcctcctggggagattaaagccctggcaagcacagtttatcttggtgaatgtatactttagctttgtgtgtatctacacatatacatacactgcagtatttatagctggtatacatgtgaggtagcgctggagacaaggcctggaatgggtgtacaacacctatgaggttggaaccaagatcttttaaacgcaaacctggtttccctgaactgtcctccacccgtgtggtccaaacacacactcaggtgtttcgggaagaacatcctccctccctgcaaataggggcagcagtctttcttctgtttccagaaagagttgagtattttgtggtggcttctttcatctctggggactttgcttattagaaaaatacacagaatcaccgctctcccgagtaaggaaatgagatggccgggaggtgagctgagtcaggaccgctgctttaagccaagtctacagggttggtattgaggtggagacgcttctcagagtgcagcacagcccactctgagaagggcaggcatgggggccatccggccccagtgcccacgtgtgcgcgaccctggacagagggcggcctccagtggcagtgctgctctgtggcacactgaggcctggtttcccttttttttttttttttttggtgggggcacatatttcctcaggaaggagcagataagttcctccttaggcttgtgaatactttcttgtcacctggccaaatggaattccaacgatattgtgaagaggcagtgccacttcacagcagacactcacaacaagccacagtcatggggtggtcaaaactcccaatctccattttcatgcaaagctgaatgggcagctcagacctttaaaaagtgtcatgaacacataggtcctcttagtctctgtctacttgacaagatctcttagtgtccatgtgtgatagaacagcacatgcctacactgtgtggagtgaggggctgccagagccacacggtgtagccttctgtcccccatggaggcatgggtgagaggagagacacaagacagagaggaagactgcacatcaggctgcggaaatgagcttgagggtttatgttttgaggttgcaaagaaaagaagaaaaataaggaagatgggggtggggagaaagaacaagctgggtgaggggaggaggagggatgtacaggagatggcctgaggcagccaggaggggtctccaggagggcctaactgtggaggttgctgagaggctagaggggagaggctggagccagtccagcctaacacattaacgcaggtgtaggggtttaaaacaatacgtgtcgatcctcttacgttcttggtgtgggcagggctggctgcctctagaggctcccggaaagaacccgttcccttgccttgtccagcttctagaggcgcctacaccccttggctcgcagccccttccttgaatcaccctgaccccgcttcgtcttcactgctccttttctgactctgaccctcctgccttcctcctataaggaccttgtggttaccattagggctccctggaaaatccaggaccatctccagacccttcactcaatcccatttgcaaagtctctggattatcatgtaaggtgacatagccacgtattctagaattagcatggggacttccttgggggtggggacattctcctgtgtgccacagagattaggatggcagcacgccgtctgctgtgactcctccctggcacagctgaggggcacacacagcctccatacgcagaggcagctggcctaagccctggggctcagcatctcacccatgttctccaggcccaggtgaggagaacagcagctcacacgtgcagaatgtgaacattctgcaaaagggagatatttttgcattctttttctatagaagaaccaccccctccgcaccgacaccaaagtgtatgagctcccacaaaagttggatctgtccctgcatactaattttgtccatctattcaaagtgcagggaaaggaacatttctttaaggaaaagtcttcatgcttcttctaatttatctgtatatgagaattttttaaagtattattagaaaacttctcacctttattctcaattactctgcgaaagtttttatttttactctggattttaaaatatgcttgtggggaagaaatctacaatcccttaattccattttcatatagtcacaaaatcatcagaagaaaatggaattttctgttcagattaaatacagctcctcagtaccactgaaagcaggagggaagggagagcctggggcaagttccatagactctaaattactagcttctgcaaatcattagtttctcccctgggagaaaagcagctctacagtcttctggttccgaggcaccctcagcagagtcaggagctgcacggccacattttaaattctagtgggcacagctaaaacaggatgaaccgaagtcggcctgaatattgggacactgatttgaggagagagatggcaacgtgggacaacagcatctgattttgatgtcttttgtctagtgatgtcctatgcggtggcaagaaagaagactgcaggtgccagcacacctcgcgctgtccctcctcgggcccagcactgggacctgaggctgagcagtccacctccaccaagaacaggaatgcctgacactcaaaggccatcccagccccagttctggaaatccgagaccctaactgtactttaaaagataactgacagacaggtggcaggagtcaagaagggtcagtcataacttatcctattcgtaaatcataacagtgaagtgcaaaatcccaggaagccagctcaggctgatgatgccgccggggtgacaaaccagggactaaaaagtctgggttcaggaatctttaggtaattaactgtagaatgactagatacccgcctcccatatttacagcgcatgcctttgctaaacccatttgccctccttcatttcttcctgtctctctgcctctccctcccttcccttagcgtggagtacatcaatctgtccgaagggataaactatatttgtgttaagctttcatttataattaaccagctgaccccaattccacacataaatggcacttattatttaaaaaatacaggctacatttctttcattgttcactgtgtcattatgtatacataatgtttccttcccatagagaataaaataatgaccaaagttctgtccttcaacccaatgtctccacagtgtgtctttccacccttgttaaacactgcctgcttacatgttttcaaaacacatgacccgcatctactctgacactttcccattcatcgacagagcaacttcagtccttaattagggcagtgtttgagcttaaaggcaagtctgtacaattgaaaaggtgcatattcaaaaaaaaagaaaaagaaaagatgcgtattcaaatttctgagggagtaatagcgtggtctgtgatgacaaaactaaaaataatttattacattttattttccaacgttaatccattaaatcaaaggtcactggggcagaggtcttattttcaaataatatatatttattataataaataaatgtatttataaattcttcctttccatacctctataaatgtgcctatttctgtaagtttaaagtaagttccttacaactaattatttctgtttactgatgacaggtatgacaattttatatggaatgaaacatgttctgattcaaagagaagtagttcttccaaagtagctgaaagctgattcacaacacaggagtttgccttttacaggcagacatgatgttataaaatgtcagatggccaacatttttgcgatgggggtgtgagagattcttctcaaatgacgcacgcctctcttgggtattatcgaactagaaactggaatgccccctttaagacaaggaaagtttggaagaaaggcgccacaacgccagtcagagctggcggttttctcagcaatgcctgatgcaagctcgagctttgacagcagtagctggactccgactcttcgtaaaggtgcagcttaactcaggcactgctagagagccttggagagaattacagacgtttagagtggcaggaatgcctggtatggctccttggtttgagtcagggcagagggaaagcagcacacacttcagtcagagcatagcctggcctaaaacatgagactgtattctgttctctcacccagagtcttgattaaaaatattctttgcccatttaagagcttgatgtgcagaaccctttcctgatagcattgattctggctcggttttataatttcactgtatgtgggaggagtagttaggagggcagagaaagcagcaccaaaaagatccacacttgctatgactgaagctcattccatagggaagataacagagagccttggagagaagccaccacgttgtccctctgtgggtcccccagctgtggtggcattaatactactgttgataagggtggtggccacctgttgggaaccctggggagatcttaagagcttcagcaggaaagtttctgcaaggtttcaggcggatgcatttaagccatcagcactcagggtcttggagctctggacattggatagcagataatgtccgcctcactgcccatctggtgaccctaacctcaatctggggaaatcgcttctctgtgaaagataacttcggctctgtgacagctccaccccaaccctcgctaagaggagggccaatacatcatgttgacttatgactgctggggtttgtatcccagatcactctccgtgaggatttcctaagccactggaccagagtccacatgtgcagagatgagttgaagtgctgaacaaaacacacgccctgagctacagctgcagtagcaccttttgggggaaggaagccgagatctttcttaagcataatgaggacaagcacatgcagtgggttccttggtgtcggcaactcctgtgtgaaacagaggagttcctgcatgctggctacgtgggcacagggcatggtagggaaaagtgagctggggtaaatggggtgtgctcactttgttctctctctctgcctcctctgtccctgcctccacccctctggctcttgctcttcctcagggagagcagatgttttaactgatagtttgtaaatattcttaaggcagacagttgctacctgacttcacctttcttatctccagttccacccgaaagtggtaacacagcatatccaaacatgccttgtcataccaaagagaagtctgtagctcagctagttagagacttgcattcaaaagaaaaaaaaaaaacttaaagttgcttttttatacggctttttctgtgctgggtggaagtccattcaaagctactttgtataaataaagaaatacaatcctcttccctactccccaataaagctgtggggcagcacgctggccactgtgcctggatgcgcctgctggcatctgccgaggtgtcctgccccacagctgccaggtgtactgtggggacatcattcacctcctgggcatcacactggtgtgaaagcagcccagggctgagctgcacttgaggaccccatggcacaggcttggttcgcactcagctcaccagtggccgcagggccaaggctgttttatttttggcacactgtgaagttgtatttctcccacaacttgatgttcagatctatgtttaagacttagagtaatcatatttctcttttccttttctttcaccttcggcattagcttcttgtaaaaatgaatttaagaacattgtccttgcaaaccagattatgtgtttctgaaagtctgtgcaccctgactttctaaggctcattcatcaccctattcatcatcacctatcatttgtctgccacagtgacaggcacgaggaagatatgacagcaagacaagacctcgttcttgactccaacaagttaacgtttttgctaaggggacaagatcaacgctgatgatacagtgagtcaacaacacaaggttgtctccaggctgacttggggctgctggctgtaaatgtaacagagcaatcagaaggagaaagaggaccgcaggggtgggggcagcctgaataaaggcactgagattcaaggcggggtgggtgtgggggtaaggcagccctgcctgaggaatgcacaggaaaccaggttctgggcactctgaggctggcagagtggtgtgggctccatgggggtgggcaacagagagccactgagggtaactgagcaagagcgtgtctgtgaggaaggaaggtcagtacgggagtaccattcaagatggtctgttggagcaaaaggaggaaatcagcaagaccaactagaaagaaacttcaaaaaattaaaggaacaccccagaaaggaagagggccaggacaggtggatgcggagcgtgaaaatatctgtgttgtgatgtcactgaaaagagtaaattaccaaatgcaccgggagttttgagcacagtgtccagtgtgtaatacgtacgcggtaagtgctcactcctgaacttccgttgttgtgggtattttcatgtgtgagaagagaaatacgtaaattggaagtaataaacacagtccctgcctgcgtggagcttgctttgtggattaatattaaggccacctggctatgacagcatttgttctattgttttggcggcggtggagaggggggcgggggtgaggggtgtgagggttcaagtacatacttgttcttcctaaaaagtacctttgaaactgagtcattgaatggttgtgttattaaagcatttaatagtactactcatgttgaaaatgctgaagaaagccaaggtggaaatttcccacctcagtaacttttgatggtaggatactagttctatagataattattaaataccactaaacgacaaagcgatgactactgaacattttgaccagtaagtgttgatagctgaccacatgtcaggccaggcactggggatacaaatggaacaaaacaccttccctatgcttaaagagccaaaaagacagtggtagaaatagacacaaataatcagagtacaggtgcacagagcctttccaaagcctccggagagcttggagttgagatgttttggctcgtagagacacaaggtgatgggcacaaaacacacaggtggacatttgccctgtgctgccaggacaggctgagttaggcttgtcctggtgctgcctctgtcccctgccccttgtactctcgataggcaggtggtaagtttgtagttaccctaatcccatctttctgagcagccccagcaccatctggccagcacaccataatcaaacgtgaatattccttcagcaaaatgtatgaacagttacagtaagtgataagaagacagactacataattagtcttgtgtcaggttgggccagattttgtaggagaatgggttttaagggaagttttgattttccctgagctctttggattttggaatcacggataatggactgcgcatggtgtggggctgtaagtgtgggtgtccatggcaacagaagagagaacgtctagctcactcctgggaagctggaggactttccagaggaagttccagtaaacctgagacctgagggaggaggagaggtagcttcaggagagtttgggaactggggagggcaggaatgaccatcaagttgcagtcctggcaggcggctgggcacccagcaatctggggctagacccacacagcaatgagaagggtggcggcgcagcaggaaggcccttgcaagaacaggtgcatctggggggcattaagccctgaagaagttttagggtgagttgaattcgtcattgtggaatagcaattaaccggttgttgataaggtgcctggaagttggaactaatatgggaggaaatagaatgattggtactatagcgggcaggcctcaaattgttggggcaatgaatgaagtgaacagattttcattcatttcgattctcaagggttgttatggttttgtatattaatcagatgtatatattgtgtatgatcagatgtgtgcggtgtgctggcaccatcgcggcacagctgatgattctgaggggaggtggtgggcaggtgctgaggcaggaatacaagaagtaagccacaaaggcaggcactccagaggcagcagcacaggcttagtgactgatcagaggtgggggcagcaaggcaaacaggggagtcaagggaagtgtccatgctgttctgcccatgtgttctaacctgaggcctgtgaaaaatacttgtctctttcctcatgcgtttctttattctaactgatgagaacgatgctgaagtctgactaacatacttcaccactgttttctttttgttgtaaagtcacacatgttcgctaatgaacatttggaaaacacaaaccagcggaggagaacccctcgcaggcccatcatgaacacaacactgctgttaacagttttgctggaacgaggctgggagcacgaggcgtccgcagcacgtggctgattcccagcgtttgctcacctgtgtgtaggtttccttatatggttgtgatcatactgtttgcgcatttttatgcttcttttttcacccatcattttatcccagacacttccctgagctactactccatagtctgaatggacacggactttaatggatttgctgcatggtggcatttggaaggactgtgctcagttatcccctatggttggacactatgctgtcgaacagatctctaaacctgaaggaaattgctttaaaggcctactctcatggcagtattttcgggaaggcaaggaagcatttggcatctcatactggttcctaacttatagccttccgaagtctcttgctgtcaactgaatcaggcacggaaacatttataactggtagtttgtggataacagagtagtattttagcagttaagtgaatctcaagtttcagtgcctctcaaatgttgcttacccaaaatttcaatattagtgttggttgtgaatagaaggaattaaaattacatctccattgtgctcaccagaaccacgtctctgctaaccatactttttaatgtgactttaaggaagcaaaaccaagtcataaggttttgaggtcaaaatgtgagctgaaaatattctgatttttaaaaatatctatctgttgatccatctatctatgtattgctcagaaatacttcttggtctcacagaagaggggaggaaaggcttcagtgacagactgaacagccacacagttgagagaagtaatcataggacactctctcaaaggccctgctccagagccctctcctccatggcgttgtccagggtgagcaaccagatggaggtgggctccccaccttcctcctcccaggcagcctggcatggcccaccacacacaggcctgggaggagctccccaccttcctcctcccaggcagcctggcatggcccaccacacacaggcctgggaggagctccccaccttcctcctcccaggcagcctggcatggcccaccacacacaggcctgggaggagctctgccactcacccactcttctgaaagacacatgtgagtagcacccagatttggacgttggaaagtgcgcttgcactgaaagcaattttacatatggtaactagacgcagttaaaatattttcattagtatttcaggcatgttattgggaaaataggcttgtgttggcagggctggggccctcgtatcatttaaaacacgctttctgggagaaaaaggttttcaagtaccaaatctgttgttgcaccaaagacttcacaaactaggctacatccttactattcacatgcgttattaaacattttctggagtaaggtaaggtataaataaatgaaatacaaataaacaaaaaacaaatacagcactcatccgattttaatggcatagaaaggaaatatccagaagtatcaagtgggaaaggtgcttgtccacaccctcctggggctctgagggccataaagaatcagccatttgctcaccatccacagaaaagcgtgaaacaaaatgcggcatctgggtatatctcaaaggtagggaaggaaacaactcgaaggctgtaactttcccgacacttgagacgtcactcctttgcaaggcagcattcccagcaggcagcgaagcgtgtttggagaagctggagggcagatgaggagtggagggaaggcgggtagggggcttgcactcgaaaccacctctgaaggcgttgtcaatacagcaacagcaacgaggacaaacatgccacacggtgggtccaagtctgaactgcccggggctaagtcagtcaccgcacaatcgagtatggtgtagctccaaagaatggatcgggcgagagccccactgcatcagataactggtgcatcaaatggtttagatcttgggaaaagcaggtttgggttttcctcaaaccatgcctattataaactgctggtagaatattccttttgaattaaaatctcatagtctattctaagaactccaagggcacatgaaagaaaggccagtgagcgccgggggcctctgggcctggctggcgttcctctgagtactgccatctgaaacagcaaaaggccaaccggggtcacgtctctgtacgctgcatctcacagctttgggttttaaatgtaaaaaagaagcacctttacatggtaagtaagtgtgtccagtcatacactaaaaggacaaaaagccattgtcaggtgctgtggtgacatgttcagttgggccctgacccttcctacttccagaaaatccctcaaagccttcatacctggtgcctgtgtcactggaaaagagggtgcagctgtctgatgtcccctgattgccgagaaccgtgtacactgactcagctccacaggtaggcatgacaggttatgtcccctgaatgcacagcaggtgtctgactgctggtttatagattcagaccattaagtaggtgcagatacacccactgcagcactgagaaaaggcaggagacagtgtctacagaaccagagtgccagccacccttgtagtgctgctgctgaggggcctggctagaaagtgcttagagcagctgtccttagaggctaatgtgcagaagggcaaagtttttgggtgacccagtgcacgtgatctgggaggaaagttgcagaggcttcgtgggggagcacggcctggaaactggctgtgccactagcacacagcgtgaccttgggcaagtcactcggcttcctggtggcccaatttcctcatctgacatgacaacagtgaagatcatgttccctgagcagctggaggaagtgacaatgaggctctgtgctggagaagccacggtggcaaaggccaacatctcagaggtgacgtgttgcctggcccccaggaccaggagaagcccttaatgcttggagctgattgtcacagatggaaggagaagtggacaagtaacgtgggtgggccttggctcctctgttccccaaggcacaaacccactcctctggctgcccttacatggctatttagactgctgcttacatgagagtacgtgcaaaaagaagaacttattgagaattaatgctgtaactaggatttagagatgggactgagagttatgtttcaaaaccagagcttgaagtttggggagaaaacaaatgtctcttctctcaacaaatacagtcctttggttgggctaaacctgcctaactcgactgaggcagggtatctatggaggaagagtttttgcttcatgcagcagcttttggcttaactgcagaattatttctggaaatagttaataaaaatcacacatatatataaaccgataacataaaaccccaaaccatacaagtacacttaaaataaatgactttgggtatttaaaaattgtttttatactgctgaagtccctgaagtcagagcccgtgctacagctgtacgcttcccaagaatcactgcttgtcaacactgctcctgcagaggaagactgtttacctccactctgcctgtcaagttgactttgtctctaaatgctctgctttttattactaccctccaccagaccggggaaaacatttgtgtatgtgtatattcctgagaagcttaaccacattactgctgagaacacagcagatctactcatcaacttggtaaagaaaccaatcacactgattgatcagatgcctaaaacagctagttgattttcttttccacgtctgcggcattcattcagtccctaaaccctgagcagccacctgctctggacctgccgtggtataaccaggctgtggtcagacctgatggagcttccgcctatcagagaactgtgtagggacaatgccctctggggcttcaccaaaaacaaccaaaacacacgtctgccctgacatggcagatacacttttgaggttccccttgggaatggtccccctagacctggagctctccgaggatggggtcagggaagctgagactacctaggcacaaaaatcttgacgtctacatttctatcatcaatttaacttcaatcggtaaatgatctggtgatactgccaagctcaatgtccaggtcctaagcacaccctcccttgcagggcgggggtgtgaatggctcttatgttccattggggagggcggatgtcaagctcttccaaagcacccctgtgagtttgtggagggcttaacgacagacttgtgaaggggttgactacatatcgtcagaaattataccaatgacagttttaatcactggacatgaacatttacaaaatacgtacacctatgaaaggatgtgccaagccaagcaaaaacttggggctggagaagaaaggagccggacctggcagttcagctttgttttctccgcatggacagctggacaggcacaattccctacaactacatacatgatgtattctgagcattttcccctggggggaatcagcttttatctaattcttcaagaggtgaatgaaaccaacaaggttagggacaacccaactgtgtgcatcattccctgactgcagcccagggcacagctgcccccacttaccgaggcttggccagcctcagagccggctgcctcaggatccctgcagagtcctacgtttccagggtccaccgctcaagtggtttgaggatgaatcctggaagactgtattttcaacagctttctggatgagtctgacgtactaggcttaagaaccatggactagggtagccacccttgacaaaggatgcctgcggttttgcttaaagtagtagtattgcctgagaagaaatgggttgcctctttaagaacacttgggtaacccacccatccacaacagctctgatgattacaggcaaaatgaaacacatgggtgggaaataaatgtacaaactcattttgccagtttgcaccaaatctgtgtatttgtggcctgtgattttggagatactactctgcaatttttgcacacgttatgtctaggtatggttttccatccaccttgcttatctctgtgctatcagcctgtctttgcctctgacaccccggctgcctgcataccccttccgtgccccttaagtgacttgggaaacttgtggaaagccatcttttccgtccgattttgtgcagcatggatgaaagtccctgttgattctaaggaatgagctgggtggagggacagtttttctggcatagtgaaggccccacccgagcaccagccaaacggtggctgctgagagcagcactgcacagtcaccagccgaacatgccccccaaagccccatccggcccctcgcctgagccttcattaacacccaacacttctcctctgtttacaagtttatgactgcagcctactctctaaccctcttcaatgcttagaaacggactctaagatcacgagaaaactgcaagagattggaggtttggggcttcagatatagaaggtatagaagatgctggaaaattcagtcagatacagaagatgctggaaaattaagtcagattaatccagactcttggtttgaggaattcttttctttgatagtaatcacactattctgcaatactccggtatctttgatcataagatctcaacatgcttcacaaacactaatttaacctcccactacttttgtgaagtttatcataatcatccttcacttaggagatagggaagctgagatgacgtgtaaagtagaagatgtaagtagctaaatgaactttgaagtgctgtgttcttatcttagctcctaattattttgactgaagtgttttttcttatttccttcagatgaataaactgatatcgatggtttacataaacaacagaaactgcaaaacacacattcctaacttgctccctataactaagcctggggtgcaaaatgtcactcacatggagagaagacgcagcagacataatggcttatcatcaactcagggtttgaaacaaatacccactttactttgatgtctctgatgctgaccacaaagtatgagggtatcggaaagctcagaagttcagacagaagttcaattgtctgaaaaagttataaagatggagaaagggaaaaagcaaaagggttgaattctttaaaaaaaaaaccaagatcatgaaacaggcagaaaggaagaggagaatatttctagcaagcaataggttattaagtttggatttcaatagaggttgttagcagaacaatataaatattacttagttggagggctgaggagaaagtggtgtgaatcagaaagcctgaccaatgtccgtggatgaccagggacacggggcagacacaaggccgtttctgctgcagatagtgagaaggccatgccatcatatctgcgtttctcccaaagcaacaaatccatcaacacaagactatgtagaatccagccacggatgtcagactgacaagtcagaaatgtggtagatccatagtggccactctcaaggacaagcaactgactctgttttatgttttgccaaataaacccacaggccagcgggtgggcgctagccttttcataagtatgccaagtcaaaccaccattaaaaccattcccttggccactgcggtccctgtgggatgaagtgtcctcgcctccactggactccagtgtgtgttatcttttcacctccttcctgggaagagttggtggttgctcagcaccacatgtgacgactaggcacaggccctggctgctcctggcacccaccaccggcccacgccgggatccagtgctggcactgtttgctctgcgtctccgccccgtggctccctcccactgcccacccccgccagctgaaagaagagacaatgtattggcactgacggccatccccatcctacctttaggaggaggtggtgatgcatgaagataatatttcgtcttgccaatagacaaacaggctttttggatcaatgggacacacacacacacacacatacacgtacgtgtgtttgtgctgcattttacagttgtgccaaactgcatgaaattggcttttctctcatctcaatttggcggcatgaagcacaaacatctcaaaggaaaatcagcaactgtttttatccatagtctcttctctttttcttattcatctgatccacgggcctatctgagttcttattttttcacatcctcactgtaagttaacagttttggtaagacaggcatactcaatcaggccatttctcttcatgtgggaattagatacttgttttagaaaacatatccaaagactattctagtgcatttgactgaattttccaccaaaatggatgtgcaaagaagaagacactgtacaccttattaggaaaatctctataagcccaacactttttcagactttttttgagagggagtctcactctgtcgcccaggctggagtgcagtggcatgatcttggctcactgcaagctccgcctcctggattcacgccattctcccgcctcagcctcccaagtagctgggactacaggcgcccaccaccacgcccagctaatttttttgtatttttagtacagacgggatttcactttgttagtcaggatggtctcgatctcctgacctcgtgatccacctgccttggcctcctaaagtgctgggattacaggcgtgagccactgtgcccggcctcactttttcagaaatttaaaaaatgttgttctaaatgactatcatcttacacaatcatatatttaagttctttgcacttacattaaaaaaaaaaaagaaaaacattgaagattctaggtgaagagaaaaaggaatatcatgccaccaggtttccggaagaccttggttccacgataccaataccagccatgatggccattcactgagtagaacttatttctcactttgtaattcagaaagtttcagagtagcagagaaacgcgtgtcatggggaaagccagagaactgagtgtcttttatgctaggtgacactttgttccacaaatatagcctcagagtgggtaaaggaaagatggtggctgacaatggggcatttcttatggaggctcagagccggcaatgcctccagttggcagtcgtactctcttcagacagaagcaaccttggatgccttttgcatatgcattattgttgatgctgtctgccaagacttcaagatactatgagattttcccacaatgtgcatatgctgtggatgccggaggcatcatgccctagtggtctaagggtggagccgggctgcagtggctgtaatatggcatcaccaggtcttcctgtggagaggagccagggagcacatctggagtgctgagcttgtgtgagacagttgggatagatcaacaagaaaggtgcagagggaagtggagaaacgaacagaacctatgaaaataagagtttcagaacagatgaagaaaaaaggagagaacatcagcagaaacataaggagacaggaaagtggcagaaatgaaagaattagtgaaaagacatgtatagaggtaaagcaatagaaacgaaatatgaccttttcaaaggttggatatacaagtgtaagttgtgagtgaacttaacactcatcttgccatggaatctcaaatagaaagaggaacattattatttttattccctttgctatttagtatagtttagactattgctctctaatagtttaatacactggtttgaataattttggttctatcagagctggctgtaaagcataagaatgattctttggcaatgtgcacattcattcattctttatcccctgacaatgtgccaggtcgtcttcaaggccctccgatgtcattcttcccccaggaccccaggtggaaatgacccatcacaatgcaatgggataagcggtaagtgctgactgcctgggggaacaggtgcaggctgcaccaaggagctgacacttgtgcagggtcttgtaactaatattgcatcagttttttcaacatgcctattgagatcagtgggaaaatactcatcgttatgttgtagcaggaaaaacagaagtaaggagaggttaggagcttctagaagacttcaaaagtttgagagctgggaataaaaggtgttgagatacatactttaaaacttataatgcaagctagtaggacatattcaaactaccactatactttttaaattttagaatttcaataagggactatagtactttctaatcctccacaacaaaaactgattcagaaacaaatacgtcttattaacttcaataccttagtaacttgccttagaaaaaatgacaaattccccaaaattcaaacagcaggttttagatgacgatgttaggcacatttttctccactgacctcttttcaaaaaataatagaaacagcctgaatttaaaatatacagtgtctttctaataccactgtgaaaaacattcacacagaattaatttcattctcaacaaaatccctggaaaatagggaaacatttcattatgaagtcgaagaatatgtaaaaaaagattaaaaacatctttagattggttttctctgagttactgttaaggatccacgtttatgctataaacaaatctctctcatgaaagtaaggccttccctattcctggctctgccttttaatcactgaaacagctgggaactgtttaagaatttgtctcaaacacaaaacttgtttaactaacttaatggaacaggtgaggagacactcttccagaatttgaacccatcaggggtcagatggcaggtatcaaaagacagattaatggtatcagaatagtggccatgtggagtttaatgatgacatatgactggttttaagactcgtgacagcaagaaagaaaaaggcaagaaaataggaggtacaaataagaggagtggctaagctgctgcacagacaggcttggaggtgaggcggtgaagaggggtggcctgctggctgcgtgagagaaggcctggccagggcagggtgtggtgatattggctctaccagccttgcttctcagggttcccagactgggccacccacccactccacctgacagagtccctgcctatgtctctgttcatgcggctggttcattcccacagcacctcctgccccaattgtgaattctttcccagttcttacaccccgtcccccaactctctcttttaattacaaatctttccaaagccctgctctaaaactcccctttattaggaagcctgtccttgtccctcaggctcaagtacgacctgtcctcatttccagttgcccaaatgtatcagcggtgttttctgagtgtgtacattatgcaattttaaatagatgatgcaccagcgtcttccattttggtttagtccgcaaagtgattaacaacatgctatccattccatggaaaacactagcccagcaccggttccaagtgattaactcagtattccctgccaagagaaaatctcactgtccaagaactctggagcctcaacaaggaaggtggctttgccagcaccttgatttagctcagtgggactccatttggtcttctgacctccagaactgtaagacaatgaatctgggtagttttaagccactaagtttgtgattacttgttacatcagcaatagtaaaccaacatagattttagactatcaaagtgacactcagctggctctagggagcaagtacaaagatgggtttttgcagacaggtttccaagggaggagcatggggggtggttggcagataaaagcagatgatagcctgatgtcttccttggtggctgctctctagcctactggggatactgcagttctaggaggagctgtagagcttgctggatctcagcgcctgtcacactcccttgaaacataccgtttaggcagaatcagaagtcgatcaccaattcagcatatccctaccttccaccacgatcatcctttctacccctgggtcaagaagcacacagctggcagtactaaggaacaagtaactttttctgcatgaagatctataggtataaaacaaaataaatatttaaataaaaaatgtcaggagttgaagagcccaaagcatcctttcagaagatgtcttttgataactaataatttcacaagagtatatgataatgataattaataatgatgactaataaaatgacaatatgcagcacaaagtaccttacacttataaaagccctttcatctttaagaatttgaaaatgctttgcaacctgacttccaggacatagtgatttgaaattgggtctctgcttgccccctgaaactcagtttttcttggattgagatgaagtaatcatctgccaattaatgtaactctttgatattagctctttacacattaatctggccctatggctctcagatacaagtgcttagtttgtgtatgctgtgaattattaacctactttttcaaaatatgtttctgagacttacctcctggaattcgaatttgcctggctctgcgaccagctccctgtgcacactctttttcccccctagaaatgctccttcagggagtttatgtatgtcaggatttcagctcttgcacatcttgcacatctaggccctagccctgacctcttttctctacactaggcctccagctccaactgcctccctcattttgcagcacagatatcccgaaggcaccgggagtgtgacggaacacctcaacacctccccctgcaaagtaagtcttctcgctggatctctgatctgggttccagcatcgtcacctccccactaccctacatggttcagcctctgtcctgggagtcaacctcagctctgtcttctcttccacatgtccttagtccactctgattccatggtctccatctctgccatgttctggcacctgtcactgtttctctcgcctgggctgccctggttccgtgagtccctcattacacccaccccaccccgggctgtcccggcagcttcgcagctgcttccctttcatctgagagtttctattggacaaggaccttatctcatctatctttaaatttcttggtgttagactgggacttacctctacggtaatggaatgttcaataaacattcttttcaaaattgaatgttaaaaactcaaccatgtattttcatatatatacatatatatatatttcatatatatatattttctcatatatactgatatatatctgagaagctgaaggtaaatcagaattatattttaaatgtgcatggtcaatgtactatctaaaatattcctgtaataaatcctaaaacctgcagaatcttttagtacctacacacagtcacttattttttagtttggatattgttacaccaggttttcatgggggcaaggcatacctgatttactcaggaaactagcaaattgatgacagcattacaaaatgtacaaggtagattttgctattaaggacagttcctattgctgagtaacagcggaatgaaaccaggtatttactgatgggccaaacctggtaagcatttgtctaggaggcagatcagagctactaagttgggacggaagcccgtcagtggtggacctatcaccttggcagttaatgacaaaaggagccagacgagtttttgcctttgctactagatgtaacagtggatagagaagccggcctggcatgagccacaggtgtgggcagtgaggtggtgggagaaggcatgcagggtgagaaaggtggcgcagagcccacggtagatgggcatgactacatttcagccccagaatattctagtgtctgcagagcaactgttttcaagtaaagaaggtgctgggaaaacaatcaaatttgataaaaaataattaactttatcgagagcatgaggcagaacggggtgagagaaaccacaggcagtattatctgtgaaatctccatgaacacagatttttggattgctgttattttggaagataaataaggcttggtggaacaggaagagcactgctgatttgtttaaaaaaaaaaaagagagagggattttttagatttccgaatacagaggtcatcggccaaagatgaaaataaagatggaacaggtaatcacaccagggacgaatggatctctcataagtaattctattctttaggtgatgtacttcagagctactttaggtagaagttgagctcaacaactaattgttcctcctatggaaagttgatgcagatgctaaaacagacttttaagacgataaaaagattttgaaacttattttgtagacgtcaataagtctgcattatgattataaatgaggatagtcagccatcacctggatagctttatggaaaaaaggtacagatgttgcaggaattcctcacgggtgcaagtaatggacatatctgcactaggaataccagaaggacttaaggataaatcaaaaaatattcttaaataagggaagatacatagctatgtatagccataaagatttttgagtctttaatgacatcattttaatctagatctgataataagaaaagaaacttcaaggaaaaaaggaggaagttggggttattacaatcagtacacaattactatttcattagatatgaaatgctcttgaggggggagagcaaccgaggaaagaacccaggcttcaggaggaatgttatatggcccttggggatttgtatgcgatcctatgaagtatggaaaacaaacagtggaatatttaagaatcaactgaagagactgaaacttaaagctcccttggttaagtccaaggaaggaaaagggcaggaaaggccaatgtgattaaggaaggatataaagattagtatgaggagcctaagagggaggcttaaaatatataaacagtgatttagagatataaactatttataaaatacaagcagtaagaagttcagagaataattacaaaagaggaagcattctgatcagcattccacactactgtggtccaaaagttatgggagcacaggatgccaggatattaaaatgggaagggaccttacagaacgagtagtctcgcctctctttctataggcccaagagtgcaggaagaaaggcactcatccttaatctgctctctccacatcctctgaccctggctcccgctggtcagagaaaggaacaaagaagagcaggggtggaggggaggattagagccttagaggtcagaaggagcaggagcgggagggatggactggcttctaacagagctggtacagatgaagggatagagtggggggatctaatttcctgctttgggaggggaagtgtgagaaggtggtgagaacagctatgggagaaaagggggacagtttcaggacaaaaggccaggctggtgagtgtgttgagggcttttcacccccaaacgcagagacagagctgagggaagctctgactggcatttatataagtcctctgatgacagatcaggttcctgaggtctggaaagtgttacatatcattattctaaacagggctatgagatagagcaagcaattataggccatttaacttaacatcatttacagaaaaatattaggaaaagtttgcggggggtggggaggacaactcgacaagcatatggtaatttgatcagaaacaggccacatgtttttacgggaggaaggtgttgttttaactagcttgttggacttctttgaagttattgctttcttagttctaggttttaacctatgatttttccctgatatctataaagattaggaataaatatcagatatctaagtaaataaaacaaaaaccaatcacaactgaggagattaaaaatacaatgggaagaaaaagaaaaatgaatgttaaagacaaacagtgtagcaaggaaaaaaaggagtaaacatcagctagtagagtttaagccaagatacttttcatgaaaaatacttgatttgggtctgtgaatgtgtccctttatcccatttcccaagatgctctgcagaaaaaaaagggactttttgtttgtttgactgaaaaaaatctctttgctttttttttcttttgttttgcttttttagtggattgaccatttgatgtggttacaaatttggcacgttaggatgactacttcattaatccttcctttgtgaatttttaagttaaaaattctcacataagaagacgacatatttgtggttattttatatatattaataggtcaatagtagttttctcatatttacacaatatttctgtactacttactgagtagcccctgaactttcagaaacaggatcagaaaggctgaaaaccaataaaaaaatgagcatcttaaaacgtgcttagtaatactcactagaagcttcaagtatgtttcattatccatttttggctggttagtctgcacaagtcactaacaatgtcgttctgcttctccaaagatcctggactccaggaactgctatcacgtcttttttttttttttttttttttgagatggaatcttgctttgacgcccaggctggagtgcagtggtgtgatcttggctcactgcaagctccacctcccgggttcccaccattctcctgcctcagcctccccagtagctgtgactacaggtgcccgccaccctccctggctaattattattattagtagtagtagtagtagtatttttagtagagatggggtttctccatcttagccaggaaggtctcaatctcctgaccttgtgatctgcccgcctcggcctcccaaaatgctgggattacaggtgtgagccaccgcgcccggccaaactgctatcatttctacatttgcaatctccacaagggtggggactgtatctgttttgttcatcattgtactcctagggtctagcacagtgtttgataaatacttagtgcatgaatgaatggttaagaacaacatcaatattagatatttactctgtgccagacactgtactaataagtactttgcataactgactctgttaattctccagtaattctttgaaagaagtcctattattaatcttatttttaaaaatgagggaacagaggcactgagaagttaaggaacttgcctatggtcgcacagctagtaatcaataggtttcaaactcaggcagtttggccaacaggcccacatttgagcataattaccactttctctctaagaatgaacacacaatgcaataaatctgtgcatcagtgtatgcatgtacagaaaattatacacaagacaggggtcttaagtggcacagaactcaagtactaatgttatcatcaacaaataccagaattcaggagtgatggaaaatttaaagtctaatttccaggatcaggctctctgtggtaacaaacccctgtaggcagagtaccaaaaaatgttgctcaattgagctttaattggatgctggagtccttagtccagaacaaacactttgaaaacttcacactggtacagaagcgatattgaaggttttgaggcactaaatcaatgaggaaaaagaaattaccagcacaggtggaactacgccctctatggaaccactggtggcctctttcaagctagtacctgcctttgctgagcaaagggccatttttgagaccattctgagtcttattcaaaacataatataaagctctatttccctttagtcttgctgtaggatatcagtgttctgagacctgatgtgtcctattttttttttttcaaattttctttatggcattttttttttttttttagacggagtctcgctctgtggcccaggctggagtgcagtggcacgaccttggctcactgaaagctccgcctcccgggttcacgccattctcctgcctcagcctcctgagtagctgggactacaggcacctgccaccatacccggctaattttttgtatcttttttagtagagacggggtttcactgtgttagccaggatggtctcgatctcctgatcttgtgatccacccgcctcggcctctttatggcaatttttttttcctatcagtcattccgaaatgattctaagaagacatagttattggtttgagtgtccctctgtgcagaagatcttgggggacagatgacctaagctgatcggtgaaagcacttttacagactataagaagaataagaagcctttggcatgtgcaggatggactgagtccctgagaaggaaagattcagtttagatgtgagagaattccacatgtatcctaagttgaatgtagacaaacctcaaagaagcttggtgcttttcaggactcataccaaatggctctagaccattggctcttgggacctcacacctaactaaaagcttatttacaatatagtctccagttctggttacctttcaactggaagaatattctcacccctgaggcaattcaacaggaggctgtcaagttgatccaagttttaggaaaacttgttgttctgaggaatgaggttaaaagtttagtctcaccatacaggaaaagcttacccagtggaatattaggttgaagtggagtgaatgaaattaatgcagcctagaggcttagaaagataaaacgtagttcaagattcaaaattggacagtaaagggaagctcaggagagagccaaatcggtggaaaaataaagcaagcatatgaaatcagacaccactcttatactcaaagaatgctagtgtcaacagagctgcagaacaggtatgatgatagcacttgaatgaacaaaagaaacgggagggatgcggcgtcggtcacggcaggaaagggggtcgatgcggattcaagaacagtcttgttagtctgagggtccttttcctgttcagtgaattcttttgttctgtgtccttatcaatcccacaccttgtctaagtaggaatgacagacaagccattcttaatgacttcctagcttttgaaactattttggtgtcagagagggaaagagccacatttaagttgtaaaaattgaggtttctgttggcttagtaaatttccttctctgagatgaccatttttgattgtagatacagaaaagcatttgcataaatatgtgatctgtgcaatgttccagaaaattgacatctctgtcgcacctcatcaggccagagagtcaaatggcagcacagctcagggctccagtcggcagtccctgctatgtcagcacagcgtggctggcatcttcctccctgagggccagtacacatcctctcctaggcacacccactctccattagcaccgggaacaatggttcactgtgtcagagccccggccacgccctgtgcccggacaatgcacgactccacagccctacctctcccaagcactggttacttcctttcctttttatttcctcctgtgtggtagagtgcatgaaatacagttttttccttctgtctgaaacaagacattttaaagagtggtaaatgatgaccgattcactttcagtctctcttcactggggttttcctaacctctccaaggttgaacaacagataggaatttggttcagaacacagggaaaatggtttcaaaaaattcaattttcacagttaatgttcactaggtaacacatatgaacgtttctctctagagatgatgctttctattatctttaggtatatttcatatgttgagctttgcttccatagtgaggatggacctcattaaagcaataacagcaagctaggcagctttataagtttaggaaaggaggatgttatgttctaacaaccattttgtaacacaggaagttctgtatttagaaattcgcccatccatctagcaatcagtcagtatttattaagtacctaccttgttatagtctagtgtaagatttttttttttttgagacggagtttcactcttgttgcctaggctggagtgcaatggcgcgcgatctcggctcactgcaacctccgcctcctgggttcaagcgattctcctgcctcagcctcccgagtagtggggattacaggcatgcgctaccacacccggctaattttgtatttttagtagagatggggtttcacatgttggtcaggctggtcttgaactcctgagctcaggtgatctgcatgcctctgcctcccaaagggctgggattataggcatgagccactgtgcctggccttaagatattttttaaaagtccctattctcaaagagttcacaatttggtaaagagagaaagacatgtaaacaaatgattatggtgggttatagtaggtactataatagaattatgtatagcatataatgtggatacaaagaaaggagtgggaaggaatttcagcagtactgatgtatcggccagaaaaggctacatggacagggtggtccctgacctgagtcttataaaaagcaggggagaccatttatggtatagtgtgcaagtatgcacttgtgtatgagtacacagacacagacatagacatagctggagaggacctagatgtcctgcaggtctgggacagcgttgttaagtcaggcatcctgtaggttatcagggaccagccattagaataggagaccaacatgaggagatctgcgtgtgatgtgagattccatttctgaaatcaatgatttcttttggtgggtttaactcttgttttcctttatagagcaatgaagtttgtggtaagaatgataatctcaaattgaattcactgtgttctgattttggaaatgcacgctgaaggatgccagggagctgaactgacagctccaaaggctggcaccaggcattccatgagcgcatttgcccagccagccagccaaatgtggccacgcactgggtggccagagagtccttaccacttcagttggccggtagtacttgagatccacagtcacgtgaactttgccggtctctttacatctgcccacttcattttcattctttccttcccacctgtaaggaagataaacactgaatcagctcctaattgcttgggaacatttggccatgctgtagcaccttgggatgccccagccctctccccgcaggagcgcttaagctcattaaccacagcagcacaggctgatgctccagctgattattaaagcaacggcgactttcaaagcctttctagatctgttttgcaagggcagcgtttttttccttttcaagaaaatcatgacgaattcagaagtgagactttagaaatgaacagattagccagaaaataaaattgggcaactttcagggatttcaaagattttgtatttctctagaccattcttggtcaattcattattattaattaataaattattataaattaattaatataaattaatgtcttctgtcttccctttttttttctttcttttgtagttttagggatattcagagttaattcaacacattccatttgggaataagttttgtaacctaattaaccattcaatgcatccctggatcacatacaagttctcctgctctcccgtcaatggtgggcccccttagtaagtctcagatgattaaacctccaaaaagtacagaactaattgtttgtttcctgctgagtgagggtatatcaatattactttcctataacctcctctgacctagctaggatactgtttgcacacaagtttccttccctgaacatccaaggttgacagcagtaaggatcccaggagcgagtcctcaagtccacactatgcaggatgagctcatatgcttcgagattaccttctcgctaaaattctacttatccattttatgttctcattttttataaatcaagccactcacttaatggtaacgtctggatgtctataatattacagaatttgggttatttatttttacatatgaacttttttgcaaagaaagagaagaaattaacaagtatgacatgtttgactttactgtttatccttagaactggtttgcattatgagctggagatgaatcctatggacacaggacaattctgtgtgctctcggggtcagagtcatcatggggaagacaaaattagttacctgcctatgtaagccacaggcaccactgaaaatgaacattaaatgttgatcccagttatattttggaataggttgagaattaaagacataaactgacctcataagccttatttctgatgaatcacctgaatgttctgtcaaatcacttcttggtagcaaaggggaaatatttcaccgttggaggaataatcagtttgttagtgtgctgaatttaccaatggactcaaggcaagtatgaaaactgtcctgtgacacagagaattatatagcgcagtatgttgaataatatacagctgtacaactggtcatttccccatgacttttatattaattaattaacacaaaaagggatgtttggtaatttgttttcatttcttccttaatgttgattagatcaatttggcaggtcatataggtctaagaatttcaaagcaagggaattggtaggtaggatcagagctaagtttttggaaaattcaccgggaaacggtaagtggatgttttggagcatggagattgaaagcgttttaaaacataacctgaaggaatgatgaccctcatacatctcctgtggataaagaccaaatcttagctaatatccacaggaagggaggacaattggttaagtcattattattattttttttaaataactatctaattctaaagttaattgtttaagtagaaccttttaaaaaaattttggttaggctttcagtagatgaaagtatatttgtatttcacaggcatgtttgatctatttttgctcacatttcgttcttcgcaaagagaaacaagttcagcagatacttgcgtgatagtacctccaaccaagtcaaagggttaacagaaataccatttacaattctgctgactgatttttcgcctgtagctggccacgctgacttatgtgcgcaccaatattccactgttcttccactggtaaatctcaaatgccacaaccatgagaactggtgattcaaatctatttataattcaatttttaaaaaatcacacacaaacacacacacatatttaaatcgacaaagccttggtaaagacttggagagcttttcttgttttaggagggagcgtgtgagtcaggagaggactgaggccgtgcctgaggggtctttagactttggtggggtctgtaaactgtttctgtgaagagccagacagtaaatacttaaagcttcacagatcacatatagtctctgttacatatttttcctttctcctctttctttttctgtttcttcttcctcctcttattttttcttccttattattttcttctttttttaaaccacgctttaagactgtaaaacctgtccttacctccaggacagtaaaaaaaaaaaacaaaaaacaaaaaaccaaaaacaaaaccaaaagggcctcagctgggatttggcccacaggctccagttgcccactcctgcttcggccgatcaggttaatggtatcgcctcaccctcagctgaaggaaagcatttaattcctgtttatagcagtggcctgcacggctagactgcttgaattttagtgtctactactgattctctttgattgctttgctggtcatagactcacatttgggatttgtaacactagctgaaatgggaaaaggctgaaggagaaacactccctctctgaggggtttattaaatacagcctgaaagtcagacttgggtctggtgctactttggcactcaacaggcaccagctcccctgcacgactttcttgccactgtctgaacgctgtctgctgaacttgcatcttgcaaatgctgtctacagtcaaaacagtctctaagggcatggcattgccctctacaattaatatagctacattgaatgagcaaatgtaatcaggaaatggctcaaagctgaattgagttggcaaaaaccactttctaatttgcaccaggtctgaatgagggcagtaagcaaaagtttcggccaagtgccaaaaaacattcagttacaacaatacatgaaacacttgtattaacaagtaaaaggtaacagctaacatgtcctaacaagtgatgttacgacttgaagcagggctgctctgttaatgaagtgacggtggcttgacagagaggagaggattcggttaattaacaagagttactacccacgaattgagatcaacagctcaccgagcagggatcctgtataattcaatttttaaaataaattgttggctcctaataagcattaaatagcaatagaaagcactgaagaataacagaatcaaggacaataaggcaagacaaagcgctatgaaaatctactcaactcggcattcctttgaaggagcaacaaaagcaaagtcagccacatgagtcaagtttggggctattagacctaagttggtgggggcgggggaacaacacactccttgtagtgaccatgagtcaagtttggggactattagagctaagtggggcgggggcaacacactcctcgtagtgacccaaatatcataaaagcgctcagggattattctgaagaaaggcgatttaattagggtatggaagtaggaagctgcaggagctaaaatttagtcagtgccataaggcaggcctggaggaagcattagcttctggataaagatggtggttttcacacacttttgctccttccgcagacccctttcaaaaaaggaataaactcacatgagctaagagggcaggaaagagatgtgagaaaccaaattctggaagctggaaagcagatggatgagtgttaaaggacttagcagaagtcctagaaaagtctcctaaaccaacagtgggagagctgagaatggccccaatttacacttgcagaagttcccaaatgctcaggaagtgagacctgattgcaaatctccataggcagcagtctggggcctgattccctccccgacactcactgcctcaccctccctgaggtagaaggtggctggactgaaggctacaggctcagtgaagagtgggtcaccatgctgaagacagaggaaattaggtgcttgtatgcacgatgaatactgaggcccaccacacagctctctgtgggctgacagtcaggcctatttccttccaatgaggacactggggaggctcctctgggcatcagagattctccaactaaaaggccccgtcaagtcctcttataataaaatagccacaagatctaactatgctctcaaaactcacaagtagctttttaggccccccacttttaaagaagcagaaaaccaagtattacgagacaggaaatatataaggaaaatcacatatatgaaaaatagaaatccaaagaaacaaactgaaaaaaagcaacgtggaggaagtagaacaagcagggggaggagaatcagaaacaaaataaaacaaacaagaaaatccccacatctaccacctttgacgtcctcagacagagagatcaggaaagatatcaaacaaacaagaacaggatactacataaaaagaaataatgtgaaacacaggattttagaagttgaaaacaaaacatagaaattcacaatccaagagatgatttcgaagatacagttgaggaaatctaatctcccagaaagtagagcaaaaaggtgtagacatgaaaaaccagaagaaggaagataagaacattagagtgcctcagggcagtcagtataacaggatttccagaaagagagtacagaaaaaatggagcagagcaaacaactctcttaaaataagtcaagaatactgatcaaagcagagaggcacatgcatttccacaccaaaagggtgtcctccaataacgaatgggtctagacccacctcacatcaagttccacaccactgggaccaagagaaggtctgaaacactttctagaggggacagacgggactgggagtcagaatggctcttggtttcccatggtgatactgcaaattaataggcaatggagtaacaccttcaaagttctgaaggaaaattatttccaatctagaaatatataccagcaacattattaattttgagattggactagagatattttcaggtatattttgtcacaaagtatttgtttcccaggtatctttctcaggaaactaattatgattttgctttaccaaaccaagtagtcttgaataagatgtcaggaaataggggctcagtgcaggatagcagctaagagagccccccagaggagcatgaagtgacacagcagggtttgaccttctgggcagtccacacggggtcaggtcagaggctctaggactgcctcaggaagatgtgactgacagcccaaccggggtttgagagcctagagaggtgatttgcacagctggagcagagtatggggtaaagttagtgataagtacacagaaaatcaatagaacagagaaagaaggcatctgttagctctacagtaaacaaatgacaattgtacatagaagataaaataggccgggcatggtggctcacgcctgtaatcccagcactttgggaggccgaggcatgtggatcacaaggtctggagttcaagaccatcctggccaacatggtgaaaccctgtctctactaaaaatacaaaaaatgagccaggcgtggtggcgggcacctgtagtcccagctactcgggaggctgaggcaggagaatcgcttgaacccaggaggcggaggttgcagtgagcccagatcgcaccactgcactccagcctggtgacagagcgaggctccgtctcaacaaataaacaaataaaaataaaaaaagataaaatacatgtggtttactggaatgcatagcattcgtcagtcatggtaatgtagcactaaatattgacttgactccaaaattaaaacataacaattgagtattaagagaacggagggatgggtcaaggggagaagaagagggcaaaactcttgttttgaataagaggaggccgacagataagtcccagaagggcaaaatcagtaacgacatgttatttggaaacatggagataaatgccaaaataattgtaatacagtacaatagaatttccagaaacaaataattatctttaaataagacagtgtaccacagcagaacaacaaacatttctgtatgtcggaaagggcccacagagcaccccaaacagcagagcacagaacattccctagcagatgggcttagccagggaaatgggcagggaggaagcaggggtaggagacagcagggatttgtgagaactcctgtagaatgattagaggactagggtgctggggtaactggacaaaaacatctaataaagaagggaaaaaagaattacaaatgtgagctttgtaagtagcagatgtgagtgacaaaccccctccccgcaggcccctctacgttgcagagaaagcgagactgcaacgaagaagatgggcctcagcacaccccagcctgagctctgccccagagatgggtattctgtcacactagctccgctacagacccagcacttccttacaggattcccctgtcaccctgcctctggatggggaggggatgacatctttggctccatcaacattccagatcctgcaccaccacagaagccactaacagggtgggcagatgaaatctgcagagaagacagagcaggcaaccctgggaagaggcaggccaaggtgaagtatgcgacctcagcagcccagggaggagggcggtcagcactgccaaactgtgatgatgggcagatgtcaggaggatgcagggactcaagcagggccctgggcacatcagagaaagctacttggatagggtgtcgggagctgaatggatggggtgaggctgtgtgtggaggtggctccttgatgccttttggcagaacagggggagagagaggccaggcagtgactggagggaccccgattctgaaggggcctctataaaagacgagagggagcctcaaaggagggccagaggccagatgcagtggctcatgcctgtaatcccagtactttgggaagccgaggcaggcggatcacttgaggccacgagcttgagactagtcggggcaacatggtgaaaccatgttaggtctccaaatacaaaaattagctgggcctggtggtgtgcacctattgtcccagctgggcctggtggtggtgtgcacccattgtcccaagtacttgtgaggcagaggtgggaggattgcttgaacctggggggcagaggttgcggtgagccgagatcgtgctactgcactccagccagggcgacagagtgagactcttgtcttaaaaaaaaaaaaagagggccagggctgagtggggaggctgagcggcagcctgagcctcttgagcaggcagaagggctgaggccataggccaggaggaggcactcttccaaggggcatcggggcgacctgctagtgggacaggggaaaggagggcgggtgccgtttttatgcttgggaagcactgctttaatcacagagcactctaacatttaaaatacagcgctagtgtaaacggtgaaccctggatctatgagaaccttagctgtgtatggcctcttgcattgctactgaaatggaggctggttagcctccatccatgcctagaattcttccatcttatttatgataattattctaagtaaggggcttctggcagtactcagcccaggtgttatgttgtagttaaggaataaccatctaccacaaaaaatgtgaaatttaaatccattatacagctgttcatgtagaaggcacttcttaagattaacgcctacatctattctgtgatttctctatcgtggggcccttatgaatgtcacttgctgaattcatatgccaagaggcaggcaagtaccatcatctgcagtgcataaatggaagaacacaaattcacagggctgaacaatttacagatggcacgtggggaaggggtgctggagccaagactgccaagccaggcttctgggctgccccaccctgggcccagacaacacctgtttcacgtggtctgagccagaaaggtgtggtgccctctcaaaagggcatggccatttttgtggggaggcctcctcaaacattaatttcagtaagagtggtcagctggtcaatacttcccttgctttcttctttttagcagtaggactgagaaattacttaatagggaggctcccctctaaacagccttttcttatgcttcatccctaggaagtcagactaggaagatgaattcaacagaaaaagccttgcgaggtggtgctactgagggtagctgaagagatcaaataataataatgataatggtaacaagaagacaagaccagagatggctctcctcggctgtgaaaatgacagtgaacagatcttctgacgcagagctagcatttcaaagagcctcagcgtgtccacgctacctcgcacagctcattaaatgcgctccagctgcctgcttcatttatatttacccaactggggcatattagccacccccagtggataaggatggagcttctgctgtgtgggggaagcaaaacttacagaggcttcctgaggggccacagtgagtaggtgtgccaaaacgaccagtgcccaagtacccccagagtcgctgccactgttctgggccatctgcatctgcacctctttcacctacacgactgtgtctatccatctcccttcctcccatccccacaaatcttcaccaagcacccgctaggtgccagccagtaagctaagccagttgctaaggacacgggtatgtggaagctagacatgtctctgtccttaaggagcctgcagtctatggccaccacagtcttgtgagggaatgatggcagagagccagggtgctgtcagagccaggaggtaggcacctagcacagactaggtggaggcagggtgttggtcagagggaggatgcctaagctaagacctgaagaatgagtgggaagtggccaggagaagcagacggaactgtaggagcaggcatttgacgagcccagtgtggccaggctgttccaccctcgctcatcagcttacccagtgcccacacacaatgcactagctcctgcctccatgccttttctcatgccctcccacccacctggaatgtcttcctccttcctatcatccgtatctcccaatctggacaaggtccagcttacatctaactttctgcaaacataactccaatcatgattgtgaggctattacttcagtatcaatataataaatttgcacaatgtcttcatatttgcacagatatttgtaaataatgtgttcttattaattgacacccaattagagtctatatttctccagggctaggaaatctctttcaattctctttgattagtttggcattgagaggaaattagatgagcaaataacacatttatagagcacctaagaggtgtgaggtgctgtgccagctgtttaggtacttatgaaggcagcagttattttgaggatctaacagacccttagttaagaaggaaaatgggcccgcgacctggtgaattgcatcaactgcctatgaaatgaaatgagggttgcctcagacccacagcccagcatgacatcagggctctatttagatcttgcaggtgccaataattcaaaagtctgttgctccaacaaaggcactacaacatcaccttatgttgtagtattttgttttttaagggttaaaaatctaagcatcttagaagttcagaaacataaatgatagtaggattcagatttccaggagggaggtagagagacagagaggaagaaagcgagaagaaaaagagaagaagacctcatttaaatggtaacttgaagcttatatgaaaagtccaacctctttatgatgaccaaatataatgtgaatactcttgaaggtgtgagtccctttagagtctctccagaaagttctcatgggactctacgcaggttttctcagcatgactgctttttctagctctaatggggattttgagtgacgatgaatgaaggtgagttatatttccatcactcagtgtcacagattttactccacctggtcacagcatggacatcaaaagaagctttggcaagctgctgaggtgggagttaaatctatctcagggatcaacggtggctggtctaaacacaccacattgaaaggttagggaataatacagagctgcagtgagtttccttctcctgactttgcccctacatagaacccttagaagtatggctcattacatgagagttctgttcatcaccaacaactgactgagtggagggatgtgctctcccacagtgagtttgacagtcccaagctctgcaaattcccgaggaatgcattacagtagctacactggctgcaggatccaccccctggaacctgctgccaggccttccttctcaggagctgtcttcaagatcggcctccagaggcttcatgaagcttaggacccagggtccagaaatcccatccatcaggaaacagtgtcaaatgaagggagcaaggtgcatgagcacaaaacagcttgttacctctgccaggaggattttagaaatgggtttcttttctgatgtataacaatgttgcccttgttacttttactgaaaatgtaaattcagtaccacagactacaataacactttccatgtctgaaacattacccacctcccacaacgacaacaagcagcagatgttggttctcacctggttgtagggtactcttacaactctcttctcaaaatttaacaagattaatgacagaaaattagtcaagacaagtatttgcctgtttgggttatcctactatcatcttaattgtaggagaaaagtgtttccttttcacactacatacttagtggtaagttgatgtgaaaggaaaaacaaaacacagcactaaaaagagccccaacaatgcaatgtgctccacacacacacaaacacacacacacacacacacagagatacacacacatacacaccacacacacagatacacacacacaccacacacacaaaaatacacacacatacacacaccacacacaccacaaacacacacacagatacacacgcacacatacatacacatacacacaccacacacacagatatacatacacacatacatacacacacacgcacacaccacaaagacacaccacaaacacacacacacatacacatacacatacacacacaccacacacacagatacacatacatacacacatacatacacacacatacacacacaccacaaagacacaccacacacacagatacgcgcacagatatgcacacatacacacatacatacacacgcaaccccacacacatacacaccacacaccacacacagatacatacacaccacacacacatacacagatacacacatacatacacacacatacacacacaccacaaacacaccacacacacagacacacatacacacatacacacaccacacacacacaccacatacaccacacacatacacacataccacacacacaccacacacatacacaccacacatatacacacacaccacacacccatacacacatacacacacagatacacatacacacacacagacacatacacacacacatatacacacatacacacacacatacacacacacagatgctatcaaaagaaagcagttgtcataaggctgcctttctcaatacaaatgactgtgtaagaatttaaaacgttaccttacattttatcaggactgcatgtggtactgatctgcttccccgaatatcttctactaacccaaactcaaattaatgtgctattttctaataaatgcaaaacaaaaattattcaaattactcaagtgatgtcaaagacttcaagaggaaatatctgtgtcgattctaaatatacagatggcgacacgtgtcaagccttttcggagaacattacaacggataaattttaaaaacgataacaaaaatgggaagagacagcagagcttagaatagcaaaagtgagaatgttccagatgctgattggtgtgtctgatacggtacagcctcatgtaatatgaggcaaggacacaaagcacaacaagtagaactctgagctagcagaaagctttctagcttaattaatggcaatgctaatgagactagagagcttggctgtccttcaccctctacatctggctgttcaccaaatcccgctgattctaagactcaaatcaatcgctcctctccctctccatgttctcggctgaatgcagatcctcctcatccttagctggacagctccaacaagcctctagggaggaagcatggtggtttccctcaagctgtccccaccatatgagagggaataaggctaaccatgaaatctgcggaaatcaggatgacagtgggtgtttctgggaggactttctggataagctggcttttgggatatccacttgtgcttaattaagtatttacagagcaccgtcagctgttgagagcactgaggataacctgggaaggagacgatgcccacaggcatgaagacctgggtctgtgttcactgcaaatatcctatcacaaagttttttttgacagcatatgaacaagaaggataaaaagtgcacataaaggaaagaggagcgtcttgggtcacaacatactcatttcagaccctggctctgctactcccttgctgtgtgacctggggagagcactgaactgcactgtgcctcagtttccttctcagtgcaatagtgccccagccctggaaattaaacacagtaggggtgcggctcctggcatgcctccaggctcgccctaaccactccctgcgtgccgcggtgagcatgggctgtctctgtctgtcttggagcacatcctgccgttcttctgcaatagcatcctgctataggggaagaccctgctcccccgcattcaaacagtggactttcagtggggctgctcatcccagaatcctcacaccctgaaaacaggccaaggcctgggatccagtcccacgctggccacagcgacaggtctagggataactgcaggacccacaagggccagccacagtccttcctcaggatttttctaggtggattgttcttaaaggttctattcctcttttgactgtgtgaggctgtgtccccagaaaggcagtctagactgccctctgccatggggagcagctgagggatggaggcaacatcccagggcactggagccaagaagcagaggggccctgaaggagcaccaggtacctaaggctactctgagttcagtttcagttcctgaaaaacagaagaactctgactgctgggaaagtccattcacttttctccctttcctaatatagtactaaacagtttcactatgcttaagcctttattagcatagatacttcacacatttaaaaaataattcatgcgtatcatccttcgcaacttttggagcataacaggacactcctaataataaaatgtcatgtttgattcctacagagaacataaacaaaagtgcacatattttttaaagaataagatgttatgcttacatcttatttttctcattaaacttgtttaagtataatctgtgttattcacatatacaatataaatttgttaaaatatgttagagagttattaaaaaaagtaattaatgagagtggcagatattaatttctgctaaactatacgttttaattaaaatttttgggccaggtgcggtggctcatgcctgtaatcccagcactttgggaagccgaggtgggcggatcacttgaggtcaggagtttgagaccagcctggccaatatggtaaaaccccgtctctactaaaaatacaaaaattagatgggcgtggtggtccatgcctgtaatcccagctacttgggaggctgaggcaggagaatcactggaacccagaaggcggaggttgtagtgagccaagatcgtgccactgcactccagcctgggggacagagtgagactccgtctcaaaaaaaaaaaaaaaggagggttacttagaagcaacataaattttatatttgaaaagtataaaaaaaccctcaattccaaacataatcaatccaacaatgcatttttcagtccacaagagaagaaggccaatttttttttttgaaaaatgaggtatcttctttaaaaaataaaatagaaggccaaaagaatcaacataaccaaattacacttcaaagattattttatatcttcttgcttcctatctatatgctattttccaactccccatattatacgtaaaatttgaaaaagatcttatttttgccttaattttctataattaatgtcattagtttcctgcacaaagttttcatgcaaaacaaatttatgtaactcttggccacgaattgtcaatatttttcataaaattggaagtatattgagacaaaatgttcacaaaataattgggcagtatctctttttctgagtgttcttatttttgtttttaaaattttaattgacacattataattgtacacatttatggggtacattttgatattttgacacatgtatatgttgtataatgatccattcagggtagttagtgtatctctatcagctcatgcacatatttctttctggtgacaacattaaaaattctctcttccagctattttgacatatacaataggtattgttaaccttagacaccctattgtacaacagaataccagaacttatttctcctatcttattgttactttgtacccatttaccattctctccccagcctctttccacccatcccttcctcagcttctggtaagcaccattctactctctgcttctctatcatctttctttagatttcacaggagtgatatcattcagtacttgtcattctgtgtctggcttctttcacataacatgatgaaagaaatttggaaaattttccaaatttctttcatctttcttttaagatgtttttggccaggcgtggtggttcatgcctgtaatcccagcactttgggaggccaaggcgggtggatcacctgaggtcaggagttcgaagactagcctggtcaacacaatgaaaccccatctctactaaaaatacaaaaattagctgggcatggtggggcatgcctgtaatcccagctacttgggaggctgaggcaggagaattgcttgaacctgggaggtggaggttgcagtgagccaagatcgcaccactgcactccagcctgagcaacagagcaagactctgtctcaaaaaaaaaaaaaaaaaaaaaaaaaagaaggtgcttatattgagacaaaacatttaaaactaaaaaaagtaaaataaaatagtatttaaaaataaatgaaagtaaaaacatctttcttttttttttttgagatggagtcttgctctttcacccaggctggagtgcaatggcatgatctcagctcactgcaatctctgcctcccgggttcaagcggttctctttcctcagcctcctgagtagctgggataacaggcgcgcaccaccacgcccagctaatttttgtagttgtagtagagatggggtttcaccatgttggtcaggctggtcttgaactcctgacctcatgatcctcctgtctcggcttcccaaagtgctgggattacaggcgtgaaccaccgcgcctggccaaaaacatcttaaaagaaagatgaaagaaatgtggaaaaacttggtttagatgctgaccaacatctgacaaataacacaagtagggctggatgcagagcagagcaaaggccccactctacactgaaactttctgtattgctcttcaggagagtgaagggggaagatgacagccagaaccgaggcttcagcaagctcaggtgcatacctgccagagagctacaagtagtcatttctcaggtatacttacacaatggtttttccaatgtgcaagaatgatttctcgacaaattcccggacactatggacctccccagtagctataacgaagtcctccggctcatcattctgcaacatcaaccacatagcctagagggaaagagaggcaagttcactttgaagtcacactcagtggccacacattgttttccagtgcacataatcagatatggacatcgacagctggaacatgagcatgaatttcatagcatattctaagcacaacagcaatggctcccaacttttactgagtatccgaataacatgaggaacttcttggtgtggatgccagggctgcagccgtagaggggtgggctcagaggcctggagattctctctcagaatatttatccttaacatcccaggtgattctcatagtgcaggtcctcagaccacaacgtagaggaatgtgatgtgaagcagtgtctatggcaaataacctttttatggtattatttacaaaaagagcagttctaaaagcactgtttaatttttcttcatatcatagatagtagtcaaggaaaaaaaccatttaaagacaggtatttgtcctcaaaagtagaacttaatttttgaacaataaagttgagaaggtactagtcaaaaaacaaagtaagtgcgaatcattaatggaaaaacaaccacgtaatggagagtactactattataaaaaagctgtctgagaggcaatgaaaacatttatcccagagttaatgggttcataaggcagcatttcaaggccaggggctcaacttccacatcaaaatggatgtctagcagggcgcggtggctcacgcctgtcgtcccagcactttgggaggccgaggcgggtggatcacgaggtcaggagatcgagaccacggggaaaccccgtctctactaaaaatacaaaaaaaattagccgggcgtggtggggggcgcctgtagtcccagctactcgggaggctgaggcaggagaatggcgtgaacccgggaggcggagcttgcagggagccgagatcgcgccactgcactccagcctggacgacagaaccagactccatctcaaaaaaaaaaaaaaaaaatggatgtctatacaggttcactttctcagtaggagccaggagtctggtgggcaaaaatgccactgcatgtccaagatactgactggtggcaccagcgcagccccgctccccgtggttagcttttaccaacagcagataggcctggagttcctgtatctcgcaattgcaccttaaagatttttttttttaatacagataggagatgaagatttaaaaaaaaaaataagtgtagcaggaatccaacaggaatatgtctcttcaaaaaaggttgaagcaaaacaaaaaaaaatcaatctctattttttcatcacttccacccacttctcaaaataaaataggtaaaaacagtaaggacttaattataacacagcctccaatgatatgtgcattgaactctcgttccagcaaaatttaaacaaaactgtttggtttgcgtctccctaagttgttccttgataagccaaaaacaagaagttgctaaaatcaatgagccagcctattttctcttagaaaatgccaccaaaaaagtttaatttcctttttattcattggaatttgtagaaaacttctaaaaaataaaatttaaaataatttctcttttacctgaagttatttcctgtgtatgtttttgtatttttggtctattacaagattgttttaaatcatatggaagacaagattttggtctattttatatgctttggagatgtggcatgctggttgggacaatggtaatagtttcaagtcagtgatattctataaagtaactgacggaagaaattatcttggcgagaagacatatttgttcacattaatggaatacctgcaatttcattttgccttaagaaatcatggttggtgaactgagccacaagactttttaaatgttatactaccactactactactaatgataaagcatgagcttttaaaaggcatgaaatacaagttgttcactgttttgggatagtccacacaagcagatggagtctacaatggcttggtagctccctgaacactgttaaacactgggggctgaggagagcaatgagatctgaagtacagcccaggctcggcaccgtttgtcaagaagttccccaaggtgtctttctgaaaggggcaccaaggcctgtgtgcacgagcagaggcctagtgagcagctgctccttgtaggtctgtgcctgcaagtgaaattcccgcggcctggaacaccctgtctcctcatctgtctgggaatgctgacctctctctaggtcccggaccagggtcccaagtctagccactggaatgaattccaatgcacacagtatggtggcttcaccgggatcgggcctgccctttggcccgcttcccaactaagctgagcctcccacttcacccaagtgggcgcacgagtgtacccgtggacacacacagaggcacacgtgcacacacacacacacagaaacttattttggcttttgccaaaataccttcagaatttttaggaaaaattaaatgatgcctatggctagaattcctatctgaacgttcttctgcgggattagatgtaagggggtaaatacactttaatgtgtttgactcaaatttccattctaaaaataacatctcaaataggtctttcagggccactcagcttattttacttctttagaaacagtccgctgtgttagagtggtctcaaaaaagtcctatttttagtcatgtgaaagaagacaaggacgtgctaaaaatgtaaaaggagaaacttgactgttggctactggtgggtcacttggagaaacatgactgttggctactggtgggtcacttggagaaacttgactgttggctactggtgggtcacttggagaaacatgactgttggctactggtgggtcacttggagaaacttgactgttggctactggtggatcacttggagaaacttgactgttggctactggtgggtcactttaaacaccggcccgggtcccctggtgcttgttttgttcccggcaggaatctagggatcagtcagggcctctccttttactagagcaagagccaagaatctgctcttttcttctccatcagactatctgtggcctttgacctatcaatttctaggcatttcctctaaagttcatattgtaccagactccagtctgggaatgagaagagaaaggatatacaactccagatttatttgttattactgaatagtttactggtttcaacagagggatagggctttgtttaaatttccactgagcataattaatggttattgactggtaaatgaagaacaggtgacactctggattagaagataaatgatcctgtgttctggtgtgataatgggttagtaattcaccacaaagccgaggctgagtgcatcccgtcgtaatgctagatcatgtccaggagacaaaggcccctgtgtgagaaggacgcagccatccgcctccttatacagctgcacacgttgatgtgctccattgattccctgatggatggcacaactgaggcaaaagttcacccgttctcaccttcctgttcacatgctggaccacatgacccatgacatggccaggccacactctgtgatcaaatcgccacccagctttggcttctgactagagaaacagtgttgaggttacatgttttagaggtcagtcttctctctttgtctctcaaggaatgaaggaggaaaaagacagtcttcctgcattcttttggtgtcctttgaggatgtgactgacttgtccacttcctcaaatacttatttactttcagtcctgacctgattaccagtgcacatgaaaaaaatctcctgttttttaatccatctcacagagaggaaagcaaatcagttaaggaatgtgccagggcttcagattctttaacataaaaatgtcccttaattgccaaaaaaacagggcagttttcaaatcatgtcttgcattcattttgcttttaagcaaatgaagttcaagggaaatctgactccagaccattgacttttgatggccaagtcaagatgggtataaatattacttaaatttggacacgtactcttctgtaagtatataattaatctatctgttctacaaatccaatttggagaagtaaaaataaaactttagttttatttatttatttatttatttattttttgagacagaatcttgctctgtcgcccaggctggagtacagtggcacaatctcggctcactgcaacctccgcctcccgggttcaagcgattctcctgcctcagactcccgagtagctgggattatagttgtgcgccaccatacccggctaatttttgtatttttagtagagatggggtttcaccatgttggtcaggctggtcttgaactcctgaccttgtgatctgccggcctcagcctcccaaagtgctgagattacaggtgtgagccaccgctcccagcctacaaaacttaaattttaaaatgtcaaataaaaatactcctctctcacagtctcccatttggtaatttgaggggtggatgcagaagtggtttgggaggctcaggaagggccactcccctgcttgggaagctgccagctctggtggctgttcagagctggaccaatgaaggagaacactcaaagtgcatcaccacagccgactgactacacctgattccgtgcatgccttctgtggtgggatgtgtgtttgtcttaaaaatctggattctacaattgcttccacctcgacgttaacctccagttcagtatccaagccacaaacacttattaactgagctggcatccatgaataacaagatttgttaatgaaggttatgtttaactatgtctatttgactgttactttttcaccctggtgcttttgtgctttacgtgctactgtcacaaaaaccttaaaactacacacacacacacgctcatgcgtgtgcgcgcacacacacacacacacacttatgtatgtatacgcatttcaggggagaacatgtatgaaataactctaataaaaatcatggaaatttgaacaaatggaaattaaagttccagagaaaggatgcccagtgtgtacccattcacatgcgtttcatctctaaacattatttagtagctgttttcatgatggcagcctggtatttagtttgagtcaggacctccagtagttttgtggtcagccaagccttattctttgtggaattcacataggtaggtcttaggtctttgggttagttttaattaataaaactatactaataaaaacaaacagtgtgaaaccaaagtctggccttatggctatgtctattttcttcctgggcaaaaacgctgtgtcacacggattccttagattaagggacttttagacgttttaaagatacgacgttactgaacagaaaaaaaaagataataaattaatcaaaggaccaaaaataaaagaacacaacccagaaagccatatagctcttgcttctttctttgctaacatatcattctatatcaacaccatatgtactgaaagaaagaggcaatgtcaaaatttgttttgccctttatcttttaactctagccaggaatacacagctaaaaactccaggttggggttaatgtttctcttccctagaaacaatataaaatcgaacagctcctagtcttgtgttaatcattctgaatcagttttctaggatattatctattctttcaatttgcagattctagttatatatttatttcttctatttatctttgaatatatcttatctcttctattcaatttctttttcatgcacatcaattatgcatatatctcttttgttttatcttttacatctatcacctccgagctaatcatttttgggttttgtttcatattaatttatatgatttcctccagcctgttcacctgattgttttagtaaaatttattttatattttgttggtaacatggtttcaatttctgtaagggtttttttctcttccatacttttcctgtttactaccaggttgctttttatctttttgtgactttatttaagccaggggacagacaacttttttcttctaaagccagatagtaagtattttaggtttgtgaaccacatggtctctgtttctctgctgttgcagcacaaaacagccatggacaaaatggaatcaaatgggtatgactgtgttccaataaaacagttacagggcccatggactacgatttgcccacctttgctttcagcaaacttaacaaaaatatgttgcctgtaatttctttgactctacagagaacaattacccaagctctagctgctaatttttttgaatgataccccttatgatatgcacaatgcatctgtttgcttatgttccttttcttcttcttgcaatcctttccccactcacactcaagcatagattctggggtagtgcctttctacttattattatacttgaacaaggctggctgttccctgaagaatcttaggagggggaacaggaaagtacactgaggacagcctgcagctttaattcaggcttctctgaaagccctctaccaacttcattgcacgctttgccccaggacgtggctgccacaatttctcaagattttgctggtgagtgtgattagtggaaaggagcccatgaattgtagggctgccctggtgctctctggcgatgtttgctttcactttgcctttaccccagatcacaatctgcggtgttccttggctaggaggttatgccagtgacaataaaattggcttctggctggttgtagtggctcacacctgcaatcttagcactttgggaggctgaggcaggcggatatcttgaggtgaggagtttaagaccagcctggccaacatggcaaaaccccgtctctacaaaaaatacaaaacttagctgggcgtggtgggggcgggggcacctgtaatcccagccacttgggaggctgaggcacaagaatcacttgaaccctggaggcggaggtggcagtgagctgagatcatgccactgcactccagcatgggtgacagagactttatctcaaaaaaaaaaaaaattaaacataaaaaaaagaaattgtcttctccttcagcaacaccttcttgccactgtgtagtgtacaagtgggtatctatgaggatagtttctgcttctctctaataggtaatactattttatgggttttttaggactgaaattattttgtgcaaaattcatagcctgtgtgtatagttcctaacatctgctctaaattttcttcaaatgtcatggtatctgtctcaaatactttttcattttttttgtagacagggtcttaccctgtcacccagactgtagtgccgtggcatgatcgtagctcactgcagccttgaactcctggactcaagtgatcctccagcttcagccttccaagtagatgggactacaggcatgcatcaccacacttggctaatgcttttaatttttagtatacaaaaatactaaaaatgtatgtatgggctacattgttcctggcctcaagaaatcttcctgccttggcctcccaaagggctgggactaaaggactgagccaccagcctcaaattattaatacctcatatttcaagttgtgtccaatttcattgttataatgaagcagaagtttcctcttaactttattatttttcttgatttcagagggtttcaaaaaaaggagtgttgaatgaaaatgtccttatatttagtcatttaaaaatatatttcttgaagatggctgaataggaacagctccactctggagctgccagtgagatcaacgcagaaggcaggtgatttctgcatttccaactgaggtacctggctcatctcattgggactggttagacagtgggtgcagcccatggagggtgagccgaagcagggtggggcattccctcacatgggaagcgcaaggggttggggaactccatcccctagccaagggaaaccttgagggactgtgccatggggaactgtggattccggcccagatactacgcttttcccatggtctttgcaacccacagaccaggagattccttcgggtgcctataccaccagggccctgggtttcaagcacaaaactgggcagacaccgagctagctgcaggaggttttttttcatatcctagtggtgcctagaacaccagtgagaaagaaccgttcactcccctggaaagagggctgaagccagggagccaagttgtcttgctcagcagatcccacccccatggtgcccagcaagctaagatccgctggcttgaaattcccgctgccagcacagcagtatgaagttgacctgggatgccagcgcttggtgggggaaggggggtcgccattactgaggcttgagtaggtggttttcccctcacagtgtaaacaaagccatcaggaagttcaaatgcggcggagcccaccacagcttggcaaagctgctgtggccagactgcctctctagattcctcctctctgggcagagcatttctgaaagaaaggcagcaaccccagtcaggggcttatagataaaactcccatctccctggaacagagcacctggggaaaggggtggctgtgggtgcagcttcagcagacttaaacgttcctgcctgccggctctgaagagagcagcggatctcccagcacaacacttgagctctgctaagggacagactgcctcctcaagtgggtccctgacccccgtgcctcctgaccgggagatacctcctagcaggggttgacagacacctcacacaggagagctccggctagcatctgatgggtgcccctctggaacgaagctcccggaggaaggaacaggcagcaatctttgctgttctgcagcctctgctggtgataccaaaaaaaactgggtctggagtggacctccagcaaactccagcagacctgcagcagagggacctgttttttcatttgtttgtttgtttgtttgagatggaatgtcgctctgttgccaggctagagtgcaatggcgtgatctcagctcactgcaacctccgcctcccaagttcaagcgattctcttgcctcagcctcccgagtagttgggattacaggcacatgccaccacacacagctaatttttgtatttttagtagagatgaggtttcaccatgttggccaggatggtcttgatctcctgactttgtgatccacctgcctcaggctcccaaagtgctgggattacaggcatgagccaccgtgcccagctgggcctgactgttagaaggaaaactaacagaaagaaatagcatcaacatcaacaaaaagaacgtccacacaaaaactccatccaaaggtcaccaacatcaaagatcaaaggtagataactccacaaagatgaggaaaaactagtgcaaaaaggctgaaaattccaaaaaccagaatgcctcttctcctccaaaggatcacaactcctcggcagcaagggaacaaaactggacagagaatgagtttgatgaattgacagaagtaggcttcagaaggtgggtaacaacaaactcttctgagcaacaggagcatgttctaacccaatgcaagaaagctaagaaccttgagaaaatgttagatgaattgctaactagaataaccagcttagagaagaacataaatgacctgatggagctgaaaaacacagcatgagaacttcgtgaagcatacacaagtatcaatagccaaatcaatcaagtggaagaaaggatatcagagattgaaggtcaacttaatgaaataaagcatgaagacaagattagagaaaaaagaatgaaaaggaatgaacaaagccttcaagaaatatgggactatgtgaaaagaccaaacctacctttgattggtgtacctgaaagtgatgggaagaatggaaccaagttggaaaacactcttcaggatattacccaggagaacttccccaatctagcaagacaggcgaacattcaaattcaggaaataaagagaacaccacaaagatactcctcaagaagagcaatcccaagatacataatcgtcagattcaccaaggttgaaatgaaggaaagaatgttaagggcagtcagagagaaaggtcgggttactcacaaagggaagcccatcagactaacagcagatctctcggcagaaaccctacaagccagaagagagtggggccaatattcaacattcttaaataaaagaattttcaactcagaattccatatccagccaaagtaagcttcaaaagcgaaggagaaatgaaatcctttacagacaagcaaatgctgagagattttgtcaccacctggcctgccttacaagagctcctgaaagaacactaaatatggaaaggaaaaaccggtaccatccactgcaaaaacatgccaaattgtaaagaccatcaacactatgaagaaacttcatcaactaatggccaaaataaccagctagcatcataatgacaggatcaaatgtacacataacaatagtaaccttaaatgtaaatgggcttaatgccccaattaaaacttacagactggcaaactggataaagagtcaagacccatcggtgtgctgtattcaggagacccatctcatgtgcaaagacacacataggctcaaaataaagggatggaggaatatttacgaagcaaatggaaagcaaaaaagaaaaaaaagcagggggtgcaatcctagtctctgataaaacagattttaaatgaacaaagatcaaaaaagacaaagaagggcattacataatggtaaagggatcaatgcaacaagaagagctaactatcctaaatatatatgcacccaatacaggagcacccagattcataaagcaagttcttagagacttacaaagagacttagactcccacacaataatagtgggagactttaacaccccactgtcaatattagatcattgagacagaaaatttacaaggatattgaggacttgaattcagctctggaccaagcggatctaatagacagctacagaactctccaccccaaatcaacagaatataatttcttctcagcaccacattccacttattctaaaactgaccacataattggaagtaaacactcctcagcaaatgcaaaagcatggaaatcataacagtctctcagaccacagtgcaatcaaattaaaactcaggattaagaaacgcactcaaaaccacacaaatatatggaaactgaacaacctgctcctgaatgactactgggtaaataacaaaattagggcagaactaaataagttatttgaaaccaacaagaacaaagacacaacacaccagaatctctgggacacagctaaagcagtgtttagagggtaatttatagtactaaatgcccacaggagaatgcagaaaagatctaaaatcaacaccataacatcacaattaaaaggactagagaagcaagagcaaataaattcaaaagctagcagaagacaagaaataactaacattagagcataactgaaggagattagagacatgaaaaacccttcaaaaaatcaatgaatacaggagctggttttttgaaaagatcaacaaaataggtagactgttatccagaataataaagaagaaaagagagaagaatcaaatagacacaatataaaatgataaaggggacatcaccactgatcccacagaaatacaaactaccatcagagaatactataaacacctctatgcaaataaactagaaattctagaagaaatggataaattcctggacacatacaccctcccaagactaaaccaggaagaagtcaaatccctgaatagaccaataacaagttctgaaattgaggcagtaatacctatcaaccaaaaaagtccaggaccagatggattcacagccgaattctaccagaggtacaaagaggagctggtaccattccttctgaaactattccaagcaagagaaaaagaaggaatcctccttaactcattttatgaggccagcatcatcctgataccaaaacttggtgagacacaacaaaaaaagacaattttaggccaatatccctgatgaacatcgatgtgaaaatcctcaataacatcctggcaaaccaaatccagtagcacatcaaaaagcttatccaccacgatcaagtcggcttcatccctgggatgcaaggctggttcaacatacacaaatcaataaatataatccatcacataaacagaaccaatgacaaaacccacatgattatctcaacagatgcagaaagggccttcgataaaaatcaacaccccttcatgctaaaaactctcaataaactaggtactgattgaacgtatctcaaaataataacaaaataataacagccatttatgacaaacccacagccaatatcatactgaatgggcaaaagcattccctttgaaaactggcacaagacaaggatgccctctctcaccacttcttttcaacatagtgttggaagttctggccagggcaatcaggcaagagaaagaaatcaagagtattcaaacaggaagagagtaagtcaaattatctgtttgcagatgacatgattgtatatttagaaaaccccactgtctcagcccaaaatctccttaagctcataagcaacttcagcaaagtctcagggtacaaaatcaatgtgcaaaaatcacaagcattcctatataccaataatagacaaacagccaaatcatgagtgaactcccattcacaattgctacaaagagaataaaatacctaggaatacaacttacaagagatgtgagggacctcaaggagagctataaaccactgctcaaggaaacaagagaggacacaaagaaatggaaaaactttccatgatcatggataggaagaatgaatatcatgaaaatggacatactgcccaaagtaatttgtagattcaatgctatccccatcaagctgccactgactttcttcatagaattagaaaaaactactttaaatttcatatggaaccaaaaaaatgcccgtatagccaagacaatcgtcagcaaaaagaacaaagctggaggcatcacactacctgacttcgaactatactgcaagaccactgtacccaaaacagcaatggggaaaggattccctatttaataaatagtgctgggaaaactggctagccatatgcagaaaactgaaaatggaccccttccttatgccttatacaaaaattaactaaagatggattaaagacttaagtaagtcctaaaacaataaaaaccctagaagaaaacctaggcaataccattcaggacataggcatgcgcaaagacttcatgactaaaacaccaaaagcaatggaaacaaaagccataattgacaaatgggatctcattaaactaaagagctgttgcacagcaaaagaaactatcatcagagtaaacaggcaacctacagaatggttgaaaaattttgcaatctatccatctgacaaagggctaatatgcagaatctataaggaacttaaacaaatgtaaaagaaaacaacaaccccctccaaaagtgggcaaaggatatgaacagaattaccataaacaatatattccccaattatgtgaccatgtaaataatgtatgaaagaagcttaatgaaaaatacacatataaacaaaggctgtttcactgtctgctgatgcttaataagccatcccaaagcttcatggctgcagccttttgttctggtttttttttttttttgagatggagtttcgcttttgtctccctggctggagtacaatggcgcaatctcagctcactgcaacctccgcctcccgtgttcaagcaattctcctgcctcagcctcctgagtagctggaattacaggcacctaccaccacgtccagctaatttttgtgtgtgttttattttagtggagagagggtttcaccatgttggtcaggctggtcttgaactcctgacctcaggtgatctgcccgcctcggcctcccaaggtgctgggattacaggcatgagccaccatgcccggctggctgcagccttttgattgtttgtgattcagtgtgcaggaactcaagagggctcagaggacagttcctctctgctcccggtggtgatggccaaggcggactgactggggcagtggggccaagatggcctccctcacaggtctggtgctgggtgctggatgcacctcagttctcctccacgtggccattctccagctaagcgttctgacattgttcattagtctagacgatgcttctttacgtggtggctgcttccaaggtggcaaaacaaaagccacaaagcatcctaaggccttggcctggaagctgtccagttcacttcctccgcacgcattggcgacaggatcagcccaaattcaaacaaaggggaaacagactctcccccttatgggaggggtggtagagtcacactgcaaaaggacacgcaggatgggaggggttaccgtagccatctctagaaaaaaatctaccacaaagagctatcttgtgataactctaatgtcagctgattgtttcaatatagcaatgaagttattattcttgtctctaatataaacattgcttcagcttgcagtttttaattaagctccatctatctttaacatcgtgcagtgacaggtttaaatgagggcaaaaataactcacgacgcatacacctgggatatgggagctcactttcaggtcactctaatctaacgaatgctctaactggcccaataccactgctgtcacaacgtacttcccagaagtggttgtttcctggagcgtgccaagccacctacttcagccaggtgtttccaattatcttctgtcgctcggatacctgggtaagccattctagaattagttcctggcccagtaggaacaacataaaagctctgggcatgcaggaggaagtttctttacactcatgaccacctgatccttcatctccatgctcttggctcctgactgtgctacctaaatctgttcctgggaagccattatgacctttctatgaccttattcttcaagctagtcatcctgagcacctgattctgcctcttggtctaactctgaccttgggaatttaacctctgaactgattctaggcccactaggtttcttggttgaagtgttgacaatcactgttaccagaaaatatcaacttatggacatcacagtgcgtgcattaaggtggatgtagacaggactttcaggattattctaaaacagcactgcccaatagaaatataatgtgagccacacgtaatataaaattttctatcagttgcattgaaaaagtaaaaagaaaaggtgaagctaaatttgatgtttcatttaatcgaatatatccagtatgttaccatttcaatacaaaatatgattgagatatttcacgttccttttctatgtaccaagactttgaagtgtagcctgtcttttgtcctcacaggacatctccactcagaagaggcacaatttgagtgctcagcagacacacaaggctgtggctaccacgctgggctgcgtggggctacagagccagccttatgttcaagagggagaaggaaccttgctatgtgacaccctactctaatcctgtttgcttatcctgctaaaactctctgccggggcttcttggagaaggcctcctcattttctccacagcacggctggaggaataatggcccctcctcccttcttggtcattatctccacctcctgacttcttcagtagtgatttcatcagcgatgacaactgggagagagtgagtgtttgaaaagtagcacaactagctcctaatttacaggcacttgacgtttgaatgcctgcctgcctcatccatccacaaatgggcactcataccacactctctccccaattggaatacctgggagtaaacacctgagaaaccctctggagtttggtgaaatgtagtgctgcagagggggtaggtgttctcaaacgttagcgtgcattagaatcatctgtcaggctagaagtgtgcactgcaatcctctggaagattagaacgcaggctgctggcccccttgaggcctggagctacagattcaataggcctgggtggagctggagaatgtgcaagttccagggtgaagcaggaggctgctgatctgggaagcgcgctgagaaactctgtgtctagagcttgggctgggaatcagaaacccgcgtctaagctccagccccactattcactgggtgacttctggattacaggcgcggtggctcacgcctgtaatcccagcactttgggaagccaaggcaggtggatcacccgaggtcaggagttagagaccagccttttctcaaaaaataataataatccctacctcagggggctgttttatgtatttattatttttgacacggagtctcactgtgtcgcccaggctggagtgtagtggcacgatctcagctcactgcaacctctgcctcccgggttcaagtgattctcacgcctcagcctctagagtagctgggactacaggtgtgcgccaccacgcccggctaattttttcatcaggatgatgacaatgatgattacgtatcttgagggagttactggtgcccaggagaatgtgtagttcatctccacaaccaaactcttgcacccataaatagcatggggaaggaagactgatagggtggagtgaattaaatcctgattatgttagtcacagccacagaatttaatagctggaaggggccttagaggtgttgtcattcaattccacaaatgttaaagatgaagcagctgaaactggagagattaaatggttcacctgaagtcatacacctgctaagtgttagagctggggctggaacctcaactccctttcctgtattcttgcgactgcatgatgctcttgtgcattctcctaatggctgtgtgtagaatacattttcttgttgaaactcaattctacgtgctggttacaaatagctgtgtggacttttgtgagctaacctggggacctgaccagacaagaaatgaatgtttacagtgtgcctgctagttgctgggcactgtgctagagtctggcgatagaccacgtaggaacagacagggaagacactgtgcctggcctacgtgctttaaacatttatataggaaaaagcgttttaaaagtccaaatctgatttaagaaataacttttgggacagaggcttcaggtagttatcagggaactatcaggtatggctcctttctaaaaccttcctcctaataagactgtccccacacactgctcttgatgaaggagtgagtcaagccaggtgtatttaaaccaggtgatgtgtccctgtgcctactgcgccccagccccccaccccccaacacccttcggtttccatggatggagacctaacatattctgggccaatgggaatgtcaaagacatttgcagtaagagacccagaggcagaaacagcaggaaagggctgagcacccaggcgtgagactgtcaccggggcggagccagctggagagactgggaggcatgaagacctgtgtgggcagcagagtgggaaagggagcccacgaggagggagggagtgagggagatgtgcagacacagaggaaagcagatcctcctttcccattcctgcgaggtgccctgaggctccttacaaaaaatcccgttttccatgaatttctttgagttggtttctgctcctttagcaaacaagtttggataaagagcaaataggacttctggaccacgagtatatgggaccagttgtgtatcagctctgtattcagtggtaagaagggagctccaggggggataagtcaccacctgttgacctcagtatccagtggggaagatggccacttgcccagccagccactaaaatgatgggagaggggccagtgtgaaaggagctgtgggaacacagaggagacaacccagtacaccagaggaggaggagtactcagggtcctcatgagggtgtcatcaacccatggcccccgcagtccccaccgccgaggaccgcccacccttgagcgcctctaaagatggcaggctgggacatgcaccgtctttgtaactgggaacctagtgtcctatgcaacttgttggttaaaactcatttcaaatgtgtttccccagtgtcttcattcacaaaaatctagatgtcaagttaaaagtcactcttccactcagtactctgaaaaacatgctgaatataattagatttaatcattcttcttttaatttttgtttgctaatctgagaatgtcccactatgaggagtatctgagctttgttctttcgggtggtccaattgctcttactaacttgacctcacccgggactgggatggtctgttggcataatgatttcccagatgctgactctgcaatgtcctggatcaacacagatgaaaagggaagccagttgtatttaagaaaacaatgattgtaactgtaacatttgagtgtagtgataaaggaggaaagaaattctactacatacatgcaaagagtcatctagagaaacctccccttccatggaagggcctgtccacatgactgaaaattaaacaaaaggccccctgtgttctccaagattcagaataaaaatcaagagcgtaccttgaagttcaattattttaaaaacacattatagatgatcaagggagtttttaaaaaattaagtctacttaattctagatgaaatctggaaaaacaagtagaaaaagcctacaatgaattaacacttttaaagtatttaacttatcgagtatttgaaaactctaaaatatccaaaagataatttaaaaaatctgtgagaaacttaaattatcaggtactgagaatgaacatttattttttggtgactaaaattctcagtagtctgacaagttatcaacggctgctcaagactgttaacaagaaagcctgtctaatactatacagcaccataagtaatgtcatttacgccagtgctaaaggtcgagttctgaggagcaagcttttctgttaatataacacagcatttttcacatgcatttcatgtgaatgaacaatgtcttcattgtttgcctgaacactaatttaatgttgtattttttttgcttgtgtcaatgagtgtcaaaatattgttcttttaatacatgaaagtatttgcatagagctttattactgatcttcagatgttagccagaggcaaaataaaacagagacgctccagttgggaaatctcgctcacaatgaaaagcaagagtccttaacatattctgctctcctgccaatttttcttccaagtacacaatgatttatttactccataattggtgaaattaaaagcaacactggagacgaaaaaaaaactataggaaaccctttccctaaaaatgaaacagagactttgcaaggaggaatacaaaaactctaagaggaagtactaagatgtaagatcttaacgtgaattaaaggacaatctgatataaacctgattacagaaaaagccgagaagcacagtctgtttcaaccatgaagtgagaaacacagaggcaatttttattaagttatgcctttcagcatcatctcatcattaaatgctcaattgcttataaccgtctgcatttattaagaaaaataaagccaccacattttctgcctccacaaagttgaagagtccataaccaggtatcggatgtggttttcaattctgttttttccctccctaacactaattatcctgccatttggtactgccaaaaaagacaaaatgccctttcagagaggcatgggctcctgctgacgggttactcacgacgaaacttcagggctgtacccgggttgtggtcaggagtgagcagtcccagagctggctgccagggcaggctggtaaaggccatgctcgcacggcgagcaacccgaccagcctttcaagtcaagtgttggcttgtagacatataagttaatcagctatgaaataaccaccacaatgtacttattgatcacacagggcttatgatgaaactcttggcccagggaagatttgtgcttctttctttcagcctccaacctaagagaaagagcactttgaggtggtgtttacgaaaaggcagatgttaacttcatgatttcaaccttcccttcctggggaggatgagaaacacgctgggtcttcaaaatgaagcccgacacattcgcgtccctgttcattttttacagaacttgacattttcagtgtattgtggttattattaaggaagagtatttagaaagtttcaaactgataaattttaaatgtgttaccctaatttctttgcttcgagacattagggaatgctgatcattttgtttataaatcaataatatcaaagaatagcaattgaatgtttgctccaaaaatcaaaaccatgttttagaaagctggtagttttaaagtgctagtgtatgtacaagcagaatgtttagtgtacttttactgctcttgaaaatgagctggtaaatacatgtggtaattatactttctgctcaatcttcggttcccatttctaccaaattctttctaagatcgcaaagggaaagacaaggtgggtgaggctgactggtgctgtggacacgtgcgaagatgctggcagatgtgggccacgggccatccagaaacgtgaaaagaaaccagtgtcttttcccactaggtcagccccattgctctgagctgtcttctaatgtgcatcttcttaaccaaaaatgaaaaagaacaaattcagttctgatttcagtgagaggactatgcaaaggggctgaagaaccagtgacttaggtcttcaagggaagcattcagtaagtcaattctccaggggcatggagataaaaccccagcgtctccccaagagtaaacctactggcaagtgataaatcccccacttccagggcgctgcccttactgtctggcgaggccacagactgcaggtggacagacattaaaaaccatggtcagtgtgagaatgaacatgatggatggtatgacaattatgcaactgctccttcctcttttctttcacatagattgccctgtgtgtgactgactccagaataaacagattttttaaagatctagtatttctaacagtaaaatggatttccggtttgcccagggggaacaatgggacatcccagtcatcatggtggcatgaaatctagaaagcggaagaaccagtttctccattggtacgaatctgtctcccactcagtagctcagtttgaaactttgctaggaccactagtgaaagtagtgaacatccgctcctgagagtgaagagtgctccctgtctccacactgggggcacaggtggagggctcccttggagggagcagtgccatttgctgaagctgcgatccactggagctgaggcaccccctcttggcaggcacccctgctagtttggagggtctgcaggggaaagacagagcgggcattgtaggcctgcctgctgcttgtccggtacatctcctcgtagtgctactgaggctgggggttaagagtgaaggagcgaagaaaaaaaaaagctgtttgtttgaaatgattttgttcccagcagtaaaaacagtgctggtaactgagaaggcctttctgtgatcacaaatgtacattcatacaagatgggagacaactatttaaagctgggaatgtgctgtgagggtgaatacgaaaacatgcactcaaaacggaggcccgtgtgtgggatgtgagagccgagaggttcacagaggcaagagatggaggctttatgtgtttcttcatctttccaaatgaattatttttacaggaaaatactcgatgataaaggatagtcttaatatcatgtagtgaaaagaacttggactgaagtcctaaaacgctgggccctgtctggaataggcttgtcactttagacaacttactcatttcacccttgattttcttacacaggttatagggttttaggtatcccatcagataatatgttaaaagcactctgtgatctacaaaatgttattgctgttataaatgataatattattggagaaaatcctgggttaatgcctaagagatcatcaccgctccgtaacgatcgtcaagatatgatgtgataattccatggggctgttatcataccaaacataaaaacgctgcatttttcagagcatgaattctttttgaaagatgagttttagaactgaatctggggtttcaacatttccgttctaaagaatttctgattccttgcccaaaatcgtttggttatatttaagttctgaaagaacacaaaaatcctggcaatttatatgtttgtctcaacatgcgggtttttgcaatttcaagaaaataaatttgtattatataggtagatagttcagaggagctgtctttttttctgagtagggagcttcatgaattattgttaaatagtgttcctttaatagtgttgctaaatagtaaacagctgtgggcacatttttttccccccagtgtgacttctcaatgaggaagaaaccttaactgacaggagtgatcagaagatttaaacaatttaaatcttttaaaaaacaaaactaaaccaaaaagaaaaaaaaaatttacaacagatcagttaactggagattgtgctttttggaaccggattctaacttaagcatggtagcaattctaatgctatcttttattcaacaccattttcctaattatcttggtctaaatgtttccaaactttgttgtttattttggcataaagagttcccaaggccaccgcctcttttcctagagctggggatggtgttaacaagaaggtgagatgggaacacaacccattaacaagcactgagaaggctgtggtctgaaaaacccctcgagcagataagaaggcgctaggcaagagtgagcccaggaagagagcaaggcagagcccccacaaaaatattcattcgcattgtttcagtgaagataatcagaaggatttccctcaggtttcttataaataacattcatttcattgtctaattttacagatggagaaactgagacatgcttggaggactgacctgcaacagggtcacgcggcggctgagcaggaacagaaggcaaatttcctggtccctgggccagttttccacccaatctaccccgtctaaatgaaacggcagaagcttagttttgataagcagttccatgaaaacatgtcctgtgccagattctcgctggtgcccgagacactccccgatggagggttagggctcggagccctttaactccttcggcacagtggagaaaggtttaggaaatagcagaacaaacgcaaaggccttgagaaggcccttgcgagactcagcccaggactcttctctctgtcctatcttcagccctaaagcaaagggctgaggatgtaagaaggctttcacctgggtccttcgaaacatgcctggtgcctttattaactcctctacttcagaaatcagctgcaaacgtcctctctcccagtgggcagagcggctgcactatatgaaaacgacacatgtgaaatggagggtgggtatgtgaagctcaggatgattcatggattcgctgcccgtctgtttaaatgtaatactctttcagtgcatcaagatacctgatgccatgattaatttttgtgtgtggcacagaagcaaggagaagttagctaatttaagctgatgtgcattgagtcactggaaattggacaggagcaaagaccacagaactttcgaggcagcagattcatttgggcttcaggaaacgcggtgcatgagctgtttcaggtgctggggaaaggctctgcgttagaacccacaccttccgtctcccgggccaggtctctttgtaggccaccacggagagagaaaagcatcttgagaatcctaatgggaaccaatgaagaaatgagtatcatatttatatatctgctataactcactttctaatgaacaaagtcgcttactttgaaaagtgatttctctcttgtgtatggctcgggaggagggtctaaggtgggcctcgctactccagtgcctccggagcccagggaagctcacctcaggcagcctgcagaggctctccccttctagaaggcccagcaagcgccccgtttcccacagacggttcccacctggggatgttgaaccagtctcaccagatctgcttacacggaggagctgcacatcgaacatgctaaaaactgcgttatgttttttaaaaacccaacaaactctaaaatgttagctgtgggctgaaacactgactggactaaacaaagcctggcaatgggccagatctggtcagctaggtctcccagctcagcaatctggcttaaaggagcaccgggtaagggttctttatttcctgctgaatctgacttaagtgtaaaatcgagcagggatccccaaaccttcctctcacaccacagctgtagggcacactgaactttattctgttcagtagaaaatgaaatgaacaaactataaaatgtagctccttagatttgtttataatacagattcaatatttaataatacttttgttttcctagttttctgaaattcttcatatacgaaatgtaaaccacaaagggaatatgattttaaaaccggaaacatattttccacccaccacccccccaaatttcattaaacgcataaaagaaaatatcctttgtaaaatggctaattacaaaataattagtcacagaggtcctgtataacagaaacgacaacaactcttaagtttcagtcatcaagaatcaaggaacttattatttgggaaataaaaataccagttcaccttaaagtaaattttgggttaaaaggaaaaaaagatggccaagcaaagtcaagttattacttcaaccttatgccctgtccatcttttcaaatgtacttcagataaaaacaagcaacaagagcagaatgtgctattggtggccctcccttgaattcttctctgagctgccaccactcccgagtctcccagactgacctctgagtcaagccagatgggactgagagagatgttaagcaagtgctgaaaaggtgacttgagtctctggcagccgagtctggagcgagtttctctgcaaattctctgggggttgttgctttccaatttctcaggaatgtttaattctcctcatcccttcactgaatctctctctggagaggtcagggaagcctgtgacatccccggagggcactgcctaactaaattagcatgagataactttggactctctcccaaacatgaaaatacaagggagagagtttcattaaaaacagaatactaggtgatcccagttaatcccggctctaagctgctgtagaattgctcagtgtttacattttgactctcttctcggtgacagttcaccgactatactgccagctatgttatgcatacagcttgccctcagctgaccaaaccctagtttcataataaaggtaaaaagtgggtctggtggtgttaaaataggtatttagcctgtatatgttactatatgaagcagaagatccagaggtaaaaataaacatttcagtactgaggcctttaaatatcttttaaatcaggaaacaggaaaccttaataggtaacatgagtcattaaccatatgaatgtgtgtaaacaggggaatatctaatgtcacttcagtaaagcatacaatgtcatagagacatgctttctattatatccacaaatatttgaaagaatacattgtaaatatttagaacgacagtataatcaataggatatgttcaaaaagtgcaaggatgatgatttcagcatttgcttctaaaaatttaattggaagaacagctccaaaaaagggatcaatattgccagctactaccaatatatgacagataagatactgaagaattcaaacttgggtacataccttagaactcctgcttcaaccaaggaggtactacgtttactcattccttcatgaataaatgtttcttgttagtcactgtcacataatatacaggttgagtaccccaatccaaaaatctgaaatctgaaatgttccaaaatctgaactttttgagtgctgacttaacgtccaaaggacatgctcattggagcatttctgtttttggatttgggatgttcgaccagtaagtataatgcagatactccaaaacccaaaacatttctgttcccaagcatttcagataaggaatactcaatctatatattttgctttgatttaaacatgtttttgtatcttttgaatattcataatttgtaaaaactggcacttcacaactcctatttaactactgacattttacagactaaaagagttatgcttatatttctcattttttgtgtgcttattcattttgagttccttttaatattccttcaatattgtaagagataaaagatacagaataatatgcccaggagaggaaataacagcttactctgtctgattatactatattctacagagagaaaagtactcagtgataaaaaattattcactagtatattataatttaagttaggttatctactgatgtaattcgttcctagaaaagtcctttattttgacttggtgattctgtgtgatcgactttcactcaagcttcacgacaataactgacactaatagaactgggtttacggagataaagaggaagcggatccttctcccagaagcaaccagtgtaacagaaggtatgcagtctaacttgtgagtaaacagaattctggaatgtccaatactggggtaacaaattctctcaaagctggaggaaataaagaaaatgacactttaacctgtgtcaagctacttctcagctaaaatccaagttatattcacactgaagctatgaaaacacaaacaacccaggaagcacagggatggaattgattggcattctgtaattccctgccttcccttttgctaacccctcatgggcattttcaaggggactggcaggactcagtgaaatcctcagccacttaacgaggctattaattggccaggaggaagactgaagcccaagcttcgacctcaatagtttaaagctctaacaaaccaacatcaattagcacagacacaaaattttgatatcctttaggtaacacagagtttaaatgttttttattttttatttttttttttgagacggagtcttgcactgtcacccaggctggagtgcagtggcgtgatctccacaaccaaaaaatgcgtgatctctgctcactgcaacctccacctcccaggttcaagtgattctcgtgcctcagccttccaagtagctgggattatgggcgtggaccaccaggcctggctaatttttgtatttttagaggagatggggttttgccatattggccaggctggtcccaaactcctgactctaagtgaccacccgcctcggcctccccgagtgctgggattacaggtgtgagccaccgcacccagcctaaatgtaactttctaatgattgatatcttttgttatgaatgctaactaaaatcttacaacattttggggttctctgtttaatttttaaaagcacttattattaactttacttgagtcatggactcctttgagaatctgatgaaaaatgaggatatcttcttccctgagaactgcacacatgtgtgagccaacacacgaacacatttttacctacgacttgaggaaattcacagacagttttagaccctaggttaggaaatttggattttcagagagaaagccacaatttccagtgatctttcactcactgatgcttcaattttgcatgtgtttactgaagaccacgcgtaaggcactgtacgtaaagctgtgtgggacacaaggaactatcgaatcttgttgtggcagcggagaatctgaccgtggagcacacatagggtgaagccacagacaccatcaacgcggctgctgcagagcgcctctgggatggccgtttcctccttggtgatttggagtccctgccatgaccccacggtgtggggagtgagacaatgagagtgaacagtacttgctttgtaagtggtaaaccactgtgcaagtgttagctgttggttttatgaagtcaaacttgctttcctgttttgagagccaaccactgagtagtaaaccaaaaatttataccaggaaagtgaaagtgagatggcagaagattagtcagaaacatccaaaagggtcttcttaatgaggatagaagatcacttaatcaggagtctgcataccaaaagcatccagtcaactgttctgaaaaggtattttaaaatgatgatccaataagaaagaaaactgccaaggtaataattgaagaggcatttgccattgcagcatggagctctgactgtgagtttatgaaaagtgttatttaatttccattttcaggcagtcccagatatttttgatatatgtaaaataatgagctattcatgtcttcataggatatataaacaaactaaaattaaataaattaaataagtgaaatgtttataaggcatagtcacttatttcttacacagaatatgctaaaatagcccctccctggtgttaaaatatcaatattcttttggagtgaagccatctaagcctgaaagtgtgattaatctggagcgtgtcagcttccagacagtcaaacaaatcatattcagttccagatgcatcccactgaggatggctgtgctgggggtttctttgtcttctcttcctcctcactctcttcaacctaacttaggatgctgaaagaaaccatgaggaaggcctgggcctcagacacactctggtttgaatcccagctctgctacttaatgactgtgacgctggcaagtcacctccgctgtaaaattatgataacaatgcctcctttgcaggcccaaacaaaatgcacaagaaaaggagtgtgaagtgcctggaacggtgccaagcaaatagtagtgagtcaatacaatggtggctacaatagtgtgcactgatgatgccatttcctctgagtaaattggatgcatgcatcctacagctacacagcactgtctgttttgcaaaacaccttcatgcagatgtcatttgttcctcatgacacatttctgagttttgtgcaaatcttactgtaacctgtgagatgttcgctgatctgtcaaagtcacacagtgcagaaataagaagtggtccaactgaaagctggagtttgacaatatctgatatgtccagccagaaaagcatcctacgttatcagcatctattggtacagtatgatgcttaagctcagctctatgaatactgtaaaaatccaagaaggggaagaagagaagagctatctgagaaacacgaacatatatctaggaggcaatcagtctcaggagaaactttagagtctaagaaagaaaaggaagagcaggcaaagaaggtttttgtgtaatttccaacagcaatagaaagaacagccctgtgagcggaaacctgtagccttactgaggtctgggcttacagggactagaagaatgatatttatgaaaacagtacaataatgtgtccaagtatacactgcccttttgtaatctccaaaatctcatgctattttcagttactgttacaaggaaaatgaagaaggagacaatgaattgaagaccataatcaaaatccaatgcatgagctctctcttttttaacccctgagggtaggacaaggaaggaatatgctaaagaaaagaaaaaacatgtttcttataattggaaagtgcttgtagtatgtgtggagaaattctgatgcacataatttcctgagtcctttcttttaatccccagagaaaaacatggcataccccctccatttgaatctgcacataaagagaaaaggcaagtttcaaatccaaaaggggccattaaaggatttcactgggtactggaactgcatccaacaatggttagacattttacaaattctacttatttcttcaattaaagtaaaaaacgcttgaacagagatgcagaggtcatccactgaagtttggggtgcaacatcatctgccatcatgtgctggattatctagactagcaaagcacgggggagtatacgttcgtggggactggcatataagaactttgaaaaccagctgatgactgcagacgaagcctggctgaaaaactggtcagggttcgtgatgacaccaaacgtaaaaaacaaaaacaagcatggactcagggtcgcttcgcttcctctccactgttctgtaggtggtggcttgtcagcaacaactagtttctagaaagagagttttattgaaaatactacctctgtgttcctgtttaatattcctcatgcttaagctgaaatggatgtttcagagcaaaatagcagttaactgtcattagctggaaccaatattgtaaaatcatattcttactttgtgaatgacagagcctgctaatccctatttgcaaacatgaggctcaaatggcagggttaaagcaaactgcaaggacagaggaggctcttggcaaggagggtttagactaactcactggatgatgaaaaaaggcagcagaaattcaaggggaaaaacagagcatggcctttacattttatatgcattcaaggcagttagaaaatgcacagagggtcctcttttttttttttttttaactttaagagaagtctactatttgagagcaatatctatattatttgggttctccaaggtctttctcaatagttatgatattccttgaaagtaacagcatttactgaataattctctaaatacaactctcttctcttaacaaggttattaacgaaagctctgaccactgcttagaatgtttagcgctcagcaatgttgaagtgttaggcatgaaatacatgttggtgctaaatcgtttcacaaagtggttggggatgcctggggactacaacctgcagagtgacactcatggaggaagagggctgcccttgggcaggtgcgtgcacatcggagggaaatctgagcacgtgtggtgtgacagcttcacagtgggccagagaagggctcgactggctcggaaacaggcctgtgctgagcagcatcgatggctgtcagatggactggcccagttctccttggggagtgtctgacacaggaattctaaccgtttcactcctcttgagaggatttgcaaggaagaaactaccgtggaggtaattatatcttattccaagaaggaaagagttaatcaagatttcagtctccttgggaagcacccaggagagtttcacatgaaagggtgtagacttgtttttaagaaatatcaaatccattaacagtttatgagtatctcagacttcaaacatttactattgggtcaaaagttcaaaccactatacactgtacatttttgaaaaacaggaactaaactgaattttgagtagtagctttaatttaaagcacagaaatgacaaactatttgaagccaaacatgacgtacaaaaattaattgaagaaaatcttgaaagaagaaagtgatgaccattgttgctccttaaaaaattcccaaagagtgctgactatatcagaggcaaggccttataaataaatgaatcaaaaccataagaattctacttccctcatctcttttcttagctgtaatgttcatataaacatagctgcagaataaaggacagtatattatctggtgtggagagatgtactgtcttcgtaactcacttgtgcctcatcactcacatgtcacaggctaaccacccccgctgcggaaatcacagcatctatcataggatctttctgcatctgtggaggacactcagagcaatgagttgatatgagatatggagtatatcccacaaggaagaggggcaggctctcagatgaattatgagggtcattccttcacagctgcagatagttttcatattttataaagcaaagcatgaggcaatctctcactgtgttattaaagtggattagggcccatcagcatccccaaatgatgattgtgtgtaaatgtgcagacacacagacaaacatgtacaagaatgcacacactcgtccttctgtctgtctcaccaaatatccaggaaagatgtttcaggctacagtcacattgaaaacatatgtgcagaaaggcatgctaactcatgttggggtggaaacgacttcacctaaaggaacagcttccaaaactctcctctgtggttataaagaagcaaactttcatcagtcatcactgcagtcatctgattgaatcagtgtggcatgtaacttcagggatcagaagactggagattgaggaaagggaactgagtttcagagagctgaaggtgggcagttcatcagaggcaaggccaggctgactagcgaggaatgtccattccagggggagttgaaggggatgagaaatttccaagcggagcctgctcgatggcctcctgtctttggctgattccgaaagacaagtctgttagagacaacaacttaataaaatctgtaacagctaatatgattgacaggaaaagtaataataaatcaaggacccaggaatgaagttcttcagaaataccaagccttctagagaagagatggagaattatgctagcaagcgcatgcatggctgaaggtggggagttttatggacaaccttggtaagaccccactactcatcttctttactcatacaacatcttcctttctatctgcatggtatttggagatactggaagagccaaaacgatgcaaatattaaaagacaaacactgcataaccaccaccaattctacagggtggctgctagctcaaaggcatcttttgagtgtcttagaggaaggtgccttttccttttactctgttgaaaaactctattaatatgttgattcttacgataaaacactttactgtcacttgccagaaaattaccacaagtatacaaatcaaagatgtctgtaagagtggcactctcactggacatgatgtgcttggacccactatactttgaaccttccttgacctcatgtttagcaggggtcaaaacacattactttgaagcctgtgtatatagagcgatttgcagctggcctgatgccctgctccagggatccagggatataaaaaaggcagtgttttgccagatagtttccatgttgctgtgaaatgcaatgaaagttttttgtttttcttctagaaacttctgtggcttggagttcaaaacacggttctttgaaatacagagaaattatcctacactttttcaaaaatatgagtaatagatggctgtctttacataatagttattttttcttcaagttctctaaattctctaaaatgaacatttattcttttctgtctttattgtgaaaaaagaaaagtttatttttgagaaataaaaaaagggagatgggaggtatgtggggttttatgataatattctactgagcaatacaatgggtgtcctgtcccctcctgtgctgtactagcacaacctctgcactgctaccgtcgtggaatgacacgggcagccagctggactcagagactcagtgcctgcatcaacctccaacgaaagccgtgaccgttcagaatccggagttgactatacaccaggctcaagaagacacagagttttctcaaccattcatgggagggcagtgaataaagaccatttctctttccatcgagtttggaaagtcagaggacagttgctgcctctctttgaacaaacgatgcaaaaatacatagaattttcatttaagatttcgttaaatctaaggcatcgccattattacgaagaattatgtcccacacagaatttttggaatattaaatccttggttttcaaaaaatggtctgtggggccaggtgtggtggctcacatctgtaatctcagtgctttggggggccgaggcatggagatcacttgaggccaggagtttgataccagccttggcaacatggcaagactctgtctctacagaaaaaaaaaaaaaaatttagctgagcatggtggcatgtacctgtggtcccagctactcaggaggatcactctgagcccaggagttggaggctgcagtgagctatgattgcactattgcactccagcctgggcaacataacaagaccttgtccctaaaaaaattaaggtctgtgggcatcacttgagagtgaaatatgtggactgttaggctctgtttcagatttacaccatcgaaacctgcctctaagtaaattttcaaagcactgattttgctcctttctatctgggcacttagcttgcctgccctgaaagaccattaaacaggaaatgcgcagatatacgggtgaagactgacactcttctcccccaagatctgccaagtcctggggggatgtggcccaaacctcatcaactaaggaagcaacaacaagagcatctgtaggtggggatctggccagaggtcccagatgatagatgaggtgttagataatcatgagtgtgaaaacaaacggctttagacactaattctaggcacattttaccctgtaaaatttggcataatgataataaagcccctcactgatgaatgcctaccgtgtgccaggcaccatatgggcatgggccatacccctaatcctcacgccggcagtgaaacaggttacgtggctcctgctgggtggcagaagacatggaggggagacgcgctgctgcgcctacatagcacagctcctaggcagcctggagatcctgtccacttcaaaggtaatgttcattccactattccacactgcttccttaatgttcatgttgcttcggaggatgtgtgatatttttttaaatgtggcaattctagaaagaaaactaatctgcttatatttttattttatgttatttctatatttcttcttgatatacttccagatttactgctgaaggctgaagtcactttattttgaaaaattaagaaaatacacacacacaccagctccatctggagactccatttcaacagtgtgtgttacaccatcactctgaaaagagtttcccgagattgtaatgacatcaatatttctaggaaaaaggagaatgttgaacacgtctctgctcctgaaatgcaattatgtgcattcagcaggcatgtgtagggaatagaactagagtttaaattagatgatctttggatgaaattcacatttgtggaacactttcttcttcgggggatggagggatagcaagagggtataaagtaccttctccattataaaatgcaaactgttctcagcagacggctcaccatgaataacgaaccagggaattaaaagctttaaacctgttaaagaagcaatattaagtttggtataaatatagctgaaataatccagacagttttatgaccttacaccccaaataaaggtgaaatgctgaattctttccctagaaatagaggtaaacacagctaacagatggaagagctgaatggaaatttcaataaagagggccacaaagaagcatttgtaagctcaggggtgcacgcattaaaaaaagaagctgaaaaatggaactttgttttattttgatagagtgccaaaacagtactgcattccttaaagagctgaataaaggatcgagttagactggccttctcaacacctcacgaaaagcgcccttgggtctcattttgctgggatgactatttatatgacaggtaagggaataactttgctggattctgttacactagggcctctgtgacccctaggtcaaaagagcaaatgcaaaagtgacaatgtggataattgcctgtttaggataatggaatactgattgaagtcaattattataacacctgaaagataaatgagctgatgttaaaggttcagtggagacagcagacgagtggaacggcgggcactgtgctgaggagtggccaaggaactgtggaattcaagaggagggggcagccttcctgacctggaacttactccagcctggagtgttccaagatctaaaataggttagtttgtaaaacatgccataaaacagaaatttagcccaatgtctcgaactgcaggattagagtaacattagttaacgtggccctccattaattttcactataacctctgaaggcctagacttgccccaaatccattatttttgtctgtcactggagggaactttcccttcctgccagccaggaaaaagcctgctgacgtttgcagctcagacctcaaagctcgtcgacagcagcagcctgaccagtgtgggccaggactgtaccagctctgcagtcagaacttggccccttgcattttcttgttttttttttctcttatagcagaaatacgcctgaaaatgtttttccaaccccaacacccctgctgccctcctggttcaggtttcttattgccgtgtctggcccttcaaaggcctaccccatcatctcgcagtgctggcgtggcctcccatgctgatccctggaccagtcctggctggggtgggagtgaggagggagcgctcaagtgggggtctcaagagaaatgagctgtactctgtttagaaatcagaccagatgtgatcaccaccgtccacatgcctctgggtacgaggacagccttcctccagcagccctctcagggtcatgctggaggactttctgtccaaggctccacttactggaaacttcagaggagggtctttcatcccctgatgctcccctctgagcccaggcccagttctgaccattctagcccagtcccactaacacagcctcctggccgggggaagtatcctgcttctggagctggaagtgctcctgtggcatcctgatgcatttgccaatgcccagggtcacagatcaggtgaattaacagcctgggactctacctgggccctctgcctccaactgccaccacagataaaggtaactgtgtgtgaattgagaagcttctagagacaatgactctggaaggaaagtttttgatagagtctgcgattttccagcgagaaacaatgcgtgtgacccctgcagagacaatcctcatgtcctccatgagtgtgcgtctgtgtgaaaacgaatgtcctctgataggaaatgaccccaaaagcgctcttgtgtttcccatcccctcccaagaacagcgtataagcagctgcacaagcatgactcaatcatggatgcgaacctgtccctctaactgatagtggtaaaatgaaaaaaacactgaccaaattcaatttcttctttaactcattgaaggccacagacgtaactgagcgaagtgtctgtgtttcgagtgcacagagcggagtggaagtcggccctgtgactgtcatatcaggcatattttagtgaacaccagacacagccaggctggtaccaaaactgctggagagaatcacctttcccaaatcctgcctcggttggctgaaggccaccaaaggcacagtgtggtccagttctgagtttagtcttttgaggacacatcccacccaacagctctctcaggccaggagccaccgtgagcacgcctcactcaaagtggggaatggacgccaaatcgaaaaagagcgaagtgaatccgacactcttgctccgcttgcagcctgtccctggcttatacgtaaagatacatgctggcaattgtgttttgtataagtaagtttgatgagtaaaagttttgttttctaaataatgatttctaatcctttggcaatgtgtgacttcaggcaaatcacttctccaggccctagtcttctcatctgtaaaatgatgatactaccatgtagtgccacagagattcttttaggggttaaattacagtaccaaggatgctagaagacacacagaatgtattcaataaatggcaactactactgttattatgggttactcatgcagtggcaacggtgtccccacagcttcctgagagcgcttcctctgctggcctgggagaggacggcatggcagggcctccacctctctgcctgtctgcagcaccaggagccttttggtcagttataaaccctctccttcccctcctgcttcccagcctctctgcctgcctgaggagagcggggctgctgggtgccaggcccaggagctggctcccgcgctgctctgcccatcctctgcccgtctcctgcccaggtgccggcagcatcaacacgcaacggctcactgccacctccccaggctgcagggctcgctcacgccatcacaggagtcctagtgcctggtgagatgtcagactcagaagaacttcgccatcttgttttgctttgttatacaccaaggtgatgattccatttaatcagagagactgaactgtaacccaggatttacaaattacatcaaggaaccaaacttatattttaaaaactagaaccagatttcccttctccttttcctttcacatctcattctgaacacagtttgagtttgaagactggtctgtggggagcgagtttttctctgaaactgttgcagttcgacaaaaaccaatctgtgttgtaaaagcatcgaatcccaagcgctcgccttaagtgggaaaacacgattgcaagacgaaggacaccgagaaggcacatgacagcttgctgtttagaaaaagctctttgctgaccaacagtaagaaaatggccttgtgtttcagggaaccaaggcaggcctcacgaaggggtctccagctctgcctggctccctgccttcgtggtccttcctccaggtgtccttgctgctggttcaggtcccgggtgaaggacagagctcagaatgggctgtgttcctgctgctgctggtggtccttgcccagtgtgcagattgctgcccggctcctgggctctcgctgcttactctcgctggcgtgggtttctgctgttgtgctactctgggccctggcctgggcttctagccctctgctcctcaagctgactctgccgagccttctgcctacttcctcaggccactgctcccactgggcctgatgagcttgagtgcctgcgtgtgaagcctgaactctagggcctactcccctctgctgtctccctggcaccctcacacccaggtgaggccacctcaaatcaaatgtggtgatggctcttccacacatggccttaagccctctgaattgtcagccgggagaataacatcccgctgtgaatatcctctgaaatgaaccctgctggtcataacttcctttcctttcaacttagtactgaaagatgagtcaccatattccaatattcttaatggtcatgggggcctttgtacaattttacagtattgtaggaataataatatagaactggtgcaatcctctcaaaccaacttttttttttttttggcaaaaactgatttttagagaatcccagctgtcctgaaatattgacgagcaggagtaaagtgggctaacttcaaacacaaatcccggtccctacacctcgccgccaagttcaacagactgcacagcaacaggctgttgtgcttggatcaaaaggatctgagagtcttgaagcaggcttgaaatacaactgattttatgatgagtaaaattaattcaatggaattctattgaaactgcatggaagaaagagaatttgacccagtttagtccagactcacagaatttggtccaattctttcatttactaccttataccaacttagcccaaaatatatttctagcaaaagacccagttacatgtatttaaaaagcatgaaggaaaaataaaacaccaaaccaataagcctaaacataggtgtactgtaggagtcactgtttccagatgcccataaccaaacacactcatctacaatttaagctctgtgaacattcatttacttatttatcttgagtaaggacaaatagataacatttttattatctcatcagaggccacaagaagcttcaaatctgtaatcttttaataatatctttccagtccaagccttaagaccaactttgttaggactaataaaaacctgaatttagagaaaatgggaccatcttcaaacacaaatttcgtattacccatagaaggatgaatgctctttataaagagactttggatagacatgcctcatggctaactggctgatttttagagcttactgattttaactcactcttggcaaaggcaaatattaggaagttgttaggaaggaataagtacgggtgaaatgagaacatagatcaaaatgaaataaaacacttataaaataatttgactaaatgtccactgtgggccaggcactaccccatacttgggtgtgaacttgtctaattctcagaataacgttgtaaaggaggcattattatttctctgtcaagaaaggatcacagaggctgggtgtggtggctcatgcctgtaatcccaaaactttcggaggctgaggtgggaggattgcttgagcccaggagtttgagaccagcctgggcaacatagtgggactccatctttacaaaaaaaaatttaaaatagtcgggcatgttagcatgcaactgtggtcccagctactctggaagctgaggtgggaggatcactcgagcctgggaggtcaaggctgtagtgagcagagatcacgccactgcactccagcctgggcaacagagtgagaccttgccaaagagaggagaggagaggagagaggagaaggttaagaaactggtataactaggggagtaactggggagctgaattctgaacaagttatttaacaccaaacctcaaacaggacttaatcactcaacttaaagactctgatatcccttcctttgggagatcttgctcctgaggttccacggggtgcaggtgcaagtcttaatgggctctgatattttaataatctatttacttgggcatgtcccgcaaaattatacatcccttgagggaagtatggaagtatggtgcttcgttgaccactgtatccctaatgcctgactcaagtatcagacaaacactgaagtcaggatccacacatcaaagacaatccaaatggaggagcacgattctcttattgtttgcaatatagaatctgaataaaattagtgaatcaaaataataaaatgcacactgaataaatttaacctttccttgttccttaggagaagccatgatgttttacataggtagtgataacattgctacaataaatacttggctattttaagaggtggtaattttattactactgaaaataacaaggtagagagaaatttgaaaacattcagtaggtataagctatctgacaaggaagcttgctcattcacattaataagcttcaaatacacatactaaaaggccatgaggctctttgtacttagtgacagaaacaacattgcgatgtgaaggttactctgggtgactatgaagccctgtcccttgcccctgggtctatgcaagccctggattttgtgataactcagtaggttgtgacacaagatgaacaagcctaaaaaaaccccaaaccatgaacatgtctcaacttcactgaaggccttagttaaggccctaacaggagtaaaaaaaattaggaaattaaatctgttgtaataaaagtaatatttgtatgttataggtgggctatttatttttgtccatttaaaaagatttctgagtataataatatgggacagagaactgaaaagtcagtttgataatcttgaccaatctgaccaacatggtgaaaccccgtctctactgaaaatataaaaattggctgggtgtggtggcgggcacctgtaatcccagctactcaggaggctgaggcaggagaatcacttgaacctgggaggtggaggtggcagtgagccaagatcacgccactgcactccagcctgggtgacagagcaagactcgtctcaaaaaaaaaaaaaaaaaaaaaaaagaaaattttcgcaaaactccttccctttcccctgcctgaggatgttcggtttgcctgatcccaggactacccggggcgggaaggagagcagaggccagagccagaggggagagaggagacagcagatttggccggatgtcagagcaaagtctggagctgagagggataaaacaaatctggagacatctggggagatggatggtagagaaacttttggacttactgctctgggtcatgtgattgacacccttatgccacttcttctagagactgcagaaaagaataaaaccattttcccatgcttcacagtgtggctggctcatgcttcttttggatggaacactgaactaaggctgaccacccagcagcaagcttccttcctttgcttatgtgtaaagtgcactgatgtcattctccaagctacaactgttatgcctttgcggatctgactgagggagcactgcagaacaccaacaattgcacaattaattgaactactgcacaattagttttgaacattactattcataaaatatgaagaaaaagttacttagagaattttcaagaatagttctgatgcagaaacaatctgtgctataacaaatttttctcaaagaaaggataaaaggtggctttttagtctaacagggcaagaatcaacataaaactgctggataaagctatagtaacacctcaaagtctaagaagttgacccattattttctaacagagagttatattacctaaacagggttatgtatataattcatgaagctctttgtcttgctataacaaatctaggtggttagtaattgaaaaacaaaataaaaacgtgtttttatttgtgctcttaataaatcttcagcatggaatgtaaaaaataaaaaagagctctagatggtaggtcaagaaaaattctaacaagtagcaagaacaaattgccttaaaacttggtagcttaagaccaccatttcctatggtcatgaattctttgggcccgcaatttggacagaggtgttgtctggggcctgagctgggagattccacagctggcagctgtacttgttggaaaggccgttcactcctatgtctggaggtcagtgctgacctccaggcccttctacgcagccctcgccacgtgggcccccttgggcatcctcccaggacaatgactagatcccacgagagcaagtcaggtggggcagtgttgcctgccacgacctgcctcagcaccagccctgtcttctcttcatctgggcagccatgaccatcctgcccagcatcctcggcagggaaggaggctccatctcctgatgggggtagcaaggctctggaagagcatgtgggactccaatgtggtcgtatttagagcataatctgccatagtggcttggtagagctcatctctgtgagcttcagcagtgctcattttctgcgcaccattcagcaccctcttactcccaagaagggatgacatttcctttgtgaaaaatgctcctggaaataaattccaatgcaagtgctgatggaggaggagaagaggctcagcagagatggttcttagtcagaaatctgaaatattaaggagtgagatgttaaatatgacagcggtaaaggaaaaaaaaattcacgtaaaaccagcgtgctgctgcttcagcgtgatattccagtgccgtccgagaatttggagacggtgaaggtcttggaaagtctttctagtgaagctcaaggtcatataatctatgcagaatgatgtgattttaataactccatgaaaatgttttatcatttacagttcaattcagttcatcaccaaaattcattaaattgcagccatcaatgaggttgataactgtgatccagaaagatggaaatgcaatgcctcagtaaaaagcatccaggaggtctagagcctcggctgagggaagcagcacaggaagcagggttggctatgggcaagcaccagtaagaaccaaggccagcaggccagggaaagagtgggactccagtctctgggaataggatgcaaagacttaagacaagcccctcgcacagcctgagcaagcatagcagaggcttcatgggcaggaggggacctcagcatcccaggctggggccacacactggggccaaatgaactgaactctggccctgagtttgtgatggttcaggcactacctggagtggcgctgggcagtctcctccctacagactgagcacaacagaggcctgaaaaagtctctgggcctggaagctcgaagcaatgctgcccacactcccaggagcctggttttggttatgagagcaggagctgtggcatctcctaaatgagacagttgtatagcgaaattattaaaatcaaggaaatctgtcagtaatttgtggtttttttttttatcactgcagtaagttgaaaactatgattacagtggaaaagaaaagaacaaaagaatgactaccagttactcaaaatgtacaacggaagtgagtgagctgactgcaggattgtgaccatgagccacctcacacgtacctacagcctcgcgccactctgccagcgcgtacccacagccaagggcccatcagcaagctcagccccgcagccactcatgactctccagactcatctgtgtcaaaacaaaactaaagtttcccacttaataaaagcgaaaggctaatagacttgaacatttactgcatgtttttgggtatgccttaatctctcccctggctaagctgccatcatataaatcagagtcatgagttatcattgttctagtagcaataaaaataataataaaagcactgtgaggtcagaaaatgtcaagaccagtcagaaaaatgagcgagacataaaacaaagtataaaggaccagctaggattggaaaaattcaggtactgtacctccaagtgtactacagcaggaggtagctgccactgctgttttatttaatgagtctccacataaatcccagctgctaaccatgtgataagtccatctcagaacacgagaggccccattcactatcggtgttcaggcctggctgccattaatgggaatttcacttacagtaagggaaaaaacagatcttgaaatgttctgttggatctaaattgttagctttttaattttagtatcaattggtttgactcttttttaaacaacaaaattaatatgcaaagtctcttcatctaaatacatgaaaaaggagagcgaacaagtcctggatacttgaaacatttttaatgtgaagaaggtataaaaacattttcctggacaccaaagacagaattcagactgcagagtagaaacaaagcccacatcaatttcataagctgcctgaaatgcgtaaatacagaaaagaggggattttgtttggaatattttttgtgggacacacacacttttgtaaactttttaaccctaaggttttgctggcaaatgcatcatttttcaaagaggagtgtgtacaggactgaaatgtggacctccgcctggtgctggaggtgcggctagtgggaggtggcatgggagagtgtggagaaggcaacccgagacaggcagactgggagcccagacctgccactgcccaccgtgcagccttggcaggttgctcacccttgctctcagtcgcccagatgtcaaattggaatattaacatgtggaggttagacaggcaatgaggaaaggcttggcaagcaagccagaaacaggcacagagaggaaaccatgagtcacaagtaagggagacagaggcaaagactgggagccgaccaaggccacagtcgggagggcgatccagagttcagaccagggaggtggaggaacaggcaggcttaaagaatgcagggcagaattgcacaggtaaaggatgtcttacgcgtactgtgtactccaatagattcttcaatttcttcaaaattaaaaagcaatgggacaagagttaaagggaggcagtagcacatgaatggcttaattctgggggcattttgttggttcctaagaggtatgcatcaattcattcacaggctttactatcctggggtttcctggcagaaatgtctgggaagatctgcctggaaatagttacaagaaagaggtagtttctgatattacactagcaatggaaggggaacaataagacctgcaggtgatgacttcattacttcaggtaagagaaaaagagcttctgtcagaattctcctttttcacaaacctctaatttagggctaaccttcaatctagtcattaagaaatatccaagtttctcaaatgctggaatttggctcaaatgctgttaatggaactctatattttaggtcaaataattttaactctttcaaaagccatttgttggattttagttaaaataaaaaaattaattaacttagatctctggacaccctttcattttcctctatgtgttagtgtaaaactgcaaagcaattctgctgctacccacctggagttaggaagtgactctgcagactgaagggcatgatccccaacgagacagccctcacttcgggcaccagccccggtttgcgggtccccaggtcacctgcacttataaccaactggttataaacctgaggggtctccaccttaagtttcataatttgctaggatgactcacagaactcaggacacaatagtcatgtaatgacagtgttattagaaaggatacaactcaggaccagccaaatgaagggacagcaggggacggtctggaagggccccaaaggcaaagcttccatgtgctcaagatgcatcacccccttattacatcaacgtgttcactacccagaagctgcactgcccagggtttctattgaggtttcattacatagtcatgactgactgaaccactggccgtatgctgacctcacttggctcaaggccctgactctctaagcccatggttggcttatctagcttggccagcccccaccctgaaaccatacaggggcccaccatgaattacagagacgctcctattacttaggaaatgccaaggatgtagtctccctcctaggaatcaggacaaaggccaaattctttattatataagttagatagaacttgacaaaaaattattttttctttttcttttttcttttttttttttttttttttcctgacaggctcttgctctgttacccaggctggagcacagtggtgcgatcacggctccctgcagtctcgacctcccaggctcaagcaatcctcccaccttagcctccctagtagctgggactacaggtgcatgccaccacacttggctaatttttgtgtattttttttgtagagatggggtctcactatgttgcccaggatagtcctgaactcctgggttcatgtggtccttccacctcagcctcccagtgatgggattgtgggtgtgagccaccacacccagcctaaaattactttctaattgtatcttactgctggtagcatagctaaatattatgctagcatttaaagaagtggcatatctgtttaaataatatcacacttatatttatgagcctctatcatttgtgatccactctggtatattctatcagtctttccccatctcgtattcataaagatacatttttctgttcctaaatatatgacattgcatttattgctatgaaagttcttattatttttgatgaactgcttctcacattttcagagtcatcccgaaaacctcactctttctgtcaacaatcttatcaatcctactcacttggtgagaaatccagaaataaatggtcacactccagtatgacagctcagaaagaaattttcagcatttagggcttattagacaagcccctcttctcaaaaagaagatgagccaataattagcaataataataataagagctcacaattactgaatgcctccaaagtctccatgggagttaggcatggtcttaccacagcccagtagggcagacactactattttctttattttataaagaagcaaaagtgaaatgtagagaggctgagtaacttgttcagattcacacagaaagtgaagttggcttttaaaactctttgactctagcacctaaactcgtagctgctgttggcttacctacctgttttaaaggaaacaagcagataaaaatttcatgaggcaaattttacatgaagtttccaaattttccaacatatcgaggttttctatagtttttctatagcggttatatatagtatatatcgtttttgtatagtatatatgtttttctatagtagctatatataattgtatgatttgaattttcatttatatccacatgtaccgaggaatatgtggtcttcagtgaatgccagttcattgacaacaatcgtgatacttagggattaagtgtgaagaagttctgctgctgcctgctttacctcttgtggtaggctgagtaatgcctcccaaagatgttcatgccctaactcctaatcagtgactatgttacctcacatggcaagatggtcttcacagatgtgattaagagaatgctgagttggggagtgatcccggctgtctaggtggacccaatgtcatcaaagggctacaaggcaaaaggtcagaagacagagaaggtaagtgatgatggaagcaaaggacagagaatgtactttgtaggcactggagagagccacaagccaagaaatgcaggtggcctctagaaactggaaaaggcaaggaaacagattctcccccagagcctctggaagggatgtagctttgctagataccttgactataacactcatttggacttctgattccagaactgtaagatgataatttgtgtttgtctcagtttgcttgggctgccaatacaaactaccttgtactgggcgcttaaacacagaaatttattttttcacagtcctggaggctatacttctgagatcacactaccagcatggtctttttctagtgaggatgctcttcctagcttatagatggtggctgcattctcactgtgttctcaaccgtggtgggctgggggagagctctgatgtctcttcctcttcttataaggacactaatcccattatgaagccctggcctcttgaactcatctaaacctagtgatctcccaaaggccacatctccaaatacgatcacattaggagttacggcttcaacatatgaattttggggagacacaattcagtccacagcagtgttgttttaagtcactggttttgtaaaatcagaaaaaataagaaacaagtatggtttgttcccttcctcctaagtggaattaacatattatttcctgttcctagaatacaacgtgcattttggtgtttttaggaaagattaaacctgaatatatttttaaactttactactgtttataatatacagccaaatgacacattttttaatgaatttttaatctaatcaaaatagcatatataagtaatatagaaagtcaaatattgatgagactgataataaaaaacagaaatctcttgtttcttgctcctcccaccttgccagactcttcagagtcccctttcaatacttatagtttgccaaatgatgtgtctattctgttatctcctgatcgatgtatttgaggaattaactactgacttattacagcactacagaatttttagcatatttatatacttttaaactcacttcccctctataattacttctcaatttttggttaagtctatattcatagtagcaattattagtttctatataaatattattttcttcagagtcaactagtataacatgatttcattcctttctttaaaaacccatcccctttccccaccaggcttaactgttagttttttttttttcctcggattagttttccttatatatcattttctcacactctccaactttctataacacacatgccaatgtaatttttcataccttcaaacctgtcagagaacctactgcttcctttatactcttctcctggaaacatctctcttgaagggatcagtgttcaatccagtttgtttcaccttcgatactgatcgtttcacctagaccagctactgttgtctgcttgggacttcctttgctgtcatcctgagaattcccttctctctctgtgttggatctcctgcaactattcctgaatactacaccttcacctttcttgatgtattcccttgttttggtagagtatatctaccaatagctttctcagaaaagtacatggaggataattacattaaaaatgatatgtgtttgaaaatatctgtaataccttgacttggtttagaatttcaaattaaaagtcatttccaaaatttagagggtggttttgctctactggcttcttattccaatattgatagaatgccaaatttactcctgatcatgtgtctgaaatctgtacttctggaagttttatgatcttctttttaactccaatgctgaaatatgacaataacagtatttggtgtgggtctttgttcatccactgagctggacaattacacagcctttacaatctcaagaattacattctgctctgggaaattttcttcacatattcatatgataatttccttatattttccatctctcactatgaaattcttattagacgttttcactcttcagtatatcctctaatccccatgtatctcatcttcacccctttcttgatgccctttccctatctacactcactgcaatagtgatctcttctagtttcaacaaacgacttcttcaggtttcctccaggggcactgtggggcagtttcctgggtcatgatacattccccaatgtcctgtgttctatgatagtctcagaacccatgataaaatgactatgcatttgtgaggtacttctctactccaggacggctttaggagcctatgaatctgttctagggatagagatagaggttaacatgagcttaagagttccagctcacttcagaacagtttacaagaaattcagataaacttataaattccatttccccttaaagtaggcctgaaccagggtgggaaaccttaaatgacctctttcaagaagttcatgaacaaaaatctgacttatgatctttaagatgtccatggacttgatgagtctgcttttatgtcagcgaatgtcatcaactccaggacacctggatgtttctgagccaccgcaggtggagactggagtaccttgtgtacagaggtgatacatatagtttattgtgaaggcagctcatcttcctactttaaaatgccaaaggaagtcaaaagccacgtagaggaaaattactacccttttccttcattctctgcaattttatggtcacctggaattctgggtttctcattttgcttagtattcctggagaaacacaaattccctgccagtgtatctcacatctcagtgcttctcccaaatgtctaagattttaaaaaaacagaaagtttgaccagcttattgccaaaaatgaagaaatgtttgtactcagtttaaaatataatgtgcttaggtctataggacagagtcgccaataatggtagaagtggaatgatggaaagggctttacacacttacgtgggaataacttcattttaagtgaacaggggatgaagacggatacttctaaacaaagattgggtcagtgaatgattatcccaggaggatgagaaaaaagaaacaacaaaatataatgtttggatctatctgaggagtttatcctaacattttgaaatgaatttactggccacttttccaatgccctatcaacacctagagggttctttctccttttatgataaacccatgaagatttccagttaaataattgcattccaaatcccatttacgtatgtctactctaatccaaagatttattaatctaagatattctctaaaataacttcactgaggcaaaaaaaaaaatacttggaaaattgcagcaccatatataaaccactgaggtggtacaaaacatttaaataaacaaagacacatgtatatcagcaaaaatcacagggaaaggaaactacggcattatatagaaagctgggtgtttggttggtggtcgaaaccatggaatgttctatgtctagggacagaatctgaggtcaaatctggtactgagaagctgcagaaaatgtactagccttagagaatttggcctcagtttgacttcataacacagtagggttaacactgttgggttgaaggaatgattaaatatcattttcaaaacttcctctcaactctggatattaacaatggtacccaaatcattttatagattgattgagagctatatacatttcctgacaagacctttatatgtgtactattcgggacacgtcattcttatcccaaatatataaaaatcatatggaacctctgaaaaggagacagatggtccattctagattaaatgtatttaaaagttaatttacaggggtgagccactgcacctggacgatgatatcctaagtaatctaaaatgaggctggggtcaaggtgcggtggctcacccctgtaatcccagcactttgggaggctgaggtggggtgggtgattacttgagcccaggagtttgagaccagcctgggaaacatagcgaagccccatctctacaaaacaaaaacaaaaacacaaaaattagccaggcatggtggcgcatgcctgtagtcccagctactctggaggctgaggtgggaggatcacttgagtccgggaggcagaggttacagtgagctgagacagcactactgcactcttgccaaggtgacacagtcagactccgtctcaaaaataataacaatcatcatcatcatcaaaaatgaatgtattttcatacatagacttctacatgctaccaaagactctgaggtacagattttttgttttttaaggaattcccagttatatctaaaacccacaaggcatcaaaattacactaatgcatacaacactagtctaatggctaaaatgactgtgtggagtctactgatcttccttctgaatattcatcccttttcccatatatctgtatatatacatacagatatatgatgcatatatgcatatatttctcttaaatcatttattaggaagagtatctatgcgtgcctcataaactgtatttccttattggggaaaaattaaaaggtgaatgaaacattacagattttaaaatgataatcaaacaatgagaaatgggcaaatcaggaggaaatatgctttgaatgcaaataaaatttaaagattagttcaaaacagaaagttcacatgaaatgcttcaatggtataataagctttgcaatttaaagaacttgtaaataaatgttcttattctgaaagcagttcattcacattaacagtcatccacatttcagtgtactcaatttaaacatctccttaattttaaaatattcaagaaacatttgcaacaggaccctaaataagcactcagatgaatgctaataatttatccgaaatatataatctgcatagtcacagtgacccaataaacagtgaggccagagatggggggaaggcggggactggccagttctcttctctctacaaactccaccaaattagcaggatgcctgtatcggaagagaaagtggtaaccagaggtgtggcttcagcggaaagagttcttctccccatgtaagcacagggttgtgtatgcttctctattcaacaaccccacaggacctggagggctctgcagctgtgaactgtggacagggctctggggaagagatcctggaatgctggctctggaagtccacccagcctcatagttcctccttgtaggcttaccgagatctgggatctgtagtcattaaatcttaggcaggaagacatgtaggaaaaaaaatctatgtaagaaaaagtatgaaacttgtcatttttcagtatgatagatcttcaaaaaataggataaaaagtgaagctggtccaggttatagactactcttagtgtattttcagacccttgtggcacttttaaaaaatacaaattctcaggcctcacgcctgcagactgcaattaggtatactggagaggggcccaggaaactctaattttataaagctccccaaatgctcataatgatcaagtcatgtttgggagctcagatttgatgctgttttggaaaatttccttgggataatatgacttcaaatcacaaccctcaaaatttatttcaatcttctaatattgaacttctacatacacttgctccattagcaacataataattcactgaccctctcgcttcagttaaaaataacaatcataaaatattaatttgctgtgttttccattcaaatgctcactttgttttagtagcgaaaaacttgaggaagcagagaacaagcttcttccttcctctgcacttaggaaagatgtagctccttcaaactgtagtgatgtttgatacgctcatcagatgctttacccattcccttacagtaagtcagtaaaaaagtgatctgattcagtgaggaatgtttattcaaatggctcaaaaatgtaggaagaatggtgttactatatgcccaacaaatgatccttagatcatgactgctgtgtgctcaagcagggatccctaaaccccaggccagggaccagtaccagtatatggcctgttaggaactgggccgcaaagcaggaggtgagcagcctgcaagcgagcattactgcctgagctctgcctcctgacagattagccaaggcatcagattctcacaggagcgtgaaccctactgtgaactgcacgtgcgagggatccaggtggcacactccttatgaaactctaatgcttgatgatctgaggtgaaacagttttgtcatgaaagcgtccccaccccccagtcagtggaaaaattgtcatttaaatgttatagctggcctgctataagcacaggtgtatctggtaaactccacatgttaaaaaggtaaaaagaactctctcacttccttcttgagcttaggtcataaatattttaatagacttgtgtccacctatgctgactttctatgaaactgaaagctcctctcaagtaagtgttttgtgatgttttgatttgtacaatgaaaagcacagtggcaagtatatgtcagtactatcatcatcatcagagttactaacattttaaaatagtcacagtccaaagctacacacattaatgtgtttaatttcccactggaatcctatgaggtaagtatgaatattatcttcattttacatagagagaaactgaggcagaaagaacttaatagacttggccagcatttcacagctaggatgtgtggcagagccggtatctgaacccaggaagctcagaaattatgttccaagggacaccattcacataaatacaagggaaggtgtgcatttgtggaccccaatgggcacagcttggagtgtcctctataattaccagatcccatgccttggcatataccaggacaggtttgctaacaagtcaaggcatctgcactttgataacagacactttgatgtctctgtttgtttcagttttgtctctgactcatttttcagttctaatgctaggaatgtcacatagttatttcctggttttatatattcaaaagtactcctggaaaacatcttcctgcaattcttgaacaaaggagtcaaaggacacaaagttttcacatttttccagttttggtttcgatctcagtttgtaccagcttcagaaaagcactcattccaaagttctagaaatttcattaactgtgactgcactctgaagaacaaccttgcttaaattttgatgtataaatttacttctaattacagagcacacacacacacacacacacacacacacacacacacacacacacactcctgtcttaaaagttttaagaatttaaaagctatcattgcaagatgcaactccacactgtggtatgattttcatataagtcactgtagtggataattttaaaagaaaccagatttttaaagaaatattaagaaactgtttctgtacttagttctcagataagagcagaacctgtagaaccactgagtcttgtgcaaaccttttgtgtgggtgggtctggaagagcatccaggctttctcgtagctggaatgtgagtgaggcccatgtggaggtagaagcgtgaggctcctttggatcagaaggctctgtaattctgcctaaagccagccacccgctgaatctccaagagaaggcagaagccatcccttctcttggcgtattacttgtttgggagtcctccaagcgaatgtcccctaaatgtcaaacagaaccgagcactgtaaagttctgttttgccagtgcctcccttgcaatcagatcccattttctggttttggcatcgcatactgttggagaatacgagacagctttgttgacacctacaccgggtgtgtgaactgcaggctatgacacactggtggcaacacaaacctgtatcttgcttgcttcaaaacatacttcttccttatggaaagtactggaacacaaataacttaaaaatcccccaacttacttctgtcaaacatagggtgttctgggcctggtccatacttcaccagccagcaaagaggcattttgatcactaagacttgttttcaaataggaactttcaaacctttactcctaccgatccctaggatatcgtgtaggtcaaagattagcgagggaagggactggagccagggatctgggctggaggtggagtaagagtggagaactggccgtgacgagggtggagggtgcgggtggtgaggggaggcagctagttctgtgcttcccgctggcaaagagtcccccgctccctccttcttttcccctcaatgttcagataataaaaaacagtctctttaaaacatccaatttattatggatttaatctctaacgatgatatgctggagtggatggcatatatctaagaaagctcaagccttggcaacacggtgccttttgactcccagccacctgcctttggtctagttttctttttcaagttgtgatacctctgatgggaataatttttaaatgggaaaactgtgatcaagatatacttttaagtctgaaggtcttcattattatcgaaataggtgaaagaagacgagaaaatagggctgtgcttttccttccctactttctagtcacattctagaataacagaagtcaggaaagaaggaaggcaaagcaaggaaatcaagagaaattggctgaggggctggggagggagggagaattaaaactggagggagactccagagaagatgactcttgatatatgcatatgctacccatttaatgctgtatgttgccactaacacacattgttgatttcagggttacagcctacgaaacaaactgcgtactttgttcctagatacactaattttgggactccctctctgaacacacaagaaaactcaaccactacttcaaatacctcctcacacatttatatcggttggagatttgtttagattaacagactctccaagggttaagatagtaggtcattcataccttaatgtctttttttaaaaaaaattaaaatcccagctagctgcaatggtctcagtgattcagagctttgcagtaagggaagagagcaggaggccaggggaagaggaggccagccttcccttccttcctcccaccttgactagggctgcttgatgatgcccatatggtggttggcctctgaaattcttccttctcgacaaggtctcctgaaataaaatttaggtttccaaggtgaataaggtctagtttaagtaacatgatatatggaaataaagaagcttccgattctgagaactctggttgtgaaccctagcaactccaaacacaggttgtattgatattggtgagcttcttcaactctttaagtctcagtttactaatttgtaaaaagtggatagtaacaccaacctttctcaggagggttagacatctataaaaggccagcagaatgttcttatgactcctactcacaaccatttcttttcttttctttttttgagatggagtctagctctgtcacccaggctggagggcagtggtgtgatctcagctcactgcaacctccgcctcctgggttcaagtgtttctcctgcctcagcctcctgagtaggtgggactacaggaatgagccaccatgcccaattaatttttctttttctttttctttctttctttttttttttttaagcagagatggggtttcaccataatggccaggctggtcttgaactcctgacctcagtgatctgcctgcctcagcctcccaaagtgctgggattagacatctatttcttcagagcactgcacagttatcatcagctccttagccctgggtgaagcaggcacagcacagcaaacagctgcaagaagtggatgtgattctgcatctgaaagcacagaggtgggtctggacctccaagaatggagtcacaccaaaagatgtcaaggtgctgagtaaacttctgggaagaactgctggaggagcgaactctggttattggtgattcttgaagagtgtgtcctgtttcagggtagtgaatgtgacagatctctgcagcaggcagctgccacttcatccctgctcctgaaaagtgacactcgggggatacaatctgcttccaggtgctccctggagcccggaccatgaggacctgtgactagaatagcctgcccagagctgtaaaatgtgcttattctatgagacctgcaccgaaattacctttcaggaacagagaaatattctgtgaggaagctatgcaaggtggcctcttgaggaagggggcacaagtagacatttccagtttgttcatgagttttcaaaaaagcaagctatgctccttacaggaatgagaatcttgccttgttggagaataatgagtacacagatttttgtgattgttattcaagctgccaatcctggtagctattcagtagataagtaattagtaacagttttgttggaccatgaatatcagagattcataccctttgaatagaaccttaatacagcagtaaaggtttatagctgtataaagctgtccagctggagtggaggcaacccgcaacattttccatgcaaaacccactcacatgatgcattccccaccccacctcactcccgtcggagaggcagggcaaagggagcagatgtttgcacaggaattttcccagggcttaattcaagaagctaaaacggtgagcacacctgagcaaatgaggcctggctctggcgggcagccccgggcacaagccccacatttttccaagactatgttttccgcacacagagggccatagagggtagaaaagaaaggcattttcaagcttgaaagttggaattctgtccacttgctatactgttcaactttatcagctttcatgaggggacaaagaagaaccacagtaatttttagcttgttgaattttgtggtttatttatttacatctcagagaaagacttcatctaatgctaccctcccaccccgaataaaaacggcactggacactataatgttgaaatagccactgaccttaaaagccactgtctcaggcattgccagtaacaaaattgggagttggatatttaagcaaattgtacttaataaaggccatatttgcctaaatagaaaaacggagatgcagtaccacctaaagtgaaaaaatgttgaaagtttcagtagattattccaatgtaaaataaaatcagcttcttcaaatatttcaacagaggtacaagtcttcatttgagaatttacatttcccataaattaatactgtcctaatgaatgtacaattttgcagacaccagttagtctgggatcttgcctatagtcgttactcaatcaatattacttgaactgaaggacaagacagcaatctgtgagaccaaaaaaaataataaagtttctacacagcaagcattttctataataggcatatctcaaactaataaggcaggaagtatatttaaaaaaatgtttttgctttaggtctaaaagattttcctttccaactataaaacagctgaaatcatgtatcctcagcccaacataatttcacgcctaatttatggaaatagaataccaaaggcctctgaaagggagagggcaggcaggagagaaaggatagtgtgacattaacacagggacctgctccgctgttgttcggcaggaggtaggcctgggcgagtctgccctacagggcggcacagtaagattccagcaaaaacatgtgttatgcggggaggagggggcgctccgctgaatgaacttactgttacctttttccccctctaacataagtcttctttttcctgatactgtctgaatttgaaacatctaatttaatccattggagggccagtcttccttttatttcctgtctgtactgaagcagtcgcctgtttcaattacgactttctccagctcctacatttcttgtgctccagctggctcaaagtgcacttccttggaaggtaaaatgcactaactgtgctgatcggagactgatagctggagagccacaatatttaatagctgcgctgataaggaggtttaaaaaaatccatttttgagcctaaacaaaaggatattatgtagctgcatgttcaattaagatctagttaaattcttttttcccattatgtggaacctcatgcaggcagccgacataactcatagtgttatggcaaatttcatcggcactgtatgtttgagaaatgtttccctcctgcttttcagttagttactgctgatttgggaccagcttggtgcaattatttcaaagaacagaaatgtgggattgatacggcattcttgcaaaaccctggctggctaaaaataagactgttttgcagtcgagaaggcaaaaaacgtctctgggctgtaaacaccagtcaatgtatttcttttctgctttatgaaaaccacaattttttttttcttttttccgtctctccttactcatagtgtagtttaattacagtttaatctctttcagcgagcagcccttgagaccttattgttcaaccacagtattatcaaggctacagctacaatttatggcaaaaggtggaggctcccctttagaaaaaccaaaatgctcccttcccgtccccaaataaataaataaataaataaatataatagttactttattacaaactcacattacaaatttttattaggctctagagatgccaggccaataattaaagaaatacctgagaggtgttgatcaacacttaccctgtttaactctgctgggtcaataaatctgcaggaaaacttttaagttaacaagattgtttgggcctctagttgctgaaaatatttggttacactgaggggaaatgaggtgggagagagtggaggagaggttcagaagtaaaaaatggactctccacttgcttggggtacaggaaatatacagtaaagagtttgctgcaactgaaggggtgaataaggtcagtaaattatttttgctgctttaagctcacaggtatgatttagtgtctctgagttttaatacacattttgaaagaagtgccaaaatcctaggggtttcaataaaagagaaggtaaaacttggctgttcaccacaagaaaacagattctaagcataaggtgactgctcaaattcaaggcgaaactttaaccattaatttgtcgttgtttttgtttttaataagatgcgctgtttcctttttgtcttcattctttaaatgctttatggtcaatttgatttgtaaattcatttgctctaaagaagcaagaacaataaaagctctctgtgcagtttgccagtcctcactgctacgtggcgagttccccttgtgcacaccagcttggttctaaagaggccgtggaagccatgcatttcccgtcagtctgaactcacggctggccagcgggcagatgcccatgtggcgcaccccggccatccctgaggctcatctccaccactggtaactgtggcgtctgccacctccacttctcctctctgcttttttcttccccactgttgggattctgggtaaaactgttggctttattgctaattttgccagtgaatcagaactgcagtgcgtgctgggcctcagcagattcactaccacagaacactcagatctcctatgtgtcatgaattgtatatgctttcatttaaaattatagaacttcattatacattaactttatagaaagaagccagcaaacagaaaattctaaaaatttattaaaaactcacttcgaatccttatcaataggttttttttttacatggcagaaatgtgtttattctattttgtgattttctaaaattctttaacatcatacgctcattttcaatggcagctgaactatattacccttaatattttttaggctaaagtcatctctgccaaactttaaggcatagaacactaagctctcaatggaatgtatttccaagggcttcaaaagaattaatgccttcgttcgaggaaaaaccttggtctctaagtatcctgtagccaaccttctaaagaagttgagtggctttctatttcaaaaagaaatgaagacagctatcttaccatctataacagagtgtgaactttcccacctgctttatttcatttttggagctgatgggtctctcttcagtaacacagaactcatatctctgtctttatattgttagatttctataaggtaaattattagtttagttctttgagatggttcaatgctaagttgttggatttttattaaatattaatataagaaggggtctgacatttatgctttatttttcctggtagttatatatgcactacagtattacaagatacactgtttcttttctgaccaggaggaacatatcttactaaaaagtgtattttgatgtattgacagtcccccacatacatgccactgtacagagttatatggtattctgctgtactgctctaacatgtttaccataagcattctaacagtacagggcagcagttcccaaagtatggtccaggcacctctggaggtctctaagatgctttcgtttggtcttcaagggcaaaaccatttttatgataatactagaaccatacttctttggcatccacattctttcaccgatatacaggagatactgaagcagttaagagaactcaactgtcttctgttaatgcagacattaatgagatttttttaaattttgaaacaatgccactttactaatatttttgtctgggaaaatacagttatttttcataaaaatatttatcacgttatttttaaatgaataaatatcctttaaatgttgcagttttatctcctactatggttgatagatataacccacataagcaaaagtgcttttggaccctcagcatttttaagactgtcaagaggagttctgagacaaaaacagttggagaaactctggtataaggtatttaggttgtttccaattttatgctccttcattatgaaacttcaatttatatgaaaatgtagatatatgtaattgtggtaagtatataaaaatatatgtgggttctgggcttgctggtatgagacagtagtcccagctactcaggaggctgaggcaggaagatcttgtgagccaaggagtttgagtccagcctgggcaacatagtgagaccctgtctctaaaaaaggaaacaaaggaaagaaaaaaagctttaaaaaggtatctgggtaatcaacttttctctccaagtccaatttagtccctcatacattggaggaaggagttagtcattcaaaaattaaaacaggtcctagtatttgcttatcataggctaacgtactgaatactactaaaggttcttataaattgaaaactcggttttggattagagaggcagattcctttagattagggtttatgctgtcaatgtaattcaaatcaaagaaagactgaatttcaggatgggtgctctatcaactgtcaaaagagacctcgagcacatgggaacacacacacacacacacacacacacacacacaggcacgcacatgcatacacacaaatccttaatgagacccgagtctgtaggctcttttgtaactgaacaaatcggggcttaaacattgtttccactctgtccattttgttatttgacaccaaaaccgtctgttattacagctattaatagttggcagtgacatataatagatttgaatttgtctaggttagaatttaggattcttacatatcaaaatgagaaagaggctctgttgatattttcacatactgatactagcattgaatcacagggttttatttaagccatggttacctttcaaaaatagaaccgtaaatatctctcaacttcaggaaccaactaatggttcttcctctgagttgacagccactgctcagtctgtatatgtatgtcatcaggtttaggataaagaaatctcatcattcaaccactccagccttgtgaattatggatagattctgtcttcgtgctataaatataatatgcatatttgtcttaatttagaccagaaaaatctcaatacggggagaggagtggaagcagtttttatgctttgaaaaagcattttcagaattataattttttttttgagacagggtcttgctgtgttgtccaggctggagtgcggtgtggcaatcagggctcaccgcagcctcaacttcctgggctcaagtgagccttctgtcttagccccctgagaagcaggactacaagtctgtaccaccatgcctggcaaatttttacattttttgtaaagacgaggtcttgctatattgtccaggctggtctcgaactcctgggctcaggcaatcctcccaccttggcctcccaaagtgttgggattatactgcactcagcctaattgttttgttttagtcacaatatttagtttaaaaattcaaagaacatattagaggcagtgagatttactgatagggatcccatgcttaagctgacggattgttactctcatacaatcctgtccctgtttcaatcttaatcaaggggtagacccatggactgtgaaccccatgagggcagaaactgtgtccatttttcacccttgttttgacaatacctataccataaactcattagaattcattaggatagtttttataaatgtatctattattctaatttttaactgaatgacaccatcaaagccattcagtggggccaagggaggtgttttcagtaagattccagagcaactggatgtccatgtggaaagtaattaatctccatccctatctcacatcacacacaaaattagttagcagtggatcatagaggtaaatgtgaaagccacaactatggagcttctcaaagaaacacagaatatcttcataatcataaggattaaggcaaatatttcttaaaggcacaaaaatcactaaccatgaaaaaaattataaactggacttcatgacagataaaaactgctcatcaaaagagagcattaaggaagcgaaaaggaaagccacagattcggagaaatatttacaatggacataactagcagaggacttcatttctagactatataaataactagaaattcataaggaaaagccatttcccactgtattatgtaatttgcagtacgcttttctgcctccctgattaaactgataacttcttgtcatgtatttgatcaactgtgtgttcacagttcctaaggtgagtcaggtaccaggaacaaggaacatgcttgaatgaatgaacaagttgctgccgtgctgttggtttgatcctatttctcagggcaaatgatgactgttagttggaaaattgggggctcttagcttttccttatgatgaggcttggctaagttaaaggtagtcctgaaggtcacgtaactagtttcatttccttctaatctcatttttattattgccacttctaccacacatactgaagtcttacttgtccacctcttgctaaacagagacatgaggcaatggctacggtgcggttaaatgaatgacttgtagagcagagagctagctgaacatctagaacttactttcaaaagaaatggaattttcttattgatcactatttagagcttgaatttagatccggcttcctgacagtgtttcatacagtttagtacagaactgaatttctctaatcctaggtgccaggtacatacatacaatggttacatcaaaggagataaatttcaagttttaaaatattaaaaaattaatattgcctaatgttgccatttagaaaaagatcaacttatcttgagaatttcaagattttcctttcctccaaacatattaaaagataatagctagaattccattacttactaaactgaacccaacattacaaaatactactgatataaatgagtaattttttaaaaaaaatcctaagcttgctcactcagacttctttgcactagtgcatgctctctctgtgtgtgtgtgtgtgtgtgtgtacacctatacacatccattatttacctatctctgtgtctatatttaatggaattaaacacaattagtatttaaggaaattttaggtccttatctttttctttctcaaagatgattttatatcaatactttccatgaacacatctggtgtttctttatagcctggatttactaaatgtcatatctaatgaaagagggatttatgttttttcaacataaattcattttattttctccaggctcctccctcactactcaaagttgatgacttcttaaaccaaaatggttggtcagaatccaatcaagaatataaaggcaactgaataaataaaaccatgaagtaagtgtaaaatactagtgtccagacatctgagatgtatgtggctactatgaaacttccacagctgtaccggccgggagctcacgtggttccccaggtttaacagaacccattaccagtaagagttttatttgcttaataaattacattctaaagcacaatagcctaggctcatagctgtaaaattgccaaatattgtcaatgaccactctctggtcataaataacaaaataatcttgtgactcattggatttttgattcccaaggcgattctttctcgccattactcaaaaatgtgaaaaagtgcctctacgtggcattttatggaggatataaattactcaaaggagatgacataggacagatttgtaggccgagtaacaggaaccagccaaccaactgtgtaaattaaagaactagtgacaaagaagagggctagtgaaagaattctgaaatcctaagaacagatcaggattaagatcctgaaaagacaatcttggtataaaagaaaagagaatcttttctcttttcaggggaatggagggagagtgatgcaacaaccacgcatggaatatttacggtaaccggagggtgatacgttacaatacaactcaggttcactttgaaatatattttatatttatagtcttatttgcacatatcaaagggtagacactggtatcaagtgtcacagagataaacattggagggttatttttaataaccaatattaattcttaaatgtggttaacagttccttcggttacgcagctcaactacactgagcagttgctatgtggtagcccctgagccgggggtggggtattgaaattaataaggcacagccctgccctcccctagaggagctcacattccagaggagagggagctggctaactgcgtatgtcactgtgtgctgtcacagagcagccccaggtgtgggatggggcacaccagagggagggaactcagctggataggtgggcaggacaagtgggaggaataggcagggggcagaggagaagtttatttatttttatttttttgagatggagtcttgctccgtcacccaggctggagtgcagtgactcactgcaacctccatctcctgggttcaaatgattctcctgccttggcctcctgagtagatgggactacaggtgtgtgccaccacacctggctaatttttgtatttttagtagagacagggtttcactgtgttggccaggctggtctcgaactcttgacctcaggtgatccacctgcctcggcctcccagagtgctagggttacaggcgtgagccaccacacctggctgaaaggagcagttttatggcagggggagcagggtatgtgaaagaggcgtgaagagcctgatctgccagggaacagacagggaggaggggaagagggaaggttggcaggggtcaaaattactaagggtttcctcagccaaaggagatgactggacataaccttgcagacaagcaggccaatggcgagatcagattggcatttagaacgattattcctttatcactgtggctaatttcattagaacaccatttaatgatcaaagttaggcattttggcttttaaacagaacaataatggaaactaaaaacatacctttgtggcaattatgtatccttgtggcattttctgtggaaacgggaagtatctcacaatgatacttaggcatgagcttgtcttttctcctagttttttttttccctctcccagtattgctgtaaagtggtttgtaattgttttaggaagattctgacaacatgaaacagaatcttgatgagagctggtcctgtgtttagaggaaagacttttacagtcttcttttggttttctgattacttcactgaccacaagacaatgctgtgctgagtaaacgctcatatatttctgaagttgaaatgataaaataattatttaagatctttcacccttgtcaaaaagaaatatgtccttttccataaaagtcatctaagaacatactcttgcgatcttttctaatattcagtatgatgccatgaagtttgaactgccatgaatagacatttggacaaacaagtcatggaagccttatcagctgagttttattaatgtctagttataattctccagtatttttcacagagtaggtgattaaaaacaccttcaataaatgaaataaatgagtactgcttttaactggagtagattatttcattttattgtatctttaagacacaaaatcttatttgtacaataattaaaatatttagactagtcaagcttttttttttttttttttcaactgaagcccttcacaatgctttctggagacttacgggaaagaggtgtcttgcttcctgttacaacaagcatttgaaacatctacaggcacaaccttcgtgcctcactgaaagatgcaaatactgctcatcctccactgccactgcacacagtaggcactccacgtttaatgacagtgatgtactggttttctattcctattttgctatctgcaattctttgagtaagtttgatggtccattacagtacaatgtccacagaattctcttgggctatctaacacaaatccactagaaattaagtacctaattttaaaaagctctgttttcatattagaatcaaaagctctgatattcatttaaccaatgttcattgtacacctactatgttccaggtacactgctggaaatatacaaatgatacctttctactgtccgaggaatcatagtcaagtaggggaagagatctacaattaagatctaataaatgctaaatacagatctgcactagtgctatagaagtaccgcagagagaggaattcgttttgaatggtgtaaaaggtagattggcgcaaaactcacagaggcaacattttagaggaggaccttatagaacgaggaggagctcacaagccagggagaggctgtgtagtccaggcagagtaaacaggaccagcaaagtacacaggactccgagcacagagcaagttaaagaaaggcccaggaccctggtgactgatgtgaagagagcgtgagaagggggatttcagtccataaactaggaccagaggattacctactggggcctccacagtttcgctaacagtaaatttagaaaagtagagcaaaccagaggttcccagtgttggcagctgtagaatcttctaggaaactcaggaggaggatctgaggggaaaaaaagaagaaagggcagaggaaagaaaggcaagggggagagggagaggaggaagaggaagagaaggggcagcaaaggggacacagaggagaagccacaaaaggaagggagcaggtcagagacaccagaacaggaggaggacaactcgattccagttcccaaaccccccaccgactgattcaggatctgcaaaccaggggctgaggaagctgcagttattatgcaaccaggtttgagatttgttagtgtaaattctcagtctcattgaagaggaggtagatggttttttcatctgtttttgaaaagaaaacaaaaggctcagtttgatgtagatttcttagacttcagtacaaaaagaatgtatactgggaacagaaatttatttttgttagtgcttttattgctttatcttttttattattctctaggtgcttctaaaataagttattaagccaagcatggtggctcatgcctgtaatcccagaacttcgggagaccaaggcaggaggactgcttgaggcggtcgagaccagctgggctaacacagcaaaaccccatctctaccaaaaaaattttttttaattagctgggtctggtggtgtatgagcacagtcccagctactcaggaggctgaggcgggaagatgacttgagcctaggagttcaaggctacaggaagctgtgaatgtgccgccgcactgaagcctgtgtgacagagcaagactctgtctcttaaaaaaaaaaaaaaaaaaaaaaaaaccttaattaaaaaaattgaaataaaattagatattaagaatcaatatgttttcaagaatcttgggaaagaataagaattatttttttctaagctaatcactttaaagcgttcgttagatgaaggttcagaagagaaacccagcgctcaatgcctaagtgaggttattttagaaactgctactcctgagccattcctatcttcacctgacttgagaaaaagaaataactttttgaggcttcttttatcatttgaaaactttacatgatgtcccaggagacagaaagaatcataaaattcctaaagtgatgccttgagagtaattagttctagatagctaataatggatggttgagaaaacagagagagctccagaggtttaaataagagcatctttccaaagattacagcatccccatgcgacacgtaaggtcttcaagtaagagggtaggagcgatccactgacttttcctctagtaataaagcctttactgatttgtgctcatgtattattttttttaattccttttagatttttattagtatgagtcaactaaatacagaattatccatcttattgtcttataattggaaactgaaatattagggggaaaatcagagaatagattccatgcattgcttaacataaacagtaatattcgggcttatataaagacatatagagcctgaattgtaaaatctaattgcttcatgtgagtaaattttgaaaactgacattatgagagctgtgctgtactttcaaaatgaagttcagtgttctaagggaacctggagcctatttgtgatttgtgtttccactttcatttcagcagattctgacatgttgataagaaaaactaagattgaccacataattttaaaccaaatcagaatgtcagttctagcataagagtctgattaaatgcaatgtggctacaagaaggtttttagttagcaaaactgggaggctttcattctccttagctgtaggagtgcctgtaccagagacaggcaccttctccactacaggaagaagcatcccacactcaaaggaccacggctagaacagctttttgttttctttcttttctaaaagaggtgtgcattttgggactataaagactactggaacattctgataagtcttacaatgttttcaacactattactcaagataagggcacccagaaaaaaaaaacgcagctgcctttggaaccctcaggaccacccacactgtatgttctaagtttggggctgtgccacatgaggcaagagagcacgttaaacacgtgtgggatattatgaagacctgagcaacttcatgttcatagttttaaggaactctaaagtaaaagatacagatttaatctgaaggtattttgtgtttttatgaagaaatatcacatggatgtaatatatatatttgactgataacttaaaaattatattcatatttaattatactaaatctttagatgccatatgtgtacgtaaatatatatatattcaaaattcatttatatgaagcaatcctgttttataattcagtctctaaacctctttatataaaacaaattaaacaactggcatttatttcatgattctgtaacatttcctgatatttcagtttccaattaaaaatgatagtaggaacagttctgtatttaattgacttgtactaaggaaagaaaggtgtctatttcaaatcaaatatggaaaacaaaataggtcacatttgtggacaacaggcatgcaataaagtatcataaattctaagacaaaacacataatcatgttataaaacacccctctttaagatgaaataaattctgctgtgggttaatctcccacgtacatagtacatctttttcacatagaaagctggggctccactctgtgttcaaatacttcagatcatttcagattttgtcacccaatgcatgtattgtctgcaataaaaatgcaattcatctaccgaaaaaaattcagcaattcaccttaggcaggcttagagtctcaattagccatataagtaaaaaatttaccccaagttattatatgcaaatgtatataataagggatattttcacaaagtattatataacttctgtacttctggagaaaaatagttacagcagaaaatttcagtgccttcatttttactgctaagttctaaacgaaggctacatgtggtctcaaccttattgatcccactgaatagatccctagacctgcgcaacagccttatatggaattaaaaggggaccttccacttggtgaatatggccatggaataatccatttatgtgaaaaccaaacgaaaaacagtctaaatttttgttttctcctttgtgatgggccacatgcttttttcaaacatcttttattaaaaataatctataaggttgttcaagtgagattttaaacataaacccactcccactcacaaggcaaaagatgagacttccaatccctttctttttgctttcttttttaaatgaaaaggaacacaagaagaaggccaagacacattctacagagagcgtgctgtcgttagctcagctgtttttgatgaccctctgcctgttttacaccttatcctgatgtcaattcttgttttcactcttccagatttctttcacaagaaaacagctgacagaatgttgcaaaataaagaggaaaaggaagaacttcagctgggaatagaaagtcttcatccatgacaccaaatccatttccccacctctgacacactatggttgctaacattcccggctctctgcaaggggaagtaaacgagcacgcatgctcactgccccaccagtgagggcgctgagccaagttgggggcttgctctcctgccttgatctgaccctgaaggtggtgggatagggtaggcggtagagggtgggagaagaagtgaccattcattcgcctatctattcactcggtatttatgagagcctactgtgtgcttggcaacatcccaggtggtatttatggaagatctgccatgtgctagcaggttttaattatctcatctttgtaccaccttagagaaataatatttttatgactgccagataaggaaatggattcagagagcttatttaggagtcttaaatcacataaaacgactgatttatgactggattccaattttgtctcattccaaagctcaggtgttcactgatgactgtatcatggggacccaacaaaataccaccattaattcgatttattcatatacagtggcagcactcccttctaaaatacggatattatccaaagaggtaatatggaagacagtactgggaattctcagtatactgtaaacgattttgctttgttttctgttttttataactcatataaaagtaatatattctcattgtcattaatcaaagaacacagaagtgcacagaattaacaggtttctccaccttttcaaccaattaatgaacatgtaaagtttagtgtatttcttttcatacttctatctctgctcacaaactgcaacaaacaaatacagatttgtttttctccttcttcttctttttttaaagtggtggaggtctttctttttgtctgctgaccataaggcacaggtggggataggagtttcaatggaaggggggtggtagagtttggaagactaggaaaactgccagagaaaagcaggtctgggtggggttgtcacagagtttaacatttcatcgagaaaatatttttttccttaattctaaagcagtatctaaaaaaatttgtcattagtaaattagcagtgtccatacctaagaaaagcggcatgactagatagaagctggtatttatacatatatatttaatacattgctcctttacacacacacacacacacactcacataacacacatacaagatgctactgatagattgcaatctagaacatgccttcctgttctaatacaaatgggtctgcattttcttttaacttggcaaggttgaaaaacagactcgtcataagtgtgtaatgtcttgaaccaaaatagacttccttaatgatttgttttctccaatttcaccacaaaatgtaatgcagccaacaaaagaactattcttccccccacgtataataacatgttattcaacaatcatgtaagaaagcctatacataagactgccaaggttctgaaattgagtttctaactgaaatgtttggaaagaaatcttttcttttttaagttttactccgagggtttgagtgaagtgatataaatatctaggaatatacagttttgctttactactataacatgcttacagaagtagttatggtttactttataacatgggtcactgaaaacattaaccataaaaacatataaaagtacaaacaagttctcagtagaccatttactctgtagcagaacaaacaatttaattgcttctgtccttgtgagggcaatagctccagatgaagctgggtcaggagcaccccttggtttgtggggagtctacaatctgcatgctattcacgtgacctgactctctcaatacttcaagggtctgcaccctaggacggaggtaaaagcctggttaacagcaggaaaagcaacccattcccagtacggtaaggaagattataacagaatgatcaactatttttctttttctttctttttttaatggagaactgcaaaggaaagaaaaattgtaatggtgcaaaaagctaaaaagggggaaaaagtgaatccactttttacttttctgaaatacagagcttgccttaaaagtatgccccataatcactagcccacctgaaaactatagaaagtacagaagactgaactatgcaaatacataatctgaatgcacattaatgcatgatgcatatttatggtatgacgacaggtataaatattaccaaaaatgaatatatctcctgtatctgttaaatttctgggaaataaccaggtcaactaaaatgtgttagccaagataagacatagttaatgcatttttaaaaattagattatcaaaacacgtttttctaacgagtgaaagttaagtttttctaaataaaagttttctcctttggctgggtgcagtggctcatgcctgtaatcccagcactttgggaggccgaggcgggtggatcacctgaggtcaggagttcaagaccatcctggccaacatggtgaaaccctgtctctattgaaaatacaaaaattagccaggcgtggtggcaggtacctgtaatcccagctactcgggaggctgaggcaggagaatcacttgaacccaggaggcggaggttacagtgagccgagatcgtgccattccactctagcctgggggacaagagtgagacttcatctcaaaaaaaaaaaaaaaaaaagtgagcaaggggagaagaaaggctaactatctggtgggaaaaacactagtacaagcacatctatatgtatgtatgtacatatatacacatgcatatatatatacatatatacatacatgtaataaatatacatagaccctggatcatcaaaaaagtggttgattttgtatttctgatttaggtggggatcccaggtttaaactccaggtccactatttatcacttatgtggccttttgttacttcgcttctctttgtctcaaactagagataataccactcaccttaattctaaagcatatctaaaaaatttatcattagtaaattagcagtggtcatacctaaggaaagccgcatgactagatagaagctggtatttacacatatatatttaacacactgctccttcacacacacacatacacacactctcacacatacactcacatacaagatgctactgacagactgcaatctagaacatgccttcctattctaatacaaatgagtctacattttcttttaacttggcaaggttgaaaaacagactcatcatagtaacttagcagtggccacacctaagaaaagcggcatgactacacagaagctggtatttacacatatatatttacatactcagagaaataaaaagttaatgcaggtaaggcccaagtgttataccctgcaattactaagtggtttattttaataaactcaaatgtttttattcgacggattcattattttctgtgaaaagcactgagttgtaccttggtgtatcagaaaagtcacatggaaaagctcttctctttgaaagatatttctttatatccacttaaaaatctaccttgggcctgggtgcggtggctcctgcctgtaatcccagcactttgggaggctgaggtgggtggatcacttgaggtcagaagtttgagaccagcctggccaacatggtgaaaccctgtctctactaaaaatacaaaaattagccaggcgtgggggcaggcgcctgtcatcccagctacttgaaagggagaggcaggagaattgcttgaacccaggaggcagaagttgcagtgagctgagatcatgccactgcactccagcctaggcaataaagtgagactctgcctcaaaaaaaaaaaaaaaaatatatatatatatatatatatctaccttgggttatgtttctcatagagatagaatatgacaagtagacattttaggagtaatgtttgtctccttgcttcactgtaatgataaaatcattaaagaaaataaaatagtatgatacagattaggaatcctcatgctaagcagaaagtattacattaattttgagtgtttatcttggtacactctacacaataactacatatatcacacaaacatttctgtctggtactaatataaaaagctctctgaaaacaattattttatgatattgtacattttctagtttttcttatagtttataaatacatatttctgacttagcattaatgaaatgaaacctaaaatcttgaaaacatttaatataaattataaataggggaaaagtacttagggtagttagctgctactcatgtgttactgaaagaagaggcatgaattttattatgaaaaaataaaatgtggataaagaatgctttggtagtaaaaacatacacacaaaaagcactggatttcacaatcaaagtccaatgagaattttccccctttggcagtcaaacaaaaattccaggaaaatagtttaaattcccttcacaaagttcaaatgtagctattggttattaacttgcaaatataagaaataacatttcggtctgggtatctgactaatggttatttatggaccctataaaatttagaataacttttgcatttaatatatctcacatgaaattactgtttcagtagtccaaaatctgtttactgcaattccatacagatgaattataattctaaatagaatcctcaaattctgtttacgttttaatgtaaacacttcacctacaggaataagcagcactcattatttctttagagacaagaatattgtagagagctaacaactcacttttgaactgagtaagttcactgaatttccaaaattctaataagcactatagtttacatagtgctttataactgcaagcctgctgctttttaaacaatgatgcattcccctaaattcatattttaaaaatatgaattatcagttgagatttctctgcctacaacatagaaatctctgctcctggccactgggtggtcctgcacgcatgggcatggggctctagcccaggcctgcctgtcactaacttctctatggcctcagagaagtcacagggccaatgttttctaaacacatgtatatttttaagttatggaacatgcttacaaaatgccacctcattgtgtcttgtatacatggactctatatatggatgcatatactgcaaccaattatagctatcccagagtgaaaggatattttgagagaagcaattattacagcaaatgagacaggaaacatccttttccattgctcaagaaacacagatatttgtttcttgtctctcggcaaaaatggaaaaactctcttgcatttcggaagtgagtgggtctcccggaggttctgagaagggtctatgctaagtaatcctaaactgagcaaaccctcccagctccttttgagcggagaggctgaattcaacactgccaggggagccgcggctggtgggtggggacggggggcagctcgctgtcgtgggctttagggagcaaactctgccaagctgggatgggcgaggataaggagggaaagacggacagttctttggtaataaaaatgcagtttatataaactgtaggagacctggtgagaaagtaaaagaggtaattgtgcacattccaaacgttttaatatataaactgtgtaaccatcactcatgaatagcgcagctgctaacaatttatttgtttttttttttttttttttttttttttaccaagataaaaatcatgctaaagccaagagatgtttctctagtgaatgatattttgaaactctggtcaaaacataactgtgacataataaatttttaaagaagtcatgaaagcttgtagtttgaaatttgaaagaagacctagttttttccccaattaggaaggaccacatttcaactttcatgacagtggcgggctcagtcttgcggcgggggaggggacgccaattctgcatgcacatctgtttccagtgcaatgctggtatgcaaactattgtctattggaagtgtgtcgtggtaacgtttgccagggttaaaggctgggtcaatttgatcaagacgctaaaattagcttctgtgtgttttcctgaaaagaaaaaaaaatactgtaaagctctttgttttccttcaagtaccattctcagatttcagtttctggtgtgtaaactaccaggaaacagacggctatgacaactgacttcttgttcactgagtcctgcataatgaaatggtaccacacgtcaccaagctggagaactcagggtgaaaggtagctttctgacccaactcacattttcccatttaaaaaatatcaacattataaaattacttaatgtgaatgcatttggaaattcaaaaccatagctatattttaaagtgtgtgatggcttggcaaagcccaaacacatttagaaactcatcattctgagaagtattggggtaagatttaggtcacatatccctggtagtattgacagtgctctgattattttcacaggaagtgagtttgttaggatgaaaaagagggaaaaaaatacatatacaaactccggtaataatctgacgaattccaagagtagaaaggaatcgtggaaacaatacatagtcatgagatagttcaagaaaaatattgatatttttctagattagcaaaattagaaaattacttaacagttaatattccaatagatgacaaagatgaaaaaaggagaaatagaattatctgttaatgtttaaggctttgtgatgaatatacaaataaaccaaaagtagaagcatgtttgaaatttatttacatacttggagacttgctttttcttatatgagatgctaagtcaggttacaataatatagaagtaaaaacttcagtgaaatgcctcgcctatattttaaatatttcaatactgttaactttaaaatgacctataatgtaaaaagtactttttgtgtacattttactataaatatttccgattaagagaagtctgacagaagaaataaacaggttttccccaaattacaaaatgcaatagaaaaatccttcaatctagttacagtatggtgaaaatactataaatttgggtcatttataccacaggatttccttctttgcaaacatcctctcaattccagtggctttttgtacttttataatttagagctcattaaaaagatttggtatggatactagaagtgtgtaaaatatttggcaaaactcatttgtaaaatgaaacttatttgtacaacatacataaaattacccaatttttatatttaaatgccctctagagccaaacacagcatggtagttactactaattgcttattttcttgggtcagaaattagtgaaaaattactatatatcgtgacaccaaattaataagattccgtattatctctaatttctcacaaccagctcttcttcagtttaaaatctgacctcttttctcaaagttatttgtaaaaatgggaaggataatattgaactgcaataactcatcaagtctaaagtttttcagtcatgatcttcccaattgtatgttcttacacagctgagcacagccttctggtggaaagaccctgggctcctaggacactacaaatggcaggttcatcttcttcctcctgcatgtgtcctgaggattcctaccccccaccactgcccacatgccctttctggcacctgaagtttagcatttcctaaggttgtgaccttacctcccccttcttttccttttacatactgttttccagtaaatttacccactaatatatatggcttcaaatatctatgtttttagcctaagcattgttaagctaggcacagagggtctatggagggagtttgaatattcattagactcctgatactatgttagaatatatgcataaatagatgcattttttgttgttgttgagaatccaaaatggtcatggaaagctgtccatgactcaaaaagaaaagaaaacccaacctcaccaccacttgctacaccagaatggctccagcagcctaactgagcaccttcactggggtattcccagcatactagtacttcacactcaggctgttctcatgacgggcctcctcctaagaacatcccttctcctgtgtctcctgtgtgcttatgctattaccaccctaccatccctgagactctcctttctccctcatccagcaactccaactagtgcaagcctgaggcttctcttctcatctgtttccaccaccatccctttagcccgggacccttgaagtatactatgtgattgagttgccttataaccttctcctcatccagggtggccagtgttgcaccattccaggggctgcaattcttgtcacattctctgcaaatgcaacatatctccatgcaacgtgacggaaactccaaggctgtgtgcacaaccagtgaattcaggtgtgcacttctacactttctacaacatcattctcacttccctgtacagcctatttcaactataccgccgcgccccgccccccatacaaaattaactattcacattccctgaatacgtccacactttttttgtctttgtgtcacaacgcctgctgatctgtgttttggaaaaatatcaccaaatgcccacctctcacaatgcctggtggtctgtcttctgttggtctctcccatgaagttttcagtagggcagagtgtaagcatgtgggtatcagatgaggatccaaaccccagctccactaacatgaactactcaagtagtcttttgtaaactacttgaactctccacacctagggcctccttttaaagcagggacaaaatttaacagttaggatgtgaggattaaatgaaatataatgcctattaagtacctggtactttttaagtgctcaatattttttagctgttattttaatatcctcactcccagtaacgatttcattctcctgtatcctctgctttggactgtggtaccatacgtttgttgttttcctgcctcccaaatatgattttagaagtcaggggcatgcactatcatatttaaatcacctcgggcacccagcacggtgccttacacatagtaggtgcttactaaatatgtggttatttttctgaagtcactctctcttgggccagaatttactggaggtcaaggaggcaaaagggtggaagaactacagagatgttagatccttcacttgcagataaatcgcattacgaaagtcagtcaccatttcagagttgcacacaggacacaatgcctagtgggtatttacatgtgccaaagcaacgcattggctgagaagatcgctgatgacgtttaacttgtatagcatccttcaaaacatcatgactcttgggagaacatgttcattggatacagaaaacataaaaattctacaaagcatatattttcttacctcttaaaaatggaccaaaccaaatgcattacaaaacctcaggtttacaaaatagcagacaaataaattaaacactggcataattgagctatggtgaataaatactgccagtctaatttgaggaactagtttgaacacagtcatgcatcatttaacgacagaaacacattctgagaaatgtgtccttaggtgattttgttgggcccaaatcacacagtgcacttacacaaacccacatagtagagtctactatacaactaggccatatagtatagcctattgctcctatactacaaatctgtatactcatttaagcaactataacatggtgataattatttgtgtttctaaacatttcgaaacagttttactgtgcagtaaaatatagcataaaagatagaaaatggctgggtgccatggctcatgcctgtaatcccagcactttgggaggccaaggcaggcagatcacttgaggctagctaggagtttcagaccagccgcctggcagacatggcgaaaccccatctctactaaaaacacaaaaattagccaggcgtggtggcatgcacatgtaatcccagctacttgggtggctgaggcacgaggatcacttgaacctaggagggggaggtggcagtgagcggagatcacaccactgtactccagcctgggcgacagattgaggctctctctcaaaaaaataaaaagatagaaaatggtacacatgtacaggcactcaccatgaaggaagcctgcagcactggaagttgctctgggtgagtgagtgagtgagaggtgagtcaatatgaaggcctaggacatgactgcacactactgtagaatttgtaaacactgtacacttaggctaaaggaaatttaaaaataaggtaattgtgctatgatgtttggatggctaccacgtcactacatgattaaacaattttcaagtccattataatcttctggtatcaacactgtatatgtggtctgccgctgaccgaaacgtcattatgtggtgcacgactatatctttagtaagaggatcttggaatatttctaagtagagagcatatgagatccaaatttacaaatagacataaaatttattttagcaaattgttttcatgcaaaaggaggttctaaaattattttaagtgcttaaaagtttgttgtaggtgtgcattatttggaccttgtctaaaccattaatatgctaaacaaatcctttctgcagatattgtcaatatagttataaactccaaattaatgaggcaagttaaaatagcctgactttaattacacataatacctgattgcattttcaattctgaggttttatcaagaatgtcctgaggccctatataagtttcaaattgttatctgaaatcatttcattttagaagcccagtatgtacaaaatgaagtttgtagagctattgtttattataatttaacaaatatctggctgggtgtggtggctcatgcctgtaataccagtgtttagagaggctgaggtgggaggatcacttgaggccaggagtttgagagtagtctgtgcagcatagtgacactctctaaaaaaaaaggtttctttaattagccaggcacagtggcatgtacctgtagtcctagctacttgggaggctgaggcagaaagatcacctgagcgtaggagttcaaggttacagtgagctatgattgtggcccgcattccagcctaagcagaagagctacgctgtctcttaaaaaaatatatatgtgtgtgtgtgtgtgtgtgtgtgtgtgtgtgtgtgtgtgtgtatgtgtatccaggatatatatatatatatatgcacacacacacacacacatatccaggatatatatacatatatgtatcctggatacacactcgcttcaagggattgaatacaatgttttggaatatatatatatgtataaatacatgttttggaaaacatgtatatacacacatgttttggaaaacctgtatatacacacgttttagaaaacctgtatatacacacgttttggaaaacctgtatatacacacgttttggaaaacctgtatatacacacgttttggaaaacctgtatatacacacgttttggaaaacctgtatatacacacgttttggaaaacctgtatatacacacgttttggaaaacctgtatatacacacgttttggaaaagtcctaaggtagattccttagctttaacgttttacataagctttagtaaaagataaggctttgatatcattatttcaacttccactggctgaagcagcttccaagggattcaaaagaattgcacatattttttttggctattcaaaacagctgcatagatgaggggatttaggaagccaccatgcatagccagggtgaaatgcagactcagaaaagacctcacaagatcttaagatttcaatttgggatgatccctggcacagacacaccctacaacagttagaaaacccacaggaaatgctagggaagggaaagaactggatttccaaagttaccacattctaagattcaaatgtccaggtttcaacaacaatggaaaaataagacatagaaaggaaaaggaaagtacagagcattcaaaggaacaaaataaaatgacataaaacatacctgaggaagcctaaactttggacttaccagataaataactatctttaaggtaatcaaagatctagggtaagtcatggacaaagacaggaaaacaatgtatgaacaaaatgagaataacaacaaaaagagaaattttaaaaaagaaaccaaaagaaattctggagctggaaagtataataagtaaaatggaaaatacaatagagggggctcaaaagcaaatttaagcaagcagaagaattagtaaatttgaaggtcaaattactgagtttgagaaacagaaagaagaatgaatgaaaatgaatgaaaaaaagtgaacagcgcctaaggaactcaagggacaccatcaagcagaccaacataatctgcaggagtcacagaagaagcagagagaagaaggggccagaaagtgtatttgaagaagtaatggttgataacttcccaaatttgatgaaaaacatgactctacaaatccaagaagctcaccaaacaagtaagataaactcaaagagaactatcctgagacatattcaaattgtcaaaagccaaaggtaaagatggaatcttaaaagcagcaaaacagtaacaattcatcacatataagggatcttcaatatgattatcagccattttctcatatgatatcttggaggtaagaaggcccagtggctgatatattcaaagtgctaaaacaaaaacaatgttaaccaagaattctatatttagcaaaactgtcccatgaaacaaggcagaaaataagacattcccagataagctaagaaagttcattaccactatacctctcctacaagaaacaccaaagtgagtctttcagcttgaaattttaaaaatgtagcatagttgacccttaacatggagggttaggggtgccaaacccctgcactgtaaaaaaattacatataatgtttgactcaccaaaaacttaactactaattccgactgttgactgcaagccttgctgataccaagaattgttgattaacacatattttgtatatgtgtaccatatactgtattcttacaatgaagaaagctacgggaaaaagtttcattaggaaaatcataagaaacatatatttgctattaattaagtggaagtggatcatcataaaggtcttcatccttgtcttcacattgactaggcttgagagaacaagaaaggggaggggtcggtcttgatgtctcaggagtggcagaagtggaagaaaatccatgtataagtgaacctgcacagttcaaacccatgttgttcaagggttaactgtgtatctatatttctaaatgaatatatatggatataggaagatacgtgtgtgtatctatgtatgtgaacgtgtgcgtatgtgtatataattttaaatgtttgtataaccaaataaaaaaatatattatgcataggcattttcccctaagaggttgtttatccaagttgaccctacacccaatttgttttgtttgttttgtttctgggacacagtcttgctgtatcatccaggctggagtgcactggtgtggatcacagctcactgcagacttaacattctgggctcactcaggtgatgctcctgcctcagcctgtaaagtagctgggaacacaggcacacgccaccatggctggctaatttctaaaatgttttgcagagatggggttctgccatgttggctgggctggttgtgaactcctgggctcaagcgatccaccctcctcggcctcccaaaatgcagggattacaggcgtagccaccacatctggctgcttacacctagtattttaatgaatcttcttattaggtggacggggggaatcaaatcatcatcaaatattccaagccactttatacataggcatatatggtacattttaactcttcaacacttagctcaagaatcaccctctgtgtgctatgttcttggaaagctgcctcttgcctcagcctaattcagaatcctttttctgtatgttctcataactactgtcacaagccttggttttgagttatcttacatagagctgtaatcactagttaacttatcagtctcttcttctagactgccgctgtccaatatggtagacactagtggcttttttatttaaatttaaattaatcaaaattaaattaaattaataatttagttcctcagttatactagccaaatttcaagtgctcaaaatctacatgtggctgttggctatcatgtgggacattgcagatatagaacattcccataagcagataaaattctattcactaaaactactctagatcaggatttcccaacctaggcactactgacattttgtgacaaataattctttgttgtggagtctgtcttatgcattttaagatgcttagcaacttctacccactaggtatcaagaccattcccccagtagcgacaaccaaaatgtctccacacattgccctggattgagaaccactgttctagactctaaacatcttaaggagagggagtatgtgtattcagctttgtattacatataaccaaccacagaggatatagtacaggggttcaatgtatgttaagaaataaagacaagaagatgagacagaagcaagccctaagcagtgagtggttttccactctaacaaaggtacaacacttctctagtttttttaagccaacaataactacagcaataaatgatgtagttgcttttgcctagaatgtaagcgaatgataaactatatctggcacctgttcagaaatctatgtgatagttattatcaacaagatattaaattatctgaaatttatataaaattgaatcctccacactatacactatagtatacacactatactataaggcatttcagggataagaaatatatataactcttagaacctcttcgagaatatgcctgttttgtagaccgatatgtgaaaatgtacccaaacacttcagaaaatgtagtccttccattcatgtctaggaaactatttgcccaaagcattataatttttaaatggttcttcaaaagtaatgcacataaacatgattatcttgtttgctatatttggccaatgcagatacaggttcaatattcccaaatcagaatgatccagcagagttattctggtaaggccatttgtaaattgtttcctgattggctacaaaggcattactgccattataggattaaagtaagtcaatggctttcttccctctaaatcattccgctggttacactggcctcctggacgttaggtcaaagccctcccatcctgaaactaaaggagaattcagtggctgtgtcccatctgccatgtgtgacaagtgatataagcaagaatgcctgtactctggatctgccacttaccaatgtgccatttctcagtttctttagtaaaacgaggagtccagataatcattccttaagggaagcgtgaagggaaaatctctatgaactgcaaaacactaaacagatgccaattttaagtattttaggtaaggttataaagtttttagcaaagggactaaagaagagcactcatcaatgagaattacaatcccagaggcagttagggaaacatgacttagtaaaataaaaataaacactgtaggatgccatgtcactcaggcgatagaagaaagttttttattccagctttctgaggattcatccgaacacacatattcctaacctttttaggttttttataaaatcttgaaaattctttaagcacctgtagggattatttatctgaaggagctgaagcctgcttctagaggtatttgccagagcaagctagcatattgaaaaattagatgttcaatccctggtagcctagttccagcccacagtcaccatctctcaccaggtctctacacagccaatgcacaaaggccaaagaggagtttcagccacttttaccctccccataagaatttttgtaaatacataattccaaggaaatttctgtctggtcacagttggtttgtttttagaacaaaaaaccataaggtggttgataacgtcttcagaaatttaataaatatataaaaactaccatcttacgtggtttgattagcactaagtgaaggtagggtacagaattaaaatctctttagaacagtggctcatgtctataatcctagcactctgggaggccaaggtgggaggatcacttgagcaacttgctatattgcccaggctggtctcgaagttgttcaggagtttgagaccagcctgggcaatataacaagaccccatctctacaaaaaataagaaaattagccaggtgtggtgtcatgtgcctgtagtcccagctactagggaggctgagtctggaagctcctcgaacccaccaggagtttgaggttgcagtgagttatgattgagccactgcactctagcctgggggacggagtgagactctctatacccctacaaaaaaaacaatccaaaactccttagagattaatttttatttgtagcatttgactctgtgactggagtgatggcttttattttttttatgtgtgttggagagcatgtaaatgcactgacagccagtcacagcatgatcacctacttttgtgcccattacacaagcagtaacttggctgttccggactcactggatgttcaggatgaagaagtggagaagtggaaaaggacaggtaaaggtaagccagagccaaagactccttggtcttaaaaatagtccaccacatgcattgttagcttgactgcaaagctcttttcagtgagaaaagaatgaacaaagtgaggccgacacatttcagaaagcatatctgcaaactgcctataaggcaaaagcgaacttttcattttctgtctcgtaagttctgtctttgcctgccacagacctgatgagcttcagcggaaaagtcagcatgaacatgtgaagcacacgatgaactttatcaggctgcgtctctgtggccactttccagatcacatatttacccagtaaaaacattcaggccacacgaggaaggaagtcttcggctactgaagatcattagtagcactgagtgcaaccactgtcagttttgtggggttggcctctgatcactcacacaaaggacggaaaattgctggcgccgctggacctgtgcccagctcacccggcagtggagcgtatgaaagcctttttttttttttttttttttttaaactaatgcactggaagggggcaaagggtggcatggaccctcaggcacattaatcagcaggggaattggccaaatgtcgtctcccgctgggcttcaatgccaaaactacacgtgtcagtgacttccagagaaggggaggccccagaacaacactggacacatcaaatgtcctcccttccttcatatggaaagctcatctcggaggtgtcaggataaaacatgagaacagcatctgtcctcagagaccaagcagagtgattcactatttcatggcacaatgaggggaggaggacgctgtaataaaaactttataaggtgaaatctaaatcctgaatgcagcacacatttttaaaactttttttttttgccttttcttcctttcccttctcctccccttcctgagggaacataacacaaggtaattaaattgtaaattacttgagagagaaatgtttagactcatgacaagtctttgtgcagaaaacaaaacttcacaccccacacatattttggatgacctaattcttccagcgaagtttaaaactataaccaaggttgtttaaaaaaccattttcacatggaagggcagtgggttgaaagatcctcattattcaagagaagggaaatttatgaaggcagaaattaataccaaacccaaactgctcattaaacaaacaaagtaaattaagaagttgttggttaggttttctctatttctagtcaatatctaaatgagaaacatgctctccttaaaatcacaatgcatatatcgcatcaaatccatagaacaactctaatattcttactcactcaaaaatgaagacatgtatatacaaacataactgaatcacaaagtcagagcttaggttctggttaaaatttacaaaaaaattaaatagaaattattaagaattagcaccttaaaatctagtagttaaagttcaatcctggtaggttacggatttgcaggttaaaatgcttggcatgctttgaaattaaaacagatgatattaatttcatcaattatcaagaaaataaaagctattctataaggattcattaaatgtccattgaagatttaaaaatatttaaatctaaaagagattccatttaaaatgttctcagtggtgggggaaaaatgctgggctattttaaggcactaatttccatctggtagaacagatccagacctacaatgttgcatttccctgagcaattgctctgagggcctggaggttaccaaatgtcagaggcaccatgatacatcatctgtctgttggctccagttgggatccatcttttcttagcgcttgacatctatggggagagtcggcaactccctttcattaaataacaaaacacaacaaaatcctttatttacagtgcttttgtaagatttggtttaagcatcagaagtatgttaagcttttaacatacttctaagttaaatgcaagattactctgttcttaaagagaattgaagggcaatttcttattaaacaatttcctattaaacttattaaacttatataaactataacttattaaactatacaataattccagaataactcatttttaaagatcagatattgcattcatatggttaaaatctcaaaaattaatgtgacattactcgattttctccatccaggtcccgggaaccctgtttgttccgtcccccttcctgcaaccaggcaaccacaggaacagttttattacccccatccacctttttatactactttatacacactattcttgttttttcaacttaatgtctctgagggcatttcagtttcacggagaatgttcttgtactttcctacagatgcaagcaaatcacatgatagatttaccacagtttaattatttttttatttagatattaattagttctctactgatagagagggagagggaaggagggagggaatataaagtgagtgctaagtgctaacacggggcaaataacacggacgggaggggcacagagtctgtgttgcgtaagggggggtctgtcagggaagttttccttgaggacatgacattgaaactggctgaagaacaccctaaggcagccagaagaagagcacacagggacagatcactgggatagggtggaggtggcttatgctgctgcaggtcggaactcagggcagcattctacattctgtgtctctagaagagtggaaggaggcggctttgctctcctttcccaactcagctcccacaacatctcacatgctgggagatcagcagcattctttgtagggagttgttataacaaatttggtgaattcttattctgcttttacagaaaataatgtgaaacagagtttacatagaaggagatatgtcactataaaataatctttaaaaatctagtaattttcacatttaaattactaaattagatttatgtctttttaggcttgataaaccaactattttataagttcttagatctcttttgtatttctaattcaaaaaacaagtgcaggcagatgggcataaatatcatttaatttgttgattgtgaggaaccatgaataaaactgcacataataagtgcatttggagtaaaacaattctttaagatatcaatttggtaatagggcaaaaaataactgttaaatcaaggaaagaagaggccatcaatttaatgttcatgggagtcattagacatttttttcatttgctttttattttattttattttttatttattttattttattattatttttttgagacggagtctcgctatgtcgcccaggcaggagtgcagtagcgctatctgtagcgctcactgtaagctccgcctcccgggttcacaccaccggagctgtgactacaggtgcccaccaccacgcctggctaattttttggatttttagtagagacagggtttcaccatgttagccaggatggtctcgatctcctgatctcgtgatccacccgcctcagcctcccaaagtgctgggattacaggcctgagccaccgtgcctggcctcgtttgctttattttttaagtacgtttttgattcactagtatcttgtcatgcctgatagtctcttttaaagtctctttcctggtggttttgctgtgtaaatgaaagaaaaactctgagacctgaactcaaaatttgaggtatgaaagctagtagaggccaaatgaaatgctcacagatcggcatatgtatgttaccacgtcaccatcaactaagcaactgctacgctatttcactaaactgaaaaaggcatttgtgttgcctgttctaatttgtttatggttggatgtctatcatagtattttctattatgttgctagataaagacatttttagagtttcactgaatctgcaaagtgctggtgcatactttatgataaaatagctaatgtcctttcattagtataatgacatctactaactacatcagtttgcagaaaaatattcttacgaaaatagtccataaaagggagattgggtagaagcggctgatgaactggttacattaacatgtgtttcttcactgaatttcgtatggtttcccctcttcttcttataaaactctatggactctggcaaacccttcattcttttgcagccaagctctcattcaggatagaggacacctgaattacataaatctctatcacaaagttacaatttctgtgcagagcaagagctgtcaggaaaaaggtaatgaagaagaatagcttagacagagggatttaatgatatccagctgctattctttggtacttgctgataagactttgttttaagtttacaatagagaaagtttgggaaaaggctaaaaattcatatacaggaagtggaagtctttatatttcatttcagtttccgctaactcttgcaattacgttcatacaaagtttaattttcagaatgttcaaatatgtcactgtaagtctttaaaaataaaatgtaaattgcattaaaatgtgtagaaatattgtaccttagggaaaagacaaccaatttgggctcaccacatgttcagatgataagataaacctgggaaagtacaagattcttaaatgtttattataattgtatgtcatcattgtggtgatttttctgtatttacaaaagggcaggggtgggtggagggaaagttctttgccaatggaagggacatagccggttcttcaaaacatatagtaagttaacataaaattacagaaatgtggtctttgcagaatgggaaaccctaaacaacttacattttactcaggatttagattccatgacaatgtggcctttttgcttcctaatctgttacttgcatacacgatgcttaatggcacgactcaaagtgttggtaagtgtggtgtacccccgtcccgaatcctgaattttctgtggacaggaacacattttaataaacgcttgcctagtaaaggaagttactgggaaaattctctgtgggagccaagcaatgaagactctctcaagaacttcgacatcttatatgtgaatactgcactcaatggactgactgccataggggccaaagagttaaagcgaaggcacgatattctttcaggctaatgaagccttcctgctgggagttccttccccagtgagtgggaaagacgcaggatgaatggctggggctttgtgcactttcccacaggtctggacaggatctccagctcagcatctacagctcagggaggaaggagacccaggcctcacagggagcagacaggaggactagggggacactgctcaggccgcccacaggctccactgcccaccaagtgctctgaaaggcttgacaaataaaagcattgctatttttttaagggcaaaaggtgcatgaaggtcagtggtaggtacctgtctggaggcattttatgctattggtgcaaacctcccacgagttgaacttaaaggaatgttccatccttgcaggaagtctccagatacaggaaatgctaataaaagaaaaagggaggaggctttgctctcctttcccaactcagctcctacaacatctcacattacaaatttgcaaactaattacttagagccagacatattaaaaaatttccctttacaactaagtgaatacagaagagaatcaaaatagagctcttggctccagacttagatagggctctgaatttaaaagtctaattaaggcaaatcatgtttgctatgtagttctctcaaacactagcattattgaaattactcctaacaacttaattgatataaccaatacctcaagtaaagatcatgcagtaattagttcagcctgcagaagttggagtatcagggatgatgaggttttctataaaggctttggctgtttttttccacataaatttacctctgtgaaattttgagttagacaattttattttacactgacttggcaatgcaaataaaatatcgaaaatagctgaactgttattaaatgggatgatttcttggttagtactgtgattggtatgaagagcggaggaattcctcttttgtctctttcccttggagctctctattgaaaggagaaaggggagatggcagtattttatgagtcattctttggaacagcattccaagtgtgatttacttaatatagccctataaatcacctaatgcagaaacaatctcaagatctgcatgtaaacatacctattaaaatattacaattactctgtttgcttagtgctcataaggtatatctcatctgaaggtaaacagctttttccctgaggtgggacatccaaaggagcgtccaaattacatgcccatgtaaggatgctgaacttgagaaaaatatcacattacctaagtacaacgacaagtgtttgactaggagagggactattatacctttagccgacatttttctgccttcaatttgctgctctggtttgaaaatccaattcatctaatttcatagttggctacagcactggttggtaattattaatcacagagaaaattttcagctcagaaaaaaaaaaagtgagcatgtctacatttgttttagtgatttgctccgcaacagccagagggcatttatttttaaacaagaagtgagccaggggacccagatctatatgcttgtggtactgcttatttttggctcataagacttaactttctttagtatggtaatctgtaactgtaagcaatcatcctcccgattagtactgggttaaaaactgtaaaccacctacaattactagcatgatccctaacctctgtaaggtggtaatccagtattggttgttagctgtcaaatttatttccctttggtgaaatataccctggatttaattagcagtcattctagatactttatggagctgagcccaagcactgtggctttgacatttaacccctgacccttaaatatttaccagcttttaaactggttgtgtacaattatcccttcaagtatatatcagatccatcattctgaccactctagtctattccaagtcagatgtactattccaactgatgttgtaattttcaccctggaagtggaaataaaatcatgggcttcacaatgagctctgtcaggcaaagctgaaagcacttgttactagatgctacccatggaaggggcagggtgtgctgccagtcaggagtcccagtgatgagtgtgaggagcaggctgcagccgaggggacgtgggttgctctttggctctggccagccctctgcgcctttgtgggatgctttagaaccagtttcgtcttcggctcgcaatcgtgaaaggaatattttggaaactgttttcatttgtttgaaatcaactttattgaggtatgatttgggaagtgtattatttaaatttccttgaggtttcctaggcagaaaatgcctagatagaagcaatgagaggcgaggactgcattttttctgctatggtgtaaaactctcacagaatgttacgcacaaaaccagtgcacttcaaatgtcacagttcttgaaatgtattttaatccaaaagatgggctagaaagggccctcattaggcaatacccactttaaaaagataagtgaatgctattctgttgagactttgcaagacctcccacctggaaggggcacccaggtctctagttcaggagtggtaccacccctctcacgctctgcctctcctcaccccttccagaacatacatcacgtgcctggcacatagtaggttctccaaaactttttgaatgagtgttaaataaacccagcagtcatgaaaatggcttacagaggcaaacatgccaaccagaaatgtcaactaggcttgtgcaagtaaaaagaagaatgttactggaagtgagagagtccaagccaggaaaacaggagcatgtattgctgatatccagcccccacactataccccagcagagaggaaagagggcaagagacgtatttgctgctagtggggagcccctacgctcagtctaaattagggccagatgctcgtttttggctactctaagaaaccaaagtgtgggtcagccgcacttccaagtggagcactgagtggagaccgggctctggtggccagctaatccagaagcctgctttctcaaaggagccaaaactggcatgtgactctgctagacttaaaaaaaggaaaaatttgtagaatagccgtaatgtgtggtcttgagggtaatctcaacaaacagcgttcgggttggttaaaatgcctcagtggcagtttggagctcaccggatctggcagccactaatgacattgtgagggcgactgttgcaccatccagctacactgtacacgtaatgcaagttacaaacaaacaggacagacggaaacttatgagtcaaatttttttcatgtttctgccaggtggacacactgcataaacagaatgtaggtatcagagactgaactagctagacatttttaattctcgggatttttttaagctttgttgactaatgttttatagtgatataaaaagatcctatgtagtaaaagaataagggtggtaagtcatgggcatttacctttaaggagtgctaaagtgctggaagtgctaaaaatcaaatgaactctctctcctagaatcccttgctctcagaacatcccaaaatatttcaaggcgttccttgttttcagtttggtcttagttcagaggtgaactttatgcagggaggaggttggcttaagcatattttagtcctttgtaagaaacatgatcctggaaaatagtgtttcctcccaaactctcactgcaaagtgaaacttctatcgaacctaacaaactcacaagctgataaccaaatgctaacgtttttgaaatgattgcttcctactaaagatccatgtcactgctaattagaaattaccaactcatttttttcctcaaataagcataattgtttatttaaaagatttccaaagattaggaaaggggacgctattaatatcagaatgggtaacacaacaaattaacaatattttgcacatatatccctatttttgctgtagtgtcactgctatagaaattgtctctctgtacaggtacaggtaggtggtgttcatgtgtatgtttgtgatgtagagacacagataggaagggaggaagaaccatgaggaaggacgctgacacaggtggttccagtggctggaggacacgtgacttgttcatatccaccacttgactgctttcttctcactcacttctatcccactggccagaacgtcctgcaatgcctatttccctaaatgccacttcctctccgtttttcccaccattgtcttaaccaggaccttcctcatatcttctctggatgctctcacaattcggaatggcattcagacttctacgtgacacacatggactcttccccaggctcatcccctgtgactctaaccattctccatattcacatactcacagttccctctcaaaggctgtgttctctcccacttctgaactttctgtatatgatgttccatcaacttaaaatctccacctcacctcttcctaactctatttattcttcaaaacccagcacaaaaatcccctcctccaaaaagtcttctgtagtggctttgctgtagtggtcgttacagtcccaccttctcctttctgaagggaaccccactgtagtttgggtgtttgttcttgcccttatgcatcagggaggctgcccacagcagtagcctaaggaaaggcaatcccaactcctctgactggcaaatagcctgggtctggatatatgacccaactctagctagggagatgggagaggaggcctgctgaggacttcaggaaaggccagggaagtcactctgtttctccaaatggagaagaatgtgactccaactgctgctggcagccgacttacagccacagcagggaccagtctggggatgatgtcaatactgtggacagcaaagagaagcctgggtcctagatgactctgtattagccaactgcaaatcccagcctacctccaaatgtcggattacaggagacaatacattttttaaggttaaagccaatttgattcaaattttctgttacttgaagctaaaaatatcctattttgaggggtggggataggggataaactgcctagtatttcttgctttcaaaggttgcaatgaggtacagaggctcacattgtatattttaaataagaaaatttcagccaggagccgtggctcacacctgtaatcccagcactttgggatgccaaggcaggtggattgcttgagctcaggcattcgagaccagcctgggcaacatggtgaaaccacattgctaccaaaaattagctggacatggtggtgcacacctgtagtcccggctacttaggaggctgaggtgggagggtcagtgagcccaggaggcggaggttgcagtgagtgagctgaaatcgtgtcactgctctccagcctgagcaacagagtaagaccctgcatcaaataaaataaaataaaataaaataaaataaaataaaataaagagaatttctacctggattctgcctggttggtacagaacagacagtacagattatgagggttatgagccgctgaccagtgagccaacatcactgtccatacccaaggggatggccctcagattggcagtaggtgctggtctcaagcaggcaggcccactcatgcacaaagcaggccatggccatgtggatcaaaaggaaatgtctgtcaacttctctgggtctctggactcctatgttagaaaagaagctacatcaatgtacagtataaggtgtgagaacaacaaaataaaaaagaccagagccctatagggtctctcttaaatgtaaggagcaggccaggaatggtggctcacgcctgtaatcccagcactttgggaggccaaagtaggtagatcactcaagctcatgagtttgagaccagcctgggcaacatggcgaaaccttatctctactgaaaatacaaaaattagctgggtgtggtggcacgcacctgtagtcccagttacccaggaggctgaggcacgagaatcacttgaacccatgaggtggaggttgcgctgagcagagatcgtgccactgcaactccagcctggatgacagagtgagaccctgcctcaaataaataaataaatgcatgcatgcgtggagtatgttggttaaagccaacctttgctgagaacagggtagcctctgatgctgccatgctccatcccaccaggcccctccaaaagaagaaaggggagaactgaggccatagcgtctgcatgatctgtcagaaatgcaggagagctgtggtgtcggcttgtcggcaagagacttcaactcgccctcagcatctctcttctcaccttgttcacagggtgcgctttcaatgtgaggatataagtaatcacaatagcaacaactactacttacggaatatctatcatgtgctggcactgtgttaggagctttagatatactgacagatcgaattcccatgataatcccattcactagggcttattatccccaaagtccacaattggttgaatagcagagctggggtttatatgcaagtttgtctctaaaccctgtatttttcctagtgtggtatattacctaaataaaatgaagcttaaaaaaatctaaagtagaatgaatttttctcaaagaaaagactaggatgaaaacttactgactactgagtggattgtatgtacttggattgtacatttaatgttgtgatttggtctttaaaaatagtattacagcaaacctacctcaaacagtttttacctatgtcaggattaaacttaaaattcttggcataccatactttttgcattcagcttgaattttcagacttaatgcttggcatatttattacagttagcttgagttttcctaaaatcaattataaatagccttcattatctgagaaaatatttcaaaactttgtaacaagaaacattaacaacctacaccttttttcctggatctgagaaaaaaaaacctgattttagcagtgtcttctcttgtgtttaaaatatttgggtctgcaatcatgacaaagaaaatggaagttcaagctgcacctatctagcaactttcagtgacattaacagatgaaagtgcatctcgaaatgacttttggctcaagaacaaatatatacttttataaataggttagcttctttctcagacaacttcatttaactagaagaaattaacgacagagagttacaactgtaacctgagggtaacacttctttataagaatggataataactaaatgagtggccctattcaggaaggaaaatttggcctcagaagaaatccttaggttttactgtaccagtctgtaagtgctgctaaagctcagtgcatttagatcatgtactcttaatatttttctcatgttcaaactgatgatgaaatgtgactctggttacaggaggaaagtagaaacatctgaaataatggcaagacaaattgttttcatatcacacagcattttacatctgagattgaggcaatttgtcaatgtcatcatctgactctctaatgattcctctattgtacattaaaagtaaaataagtgacttatataaggtcacagactgagttaatggcagaaagtgtaatgggtttcacggtcatagtttattatcccatattcaacattgtacttatgcttttagaggaagaaaaggatacccagattctctttgtaccatttatcagtgatgagcatatatatataaaacatagatcttgtagaaaatgcacattgaagattatagtagaataactatctggtccagttttattagccaaccacttcacggcttataaacattaaatgaatatctagcatatgttgagacattctcaggtggctctctactactttaaattcttcacagggtacccttcctctgaatgctgtaagtcagcggtccccatcctttttggcaccagggactggttttgtggaagacaatttttccacggactgggggtgtggggcgatggttttgggatgaaactgttccacctcagatcatcaggcattagattttcataaggagcgcataacctagctctcttgcatgcacagtacacaatagaggctgtgctatgagaatctaatgctaccactgatctgacaggaggtggcactcaggaggtaaggcttttccaccactcacctcctgctgtgcggcctggttcctaacaggccatggaccagtactggtctgtggctcagggggttggggacccctgctgttaagtcctcatagcaatattcaggcatgaggacatagtggagtagcattgaatccttggcctgaagcatatgatccctgggataccaggtgtcctgtggtctttttgataatattagatggggagtcaaggtccagggccagacaccatgtttcttttttttttttttttttttcctccttgagacaaggtctctttgctctgtgacccaggctggagtgcagtgccacaatcacagctcaatgcagcctcaacctcccaggctcaagtgatcctcccaccacagcctcccaagtagtgggggctataggtgtgtgccgccatgtccagctaaattttgtatttttcgtagagacagggttttgccatgttgcccaggctggtcttgaactcctgggctcaagtgatccacttgccttggcctcccaaagtgttgggattacaggtgtgagccactgtgtccagccagacaccatgattctaatgccctttttctctctaaaattctcaatatcaataaaaggaaacaaaactactacaatattgggttagagtgaaccatagtttataaaaaacaatgaataagtttctctccattgataggaaagatgggaaaactctaagaggctggcagggacagggaaacgatatggaagccatgggaacatggaaagagaagctatgctctacattctttccaatcctagattgtgaacctctgtttcccccaatgaaggtgaaaattgcaaaccgtactctgaaagacaagggctaggcaaagcaacgtactgaggggaacactcagtgacagtgagagatgtggccagaagactgtgtgtaccggaaagcaaagcctcagggcagcatttgagcaggtattttacaaacacttagaacatttatgtacagctcatatcttttaggatgtatcaaatatatcactgtggactctactaaaccaaggaggcaaaaactccagcaaaacaatgacaagtatgaagctggagaagactcctgataatgactaaggtgcagggggagaaacagcagatgaaatcatgcttgacctttcagatgtattgaaatagaattatgatgtaccttttactggggagagggtaaatatttcccccaccccctttttaaaataaaagacggtcttgctctgccacctaggctggtgtgcagtggtgcaatcatagctcactgcagtctaccactcctgggctcaagtatcctcctgcctaaacctccctagtagctgggactacaggtacaagccaccacgcctggctaattttcttatattttgtagagacagggtcttcctgtgttgctcaagctggtctgaaactcctgggctcaagtgatcctcttgccttggcctcctgaagattacaggtatgagccacggcacctgccctagggtaaatattctttaagaaatctagaagatggtgagaaaaatcatgggggaacaacaatgaaatagtcattcatggcaattttcagaagatccaagtaacagaagcctattcagtctgtcttggagcggttttaaataccatcacctcagtggacattcatctctaattccattccctaagttcccttgcacatgtcccatgcttactaatctctccacaccaataccaaccaacacttcaatctcagtgtgtccaatacagaactcagctactttctgcagaatgtgtcaacctatgtttcatagatagaaatattaatattagtaatccgaatgtaccacatgcccctattaggaaggtttacaaccttggagtcattcttaattcatttttcactttgccccaatactaatcagttggtaagttctacacagtgtctacccaggcaacatctctgtcaaccaggctgatattttggtttgtgcggtctgggtgttcgagtacactgaaatagacttggtgagggtgtactgtctaacgggaagatcagcactttaggagaaggaaagagtgagacgagatatatgaaagagaagtataagacaccctgggagtgtacggccaaggcattaagccaaaccatgggtgctggagaagcctctccaaggaagtgacatcgaaatgagacttgaaggatgtgaggtagaaggcaggcactgctgttagtttgtctccaaaaatctaccacaaatcatctcaatttccaatcttcatagatccacaccggctacagagtgaagcatggacttctcacctttgcatgtaaaatctccaagaccaggtcccaacgtaccgccccatttcatcatctaccgcttgtagagtcacagtgctccgttatgtagcctctgctcatggccctgtttccaacctctgtgcctctgctcatctgttcccaccacccagaatcccaggtgattaaacgccacttatccttcatgctcagctcagttggcaacttctccacaaaatctctatggattcctggcctcccatcacaccctggctcctactgcctttaaagcaaaaagcactttatccttattctgaaaactctcgtcacctctcttgacattgactactctctgtcttgggtaccttatacaatttgatttaacaaagttttttggttttcttgttttgttttgtttctaagtgacaaccatgtgcccagcagaatgctgtaagctaatgtttgagtaaaagatggtgaattccaacttggttgctctgtgcttgaaagagcttttgaagatagtggggtgggaacgtccagagggcaggactgcatagggctggacttcatggagtggtctgggctgaagacaagaatttgtaagtaatgatggtgcacatggctgttgagggtcccatgagtgtaggcatcacctaggagggtgtgtgaagtatagtgaagtgggctgatagggagggatgggtgagcatacactgtctcttctactagcacagtttttcagcagtggcatcactgacgttttgggccagatagttctttgttgtgggggctttcctgtgactgcaggatgtgtagcagcatacctggcctcaaccactagatgacagtggcaactacctccctgttccccatccctcagttataacaatcaaacctgtctccagacattgctaaaactcccctgggggacaaaattgccaccatttgagcactgctggcctagacctgtaagtataggttctaagcaagtttctttcttcctgtgatttagtcacttgttgattaaattaattgttaaacaaatgcttgatacacttctattatgtataaggcacactggaggccaatgctagatgcttaataaacatttagtaaataaattaaaaaatgctacatttcaggaaaacatctggtaatataaacctagggattcataaaagaatatgaccaccatacgcatgctgatcaaactgtttcatcttcatgcacctacaggccacacgtgctcatgaatgaacacaggggagtaggaatgtagtgacttcatgtacatgatgctctttcttaaaggaggtgacaaagggtaaaaaagcaaacagcactgttatttctttttactctccagacccaggaaagtttgctgacttgctaataaacgcaaaaatgtgaaggctttttatttgggaataacctgtgaatacccagtaaatgtacttaagttatgtggaataaaataattttagcattgcaaaaataaatcctagaattactgttgttgtagcttttccctgaatttgactttccaaaatgtttattataagctctttattctaaagagtctactataagaattaccctattatgtctagagactcgacagaacagaccgaagctctttgccatattatataaaacagcaacaccatcaatattatggtgacacagttttgcaatcccttctatctaacaaagaacttttcaaaaccctttcgtggagctagaattgctcagaaaaaaagtgggtgttttttgcaaaataggaagttcgtttttcaaaataaggaagctaggtcttaaagagctttttacacctgaagacattcactgcacataaaatactatttgtttccccataaatgatcatcatgtgttccaacgtaaaatatcagagacaccttatttttcccagtgccttttcttcctaatcctcctcatgcaatctcatgggtcttctgctaactgcctccaaataaaggcataaactgcagcaaacagatggccaaactcctgaacactttcttccttgtgccaagctgctatcggatgtaaatacattcctagactgtgttaaaagcaggatctttctggtttcgcttcagtgtctattacccaggttctgctcattagaaactcattattatggacctaagtgtcaagatacatgttgtagtgaggcgcttctacacatgcacagtaaaacttttatctaggccactaaatactgcttcttatctgtcagttttcagttaatttacaatgctaacttatttatcagaactggaaatgggccaggccttcagtgtatttgatgagccttacaataaccctgaatgcacctgttaattttgcctttgggtaaacagttgaaaactcctcagctatttcctcaaattgggtggaaacaaagaaacatgagattaaaaaaaagtctagattagggaattggagatgcattaatttaaaaagggaacagggtcaaacgagggctaggaggctaataagcacagagcacacagcaaaaaagctcccagcagggtaagagttcactcaatttatccggcgatctattccagacgcagtcaatgatacgttattggatccagacctgcaactgcttcctaagaccaacctcacttaagtgtcattgccctcccttttagaaatattgctattacccaaacctgttcgcagggcagctcactcagctggcagcccactgacttgtgttctttatgatgctccctctaactcccgtctctgctgtgggaattaggtataaccaccaccatgcaaaccgcagaacacccaagttgatcctactctacgagacttttagtactttattacacagaaagccaatccctgggataacagactataaacaacagcaaatgctctatcaggcaggctgtacgaggttaaggactttgagagatttactggagaggttgtggacgggaatgttccatccatcaaatgcgctttcttacacattagataaaagaagaagaagaatggaacgtaggacattttggctaagacatttagaaaacttgtatgtttgtcccaaacaacgaggggaaaggccgagtgattagctatgtaattaaggctgccttctaaccttttaattattattaatgtggaaagttgtgagactgagaaaacgtgtattttattgcaacaggaaataagttttaggtatttgctgatatcatttcaacattaaaatatttaaattcatttggcaaacaatataatattatattaaaggggcttattggaaataacatactttattaaagttaggaccttcggggcagggatttgtttctttcctgtgctatctaattgtttgaaaacacacatactgtatagcagaccccatactggacagcagaacgaggcatttaatacatttaataaggggactgtgtttgcggggctataaatgtgggccagctaatgaggaagtgatcaccagtattccagtattggggagctttccctcactctggattttaccactgaacactatattttttaaaaataataattttaaaagaaaaaaaagaaaagctggagttcagaattgcccacagaacatgaaatgcttttaatggcagtctgaggtgactgtgtttcttgttcacaacaagcacctttgatttgtggagatgaacactttccaaacgacaggctccacccacagcagacatccggagcaggcacacacgtgtgtgtcttgtcaccacctgggcagcttctgtgaccatgggtactaacgtctcagcaccctatcactggcagggagaggcaggaggagaggctcccacacggaatcacaagggtccctgaagggagcgagaaagagatgcagaacgtgtttctggacagtgccatctactttgttctgggccatagcggaggctctgaaataagtcttttccacagtggtcactccaaccaccgcagttttgctggcaactcaaattcaaagccatgtgttggtgcagtagcagcagatgaaaactcagcggggcattacgcagttccctcaaagccacaggcctcaagagctcgcaaaatgccctttaaatgaaggaatggttaccaatatgtagtatgcatgccaagaacttaaaatcaaacaataaatttacagtatgtccttttgttcaaaatctttcaaggatattttctgtaataaaagctttttgcttaacgagtaaactcaaaaatggcagttgaggtgcatatgaaaaaaacttcagtagcctttccattgtaggcacagtgatacattttctgtcctgtgcctgagagcaaacgagtttaacagggctttttcactatttcttttattttccacaagcttcccctccactaaaaaggtgcgtttctttataatacttgctttgaaaatttagcattatgtttttcttagtgtctttttttttctcttaattttgttactaactatcctgaactattttttctgtccctggcaatggtggaaggacggtgggacgtgggatccgatttttttttttcccgagatggagtttcgctcgttgcccaggctagagtgcaatggtgtgatctcggcgcgatgcaacctctgccttccgggttcaagcgattttcctgcctcagcctcctgagtagctgggatttcaggcatgcgccaccacgcccggctaattttgtatttttagtggagatggtgtgcctgtttgttggtcaggctggtctcgaactcccgacctcaggtgatccgcctcagcctcccaaagtgctgggattacaggcttgagccaccgcgcctgcctgggatccgctttaaagtctgcgcacatcttggagaatgttctcatttctgtccttgttgagagaaaggggaaaggggaaatgcaggcaggacttgctaggagaattttttcccctttcctactcactaagggcatacaagaaactctgaaaagtatctgagacatgaaatactgccaacacaagacacaaaacactgcctttttggaaaaggctgtctgaagattatataaggagggccgggcgcggtggctcatgcctgtaatcccagcactttgggaggccgaggcgggcggatcacgaggtcaggagatcgagaccatcctggctaaaacggtgaaaccccgtctctactaaaaatacaaaaaattagccgggcgtggtagcgggcgcctgtagtcccagctactggggaggctgaggcaggagaatggcgtgaacccgggaggcggagcttgcagtgagctgagatcgcgccactgcactccagcctgggcgacagagcgagactccgtctcaaaaaaaaaaaaaaaaaaaaaaagattatacaaggagataactcatatgagtgtgtgtgtgtgtgtatacacatctggacaaccacgtgtacagggcaagacataaaacattatttcaagatgtctatgtgggctgttagtagccacagagcctaatgaaaatttcataagttatccaacagaaaagtgattagctattgaagactcagttaaaatagtctgggagatagaaccaaaagacattcttatcagtttgagttgtccatatatggagaaatatatcaattctatgtggatcaaacttacttattcattgtagaaaatcccccgagttgaatgaatgagtcataaatgcaaggtgtatttttaatttccccccttctgatatcagtgccaaatccttcccctccatggtcctttagcactattcagaggcagacaatgctgccactgttttcagaacatggacatggtcaagagtggaataatataatgataccatttcaagcagggcagctaaggttgtgtcagcatttccattataaaaacctcttttcaaggattaatatctcaggtgtaaaaattcacacccaggcaagatttggtagcagaaatgcttttattctgtaaaactgaaaactatgcttgtcttaaaagtcgtattttaatgtgcaccaattttccatacacagatatgtgataacagaacttagagaaagatggattatgagtctgtgtgtatggatgaggccactgacattgagtttaccttaatggcattattttactgcaaacaagggcaaaaataccacataccaaattggaatttcagacttcagaactcagattttgttgtaaacaccaaaacacaacacgctgatgacaaacttccaatgttctctgttaatcatgtcctccagcactatttagctcctatctatccttttagaagagtggtttccaactgggagtgattttatcacccaagctatatgtggcaatatctggagacatctgtgattgtcacaactggggctgtctgggtgcttctagcaggcagagctcagggacactgttgaacagaacagctagaattatttggtctaaaatgtcagtaccacattgcagagccattctcattcagcatgtgggcacaccagatgctgcctgcagactcgcgatctagcagcaagatgggccacattcatgagcagccttatctccaatgtcttgagattgtcttgtcttcttttcacgtttagaggagaggagatacctcaaaatctcaaattatcctggaatatttcctttattatcatcctttcttgctaagggatagctcactctaaagcacagagataattagtaaatggaatgaaaaagaagatgagaaataagccattcttcactattaactgatggttattttttgtgttttctttagagaagaaaagtctgtgggtctgagatgtgtagttgtcagaaaaaaaataaaagttcctcatctgtggtagataagcacttggcatctaaaaacctttctgcatttattttgttgatctttgtttacctatgacaaatagagagagctaactcccatactttatatgtcagttgatcagccaaacaatctctgcatatggtgtcaggaaagacatcaggtggctccaagtgcctgtatgacctgctctgggaaaagcacttggggatccatagacctaagacattcagagtcccagagctgttagccattcacatcaacatcttctctaggtgtcagccatttgctcaaaccactaatcaagcaaattttggtgacttaaattacaactcattttctttcttatttctaccattgaagggagggcctacttagtaaagaaaaagtaaaaatgcaagaagctggagtctggccaaggatttttcagttaacactaaacagaacagagttctattctagaacagagatcactgcagagtccagaatgcagtctagagagggctggtactactccccaagtattgagagggtacctgacttgttatgtaaacagctgtcaccaggaagtagtaaatgaagttaaatatcagaggaaaaagaactcaaagatccactgagagaaatattcaactggaccaagtgataaaaatgttacttttgttaaccaaaatacagtctgagagcaggatgctgactagcaggttgacaaagaaacaatatttttcaagaaaaaaatgtacacaaattcacccttctggaaatggaaacatttgaaaatgaattttaatttactttttcaacaaattttaggcaccatacagtctaaccttctcttttctatctgctactacaatgcacacacacaaacacacgtatggatggatggatgcatgcaggtacattacagggagattctgaccgtgacaaattggatttataaatacatattcatacagacagtgtgtctgtgtacctaatctctcaaatccaaaatctccccacaaccgtttcaacatcctccagaatttcaaatggctgaacaatgaacagtaaagtatcttgggaatccttaacctccctgtaagtacatagactgcctcagggggtcagttttgtattttggaattatggctggtgaggatcaaacttgtcggtagtgatggtgataatgctggtgtatgtgtctttaaaataccctaacttttttcatcttctgattttggtgaataaagttgctgaaaatgaaaactctctttataattcacacaggcttgccacaacgtcacagaaatgtgctctaacctacctgtgagaggttgcctgtatctattcctacttacaactcagcagctacactctctccctttacttccataaatcagaaaactcctcctggccctgaaaacattattagctaccatatggagtgccaaactctaccactgctgtagacattagctcttcagatggctgagagctaacgtatttgcccaatttgcattttaatagtctgcagctgcagtggactcctttcactttatgatggggatgccccagctttgctcaagacaggcaatcctggcatactgcccagagcaaggaagctgtagcggatctggacaaaatgcaagagtacagactcttatttccaacagagttcaacaggtagggggctccaccctagacccagcagctagcttagaagtgtttggtgtggaactctttaggctgcgtagttttgatattccatcctagacatcttacccttgtgaccaatcactttgttccctacagggccatgtggatgtgaacagaatccttccttatgtccatcttggaggtgagaggcatcaactctcatgtgccactgagagagagggcaaaaatattaaaaaccattgctggaaggacaccttgtgagtttgtaagtttttcagcacacttatcatctaagaaactaaactaatgaactcagtcccagaatgcatagagttgtcccacatgcgaatagatttctacctctatcaagagttccctgtgctttccagagggaatgagcaccagcacttgccattcgaatctgtcatcaagatgctctcaggctcttatctcagacaatgttgactccactaccaagttataaagtataaaaggaagtgggtcttagagatggtacagaggaaaacattcatacgacattccttgttgtagtgaacgtaactgggttttgcagttttcccacttcaaaaaatcacctgacagtccgtatgctgcgttcagttccactcatcataaagggaagcacaggattacctgggtgacagcttccaaagcccatgaaccatgaataaggctggggacatacggagacagcagcctctgtggtgtgttacattggatctgggctgagagttgctgtctgctctagtatctttatctcctttcaccttggaaattgctgtttggctctggctaatagttggttgacttcaggatcacagtagggactaacttggaaagtgcccttaaacttatttttatcaggatgcctcttatggttaaatatatttgcttcctgtttgtgagttggagaattgccaagcagaatgtacacctccctcagccttgaaaggatggatgcttctaccttttttgcattatcgaagagataataaagtgtatttgtgttattcactatatttttagcaagactgagccctagtccatgtgcagacttcttggttttgtttattaataaaaatcatatatatggctgcaaccattctgacagtctagaagttgccacccttgttaggaactgcatttctgtgattatgatcaaaatatactaaggtagttgtctataattatcatcttggaacactcatgggccattctaagataaagaactaccacatccaccataagcttgtgttatgtttatgaccatcaatgtcacaccatgttagaggaaagcgcatatatttatgaagatcaatgtcaccctgtgtaagagtaacgaatgtattatacttacgaagatctatgtcatactacctaagagtaaagttacagagttgagagtcaagagtcttatatccaattagcctacaactccaagtatctcagtacatggaataaaacatataaaacagacaaaaaaagaagctataatgtaaaacctaaaaataataataaaacctagagaaaagtgcttagacgttacccctcatttcttgcaaagtaagctcatatttaagttcagatggaccgggttaacaatcgctatttttaatgttaaaatgccctagggaagttataaacgcaccaaatatgctgttaaccttactttatattgtgtgcagctgtatggctttgtaccagggaccaaactttctaactgggccagcaaagtgaaagaggcttttttccaaaaacctttcaataacaatgctttgcttgtcactagatttccatttcatttttttctactacttcacactagtatttggtttagattttacttatttccaattactttctttggttgttattttcactgagaaatgcacactatatattactgaatagggataaaaacagggagagaaacgtaatggagaaagaagagcaaattcaaatgtttatttctgacaccgagagccaatgcttttttaactcccaagatcattctctctggcaagtttaaagagacactttaacatttctatagaccttcctgggatcattaatattgagcaccatttgctgatcttatgagaacgtaataaaaacgacaatttttgttttttccttactgtctacataagaagttacaatctattcaactttaaaaaatgaattttaatggtttaaggtcatctataagccttggcagggtacattaaaggagaaatggccgtatctcagtgctttttttgtgttttggggggggcaggcacttaactgagatgacatagaagcacactggcaggattctcaggtctgaggtgacgcagtctgccctacaggtctgtgctttgtttgcagtcagacctgcacagagatggtgcttccagccagccctggcagtagctgattgactagcaaactgtcttgcagctcttgctgacatccagatgcagcacttacccaggagtctgaccgtagacattgatacctcactggaaaagaggattccaacgtggaaccctggtgctacttcggcgctgctgacagaaatgatgtctgcaaatgctgctgcttggacaatggccctctacaaactatttactaaaatctgtttcatgacagagaacaataaaaataaaaaccttccaccaggtagaaagtcaaatggagctaggctgtagtttgttggatgaaaaaaagtaatacaagaaattcattcaatttggcataaaactgcaacatttcagctgtaatggccaccaaacgtgcaatgaaatgaatccaattaccttcacaagtttatgcctcatgatgatgctgcacttcaaacctttgccttttttggttttggttttttgagccaacgagaaagaatcctaaagcccttgtttctggatggtctgtcaaaagaccagtaaggtagcctcagaggaagtgctgaggagcctctggaagcacagcctggaccaggagtgaagactgaggtctgcccttccactgagtgaatgactgaggggtccctgcatctgttgagattccctactgtgaaatcaggggactgacaggtgatgtctgcagcccttacaatagtcacatttgatctctgaatcagaacccttgattgtatctgaagaacaaacatcataatgtattatttaatgccttcaaacatattcagtccttattttaagaaaataatacataggtaaaaattttaaaaaattagaaaatcttactttaatatgattggagtagaggcctattatacagattgacctatagattgtcttgcagacagtcctgagccccactggccttctagacttcatattgtagtgaataagataaactgaaaataacagtaaaacaaaacaaaaccctatataacaatgtttaaaagaggaatacaagaattaaaaattaaccattgtatctcagactttaattatatataacttaaaatgttaagaatacatataaatgtgatatgtaataaaaatcttataatgaagttctatgattttgtttctgaagttaaaaaataagttgatctatacaatagattaccattcagcaatcaaaaaggaatggactactgatatacacaacatggataaatctcaaatgcacatgtgaagtaaaagaagacagactccaaaagttacccagaggattattccatttatatgatatcctggaaaaggaaaaacattagggcagaaaacattagagattataaggtgggggctggggagagagaggaggaagccgactctgaagatgctcaggggaattttgtgcaagatggattgttctatatcttgatgatggtggtagttacaggcctatatgcagtttttaaatcatagaactacatactaataacagtacatttaactgtatataagttacacctcaatacacctgcctaaatggctgatattctccaccaatatatgtctggtgtccaaaaaaaggacgagaagagtcttctcacattgtcaaccgtgaagaagagaacggctggtccacaggtttgggttgtaggaacttgatggggaaggcaaaatccaagggtactttaagaagattaaataagctaagaagttctccaacttgctgagttacatggcaggcacacactgatgggaaggagagaggaacctaggcaggtctgtgtttgtgatgtgtgcccagaagggctggtgccttctctagtcttgctccactaactgcaccagtcagcagcacactctcactcacatgcccttggcccagactccactgttagggcaatgaaatatcacgcttctccattcaagaacagagttaccgaaacaagatctgtctgtctttactctgccttccagttagtgcactgttaaactactaagtaagatgtctgcttctgagccagatcactggaggagagttttagaaatcacctggagggtgacgtgcacacaaggggaaagcaccctcagtgaatgaaggagcaggaagccgactgacatctctaaagttctgggctcagtcctgtgttgagttagtgttcattctgggaggatacatgtgtataaaatgggaagagatgatgaaacatatttaaacaaaacaaaagaatggtttgcataatgaacaaacaggactgagaatcacaccgtctagaggaccaggaggggccactccagtgtggtgcagctggggatggtgaggggtttaattttaccacacagcctgggttaggcatcttggaaactacatttttgatcaggagaggctgttccagtgggaataccagcccacagggttggattgctcacactaaccaggctgagcagattcctctaatttcggggcatgaagcagaaatgtcagtggctagagggcatcactgctctttctcccaaaaaaaaaaaaaagaaaaaaaaatgcgaaaaggcaggaggtatcccataggttacagggaaatgggctaattggctagagtgatctggtctcctatcagcctcctgacctggtgtcgtggcctcttctgtggagaagccaacataagagaatgggaagaaatgcactttagtccccagtcacaggtgagtctagggttttataaacacattttgtcttttcggacttcacctctgaaaaagtgagtagatagcaaagtctacataaaataaaatacattttatctgttgcactgaaaattatgattgttaaaatctgaactgaaagcaggtattcttgaatatatttaggaaaagagaacaacggaattacccaaacttttaaataataaaaaagcttcacagagaacattcacttcaaccactttcccaaccatctaagtttcattacactttaaatctttgagtacttaactgggatttacagacaataactagaacaggaagggagttgatgatgaggaaagagcagatacttacttctgcactgggacttcgcattcttcataaaccagaccaataaaataacgttgtttgatgacttaagctcatttatttatttttgtggcagtgggtgatccatcagtattgaaatagaaataaaaattattttgtttaatattttaaactaaaataatggttctccctttacatcaatacaccttgaacaagaggtatcaggaaaagacaaaggatcctgctggcacagcttcgaatccggggggacatcactgaaatgtattagcaacacacaccactgctttactcaatgctaggtgcagcttatcaagctatcaaagagaatctgctgaatataccaagtgtgtctcagaaaaaattctttgtattagctagaacaaggttaacaaacattataactgttcataaaaggattctgtgattaatatatttccacaacttgctggagcttgtactgattagtctttgccaaagaacctttcccagctgcattcagcaatatcctggaatgacaactctgtcaaattaacttgaaaacatctaacgttttattcacatagttccctgggtaaaaaaattccatacttcttattatgttgtgccggtgatctacattcttctttagaataaaataatggggataacataagatttattggaggagagctatagtttttatgcatataatgtctataacacttatgagtaagtctttcaagcaacattgtctcttccaaatataaaacatacaacttatacaaaacactgagaaaacatcccaaaaattggataagttaaatactaaaggtatagataattcattatgagtaataactgttaaaggctaaactagccacattattctactttttaacatgtaaaatgtttgcatttttatcctgcagaaaaaagaagcttttttagtaactctgattttaaacattaaattcaaaggtttctgattgttatctgttgcatcgatggtttttattacctgtgtggctgtaaggggctagggggatcttaatgaactggccctatcaattagctcttaggaggtgttaaaatcacccataaccattagtttctttcacatgtttaggaaaacccaccataggaaaaattctcgcaagtaaaaaagaaaatgtttttacgatttcacttcagagggtatatttttccttatttaagtacatatttgtgtttaagaagggtgggagtggaaacagcacccacaaacgtttggctgtaaaactctaaggtattatgtaatgtgtccacatattaattctttatatagcacttataaacacagaaaaatattgtgtgtgtgcgtgcatgtgtgtgtgtgttccaatataagtggggaaggggacattcagtatctctcaatttacatggagtacccacatagctttttgtgaataaaagagcagtaatttaaaaattctgacacgtcccacaagcttcttttaagtcttacaaatgaaaattcttctttaaattaaagatttagacaggtttacaaggttgcctgagatcacaccggaacatcataatatatgtgtctgaagagtatagtagtttgataatctataaatcactttatcattattgcaaagccaataaaagccaaacatctcacatacatgtacatttcttcacatttctgcattttagcaaatcacaaattaccaaactttaaagttttcaggtttatctcaaaataaaaataaaagtttaatatatattttctaatgtgtcatttaaaaaaagcattaatcaatttcaaacaaattagccaataaaccagcaaaaaagtgtggccattttcaattgatacaattaatttctctaagaggggtgggtcataacgtttcatttatttaagttttgtcactttttgcaaaaataaattaactttctagtttatcatcagttcaaaaaacaatcccaaggagataaaacattataaatatcaagaattatttctctaaacttttctcattatttattagcattactacataaaatgatacttaatcttttatagcagagatttgggaagctattgttaacttctgtgttagaaaaaagataatttcaatattacatatttttacataatgcagctcttaacagcatttttcaaaacagaagtgtaaacttaaagaaccatgacaaaggaaaaatgaattaataaaacagccctccattcttaccttcaaacattaaaattattgagctatttattttcacaataaataaaaaatgttaactagagatttatatgatcagactactagtcaaaactatgaagcaagggccactctatgatgacatgaatttttctttttctgcagtggatgctagaatataaccagggaggaaagcaaacccatgatccccatttctggtcttggttcatttagtagtgttgactaaatgtggcaaaggcagatttgctggtgatgaactcaggataaaatgggaaaaatgtgaaccttgacctttttaacaccacttaaaaatcagaaccagacctgtcagtgcaccgcctcactgcctatcgcctaacaaattggaaacctgatctcccctcctctgagtagaaagtaggcttgtcaggctaagctgagcagcaaacacccgacaaggctgagctgagcagcaaactccccaaagcagagaaagaccccaagtgtaaagtcaaacttcatatgataccttgagtttacaacagtgtaagatgttaaaaatagttttgaacattgtttcctttgccttgttttcatatttcatttgcaaaacatagtacagaagatagagtttttgaccaaacaagaaaggatgtttacatttttattgccggagcttagaaacgccatcatctgtgctccccaactccatgctcccatctctctctcttcagggattatcattttagattgaccaaaatatcctaacttcatcagtcagcacttaccacagacataaactgctttctgtaagaaatattcctcaattaagttttcttgagaactttatcctcttcattttgtccttaattatagaaccttgtatttcctatttctctttcatttctccaacctagcagatttgtaatagcagaaaaattactactaggaatattacaactacttggtgtcaagtctagtacagaattgagtttgtgtatttcaaggaagaacagagactgctgaaaatatctgttgtcttctatttctactttattttaaactggaaaacctggtactaggcaaaaatgaggtgaaattttataacaaattaagctagagtgataaaatccatgaaggaagaagagaagcagattaaatgacatttaaaaatatccaagccttcatttgattaactttaatctaattataaaaagttgctgctcacttccctaccaaacaaggagacctcagaatgcttaggttaaaaaagaaaaaaagaacgaaaggaaaaaagatgttagagaagcaaaaataacgctgaattaaagcacttggaggccaatggctttgaacctgggctccaccagtcattccacccagcgaagcggtctgcagaggcttgggctcctgttaacagagccctcattgtttccaaaggcagttagaaaaatgctgctttatatctcctcacaccacaggctccgtgcacagccccaagaaaaggcggctgagggcgtacaatccacaggaagaaaaaaaaatgcatggctatatatacagcccccagccccacaccctaccaacacagaaaaacactaccccaaactcaattcctggctggcaaactgtggtaaaggatgttatggtggtgcataatttacaactggaaatttctgattcatgtgggatttggggcatttctttgccctttacccaccacctctccgtttccacctcaagcacagggaggtgaaagctgtcaggcagtggggctgatgccatcaggcagcaaggagataaacactgcatttttgagagtgcagttattccacacctgtttaaaatgtttatatagtaattaaagattaatgcttattccagaccagataaatattagacagtgcatgtgtgtatatacatatatgaatctgcaatgctgcagagaacaaagattttattgtatcaagcgtacttagcgaagggtatacattttaaaaaggcctgagcttcacgaagtttacattacagaggggaaaaaaggcttaaaaatgttaagtggttggagctactgagtgccatacagagagcaggtagttagtagtgagtatgagctaattctgctgctaatcatttggttttctatttattaaagggcaggtctcagtttactcctgagcagcagccagttcaatgggccactctgaattgtttcccgaagtttaacaattaaacctgctgagaccaagaaaaacaaaataattaacctttacaaatgtagtagttacaatataaaagttttatttttaaaaaaggtaatgcatgcactgtgtttggtgaagagctctgggccacactacagcaccaacatcccagaaaagagcagaaagcctgctaggtgagcagatgctgctgaaccttgggagtacacttgccacacagtgcccccccggggtacccctaaatccctatggtcagcacatacagcatggacagtatgcttgctcaagtcctgctcaggaaggagaatcatctgacacacaccatgctcactggatgataacaacaatatattccttggtttataattgactgttttgttaacttttaaatcgacaacaatttttaaaaagttaaaacaatcagtgttacatttcaatttatgtaaaaattatgctcctgacaaattacatggatatatttagctacatttcccaattcactgacaataatttacagagactcattgtattccactctgatgatatcaattctggtgaaatctttaataaatgcaaaagttactttgaactcaaaaaagttgtaaattgtgaccattttaaaagtgaaaatgttcacatactgcatattcttatatgacatgctaatagggtcaactaaggattacttttaaaagtagttaaataagtctttttaaacattttctaaaaagaaattattttcctttgtgaaatattaacgaaaacatattttacttatactactacagggcaatacaaacaattaggtgtgtgtttaaaaaggtaacgatcggtaggatgatgtcagtctgacagatgtgatagagtgtgcaggcaaatatagacaggagcaatttgtacaaatctagaatccatttatctggattttacaacattgtagacacagactaccagaatgttttcatcctaacactcaccagcttactgacacctacccagccaaaagctggacccctggacattccctaagcactgaagaaggtcctgtcacagggatctctagaaacaagtggataaatatcttagaggatagggagatatgagaaaatttccctctattaattaggtaattgtaaattattcataagcatgactaagatgtttagtaagtcagtaaatcaaaagaaaagtctcagaaaacaaatcagaataaaagttaaaattgagaggtaaaatgataaagaaaacacacattgaggaatactggtaatagaaggcaggagttttggaggtacaagaaacactcctgtgttatttgtaggtgttcctcgtgtctgtggatgggtgcttcccccaacagatgatcctaggaagggaggctcctaaatgctgactttccttctcaacagctgttctttttttttttttccctggagtctcgctctgtcacccaggctggagtgcagtggcacgatcttggctcactgcaacctctgcttcccgggttcaagctattctcctgcttcagcctcctgagtagctgggactacaggcacccgccagcacgcctggctaatttttatatttttagtagagatggggttttaccatattggccaggctggtctcgaactcctgaccttgtgacctgcctgcctcggcctcccaaagtgctgggattacaggcgtgatccaccgcacccggccctcaacagctgttctgtcatcatgtttacccactatgtttcttcaccagtctattctaagtgtctaatcaggtaacctggaacatattttcctacatggatgaagtaaatatggagtaaatacatacatggatgaaccaaggaggaccgcagtgatcccggttgaatgcatttagtttcccagacccttcatcacaagactgcctcacattcagggagcacaagtggatggaaggaaatcgagagccatattctgcagagcactgaggtaggcgtgtctatatttcttactttatttaataatttttagtattctttaagaattttacagatgaaaaattttatctcaaagtcaccaaagtggcatagttgggattcattcctaaatctctgaactcaagtgtagggctcgtcccagtataatgtgctgcaaaggttacaagtaaatgcttagtgactccagaatgtgctgaatatgttatgtatggttgtgaattcagaggctcaatatccagatcaagtagttctataacttagaatcttataaggcattatttgtacattatttgaaatcagaaaattatgaatatgtttaaaatatttattttaatgaattactcataatttgtatctactctccttctaaaaatgatttaatatgttcttacaatgtgaacacgtacaagtgaaataataaagtgcaaaagaaatattaaaatagggatatgaaaccatccgtgacagtggggaaatgccccagagctttgcatagcatggttaaagcttatgagcaccatcttgtcactctctgagaagatgaggcaactgcagcaggaaaaggctctactgggggagatagctcacgctgcttgtataaaagaaaaatactagttctttaggtaatgcttttctctggcactaggtacataaggtctcatacatggatactgatgaacacaagtgggaaggttttcaaagtcgtagattgttcctttctttgttcctatttttttaatagcgttcctaaataaaaatcaagggcgtaagtcacaggcaggccacaatgagaggaggaggtgatccatctgtggcccaggtatgtttctctatggtgatctaatttgaggccgattgagggtttagacagcaaagaagagggtggcatggggtcattctttcaacagcaattacttcagactcacttgtggcaggagctgaagggctgtcaaggtctagctcctggtcaatgtctggtattcaggtatttggaactgttgatctgcataagaaccacagccttcagatattcaggcagtttctgacaatggttagaaataatgaaaaacctgcgaccattttacttctgcttctcagcaagggaggaaagtaagtagcaaaaacacaggcagaaagaaacttttactgttaaaaaataaaaaagaaatcggcacagaacccagtgtttgggaccacagtgcggaaaaggaacatttagtggatggcgtccccttcacactctgtggaggacccactgatccctggctcttcctcctggatgtgctactgttacaaaagcagggagactaatttcttggcatatttttccacacactctggacaggagagggcagccaaacagccctgcatgcctggaggggtccttctgccgcagggtgggtacagctgagacggctcagaccacgactgtctgctgtccattctccccaagtaggcagtgcctgttctctcacaggttgtgcctggggcctgccttcctgggcagataggaagaccatgccaggacaagagccacacagggctggcgtctgccagcacggtgtctctggcacttgagttgaaggctttaattcagtggccctttaatgtcattttcctctttctgtccctccttgctcctcagtgctggatgacaccccatgatcaatacggcaggtttgtacagagaagtgcacttggtggtgacagctatgtcactggacactgagtaagaaactaggagatccattctatgagctcttccagaagagctaaggatgagcacttcatccagcttgtactttcagcaacgaagatacgcccaacccttagaagcatgatatatgcctgtgccaatcaagccacaatgtcaatcttcctcccccaccccagccccacaaacacctacacacccgcacaccaagcacagctgcaaaacagtccgagccacatcaccagagaggctctttgcttgtgatttcggatgcctcagactggctgtgtgagtacagtctcagcacattttgtcttttaagggaaggagctacttagttcagtgctagttatcttgagataaatatctttaaatatactcttccttatacgtactctttttaatagaataattacttttgttacgcccaagacacacctatgaagtttaagatgtcacttagaaataatatccaaaacaaatgcaaaacacacactattaaattaagccatattaagagagtaaagttttatttcttcagaaggcagaaatgatacttttttaaaaccagctaattaacttatgtgaacaaaagtaaacacaaacagggcccagggaactaataatgtcacctgttccaaatgccagataggtgtctgggtctgctgcagacatttactattttgcatatgaaacaaatcgaggtttgggtggcttccgctaattagagagaaatgcctctcctttccaaactgcatccacccatccatatcactatcccccagcacacacacacacacacacacacacacacttaaaccactgtctaattactctgaacatccacaaggagagttaacgagtaccaagggttaaaaggggctggccagaaaggggaggggagaacaagctgggggaccctccagctgggacctgtttgtgacttctcggcctcactgtttgagacgttctggcatttttattgcctgttgtctcagtgataatgtgcaagcatagagatatattaaaaacctacgtaaatacgtttaaggaaagaaaaagagtaggtcattaaatagtgaaagaacattaattttgaaatgacgtctacagagaatgtaatattttaattttaaaaattgctgtaaaaatatgagttaaggccattattatttcaattgagtacttcagggaacacaatcaaataaataacaataaatgatgttccctgacatgaggagttgaaagcaacctttggtaaactggaatttttctatccttctttgttacagaaattactttttttcatgaaataataaaagggttcatctaccaattttataatagaaaaacgtaatgatccttgttttaaacatacttgatacttgttccatgctaaatacgacaaaattctgtcctaagctgctgttgtgaatagtaaggaaagccaattatgatgtattcttgtaaggattttttaaaaacagttacaaacggctcaattattttcctgttactcacataataatactttctacaagagcatagttcacattaacagcacggcaagttacttgccttcttttcttttctcttttgtgaatgaggacgaagatactgctatcaaagccagccagcccagatgtgctggcactatcctctttctgtgagacgctgtgagcacctacagtcaacagattatttattaggcaagagaagcacttaattctaacttctggctagcaaagcatcctcctttccctattactggacaattactttctcagatcccctctttcaaattaatctttccctcatccatggtcctctctatcccagttgtcaccctccctgtcttctggcagtagacaacaatgcccttggcacagcccacagcacaaacactggccggaatgcagtgctgagcgtagctgggccgagcacatccaccgggctggctagcagggattgcttgttttcacaaagggaacagataatattttaactgtaataattcagtctatatgaactagaataattcagtacttataatttctattcttttgcctatgacttgcatgatgtctgatgtatgtgcccaatagccaagaaaaatgatagttatgctttatggaaaggttgaagaactgaacacatttgttagtaactagactccttttagcattttttccccaatcgctctgtcagaactaactctttttgcagggatatgatagtcctatggataaaatagcccacatttgccagctacttgtgacaacgtccaaaaggggtacaatatatcactgaaacagcccacaaactggctagtcacattatttattacgagccacacatgtgacaaattatttaactcagttgatcctaataagtcaaagagcaagcaattagctaactcggtcagagggctgtttgtggcaatttatagatgcgctcaagctgtcccagcacttcaaagccccattaaggggaaaccttttaatgactcacttgagatgacaagtattacacagcacatatggcagtcaggaatttggcagcctattctgttacactctgcccgcccccagcccccgacagctgtttacaagttttcagtctctgcgccttgctgttgtaagcagccacagggctgcaggagcaggaggcatggtattttctagagcaacaagtggcagtagattcctgtatcacacaggtttctgggaaccgctgaaatccccactctttcgtcagtctgcgtgaactgtttcacaggaaagatagagacacctagacagtgagggacagcccaggtggcattcggcaagtcgcccagttctttaaaggcaacgtgaagctattataataaaaacttatctccctacagggctgttggtagaattaacgaactaaatgttagcaaaatgctttgaagagaaaagggttatctataccagtcctaaagattatgattatgcattgcaacattgctgcctgtcagacggtgtttgcatttgacctcctcccaccgcttctccttcagaaaattttcacttgggctggatccacatccacatccttaattccatcgccaaccatcctgccccacctttggaagaagagtgcaatgccacaactaaactgtgcaataagggaatggaattttgagcaacagcttcccagaaggatgcctatattggggccactttttccctggaaacagggcacacaacaagcttagacactgagaaatgaaatgccagctgacatacttggtaattttattattgtccacaatattcaggcagcactgaagaaactagcactaagactgaaggactgaaaaagacaggaaaatgaagattttgctatgtaaaaagctgagacccaaataccatatcagtgcactaaatttttaagcagtaaagatcctctttatctgtgatttcaagtacttcagtaacgccagcttggtgaaagacaagcttaatcaagaggagaagctggtgacagcaggaaaacacaacaccctaccctgtttggatggggccacaatttcctaagaaaagacaagtgccaacctctaccaaagcaccagaaacccaccacaactcatcaaatcctcttataccacacactcgctttattcacatgaaacaatcaatcgattgtgcctttgtgttccccaaaggccacagctgtattagggccgtggtgtaattacagcttgcaggaggcagacggaccagtgggaggaagggtgaccactgcctcgaacagggcaccggcctccagagacgacctgcttggaggcgtgccaccccacggggactgcacggccacttggcctccggtgctaggagtcactctgttcttgacttcacttttagtttttcactgtggcttgatggagtttcaagtttgttattttgattatatagaaaagtttaatgaaagaaatgttaggctggtagaaagaaatgtgaaaatcaacagatagtatagaaaaaacggtggagaagtgaacatttaagttgtggtttacactttccatttttcctccctaatactccttagtaaaaagagagttggtccccttatactcaagtactatcaaaatcccatgtattatggggcaatttctcaattatattattttgaagaactaagtactacgttggagtggtggagagagaggacatgatagtttgaaataacattaattaatcctagtttccatgcttcaagggtcacacacgacaatctcttcaaaacaagagataaaaatgtagctgtcgttatcctgagtatgctcttataagagttatatgtcagtaaccctttaaaaaagcaatacattaggaagctaggggaagcatgacaatatttaatatacatgtgtatatataaaatacgtatatataatatacatcagcacaagtcctcatatatgcgctgaagactcatggcttgggatggacttccctttggcagcactagcaatggatgtgaaagccctgtgtgaaaatgtgctctagaaaacagatgaccaaaaagtgtctcgtagtaataaagacacagatgatgaggatgtgttaaaggatactgaataaaattgtttttcaaaatgcgagaagaaaaaaccccaatgtttggaaatattttaatgttattttacaaatgtatgcgtagctattcagtaaattaaacatttaaagtcacttgactattttgtccacattcttaaaagtttaaatattcagttggcttagaatatttttttgtttcttctcatttggaaaacatgggactgccccctatttgggttacctattcttgggtatataaaattcaaaataaaaagaataatatccaatagagttctattcaaacaagtcctttgaagttaataaatttaaattaagagaacctcaattttgatgtttataatatttgaatatctctgatttgagatattcacatatttgaataactctgatttaaccaaatacattttatattgaagtctttttttgtatttacacacacacacacacacacacacacacacacacggactggaaagatatgtatcaacaaactctctgaatgttagaatttaaaaaaaatttcaaacatgtataagtgccacaagatgtattacagaaaaattgtagcacactcccccgccgacacacaaataaaacccacagcactatatattactgtctcaaaacctttaaacatcagaattatattggtagattcaaaatcttaagaaattgccagattttaatattcttatcactattcttaaagtcactatcttgtatgtcaagatgttttcaatgggtttttatccttgtaatactgccaaatattttcacaatttctattgtcatatattaaatttactcaaaataataatagcacattgttaatcacatgtttaaaaatatgtgagcatagctgggtgtggtggctcacacccgtaatcccagcactttgggaggctgagggcagcgcaacacctgaggtcacgagtttgagaccagcctgacgaacatggagaaaccccgtttctactaaaaatacaaaattagccaggcatggtggcacatggctgtaatcccagctactctggggcagaagaatcccttgaacccagaaggcagaggttgcggtgagccgagatcgtgccattgcactccagcctgggcaacgagagagcactatctcaaaaaaaaaaaagaaaagaaaagaaaaaaaatgtgagcataaataatgcagtcttctactatatcttcattttaaaaaattatgttaaaaaaattggctgggtgtggtggttggcacctgtaatcccagctactagggagactgaggcaggagactcgcttgaacccggcaggcagaggttgcagtgagccgagatcgcaccactgcactccaacctgggcaacaagagcgaaactctgtctcaaaaaaaaaaaattctgttataccggaaaggacactttctaactatgttttctgctatgctcgggagctgaaggtgatgagaaaaaaagacgtgtttgaagtgaaacataaaagagataatttattgatttatacattctttaacctaaggatgtaatccttacgatataataactaggctctgaaaataaatgtggtgatttgttaaagaactaaacttatgcccaggttgtcaggaggctgtgctctttggctggtagaaaagagaggaggtttgagtagaaagacgagggttcatgcctagctcttagacaattcctgaacttctgggatctttatctccctcacttcaaatggtaataacaatactaacttgtgctattgtgacaactgatgaaaggaggttattcataggaaagccttctggaaactcaatataaatataaatacaatataaatgctagatgtgggacatttctgtttgttagttcaacgaacttttatttggaatataccataaaataaaatgtttccttcctttttgatttctagtaaaaaataagacaattaattctcctatgtaaagaggttctctgatcatctttaccccttcctacagtggacaaaccaggagaaagtgaccacattgttaaaaaatgccctgagaacagttatggctgaaacaccagtgtgatctgacatcctgtatctcctttgttttggaactgtggtgctctcagaagttctggctctggtctctgacatgctggtggacagcagggtaagacttttttccctcctcagtgtcaccttggaaatctgcctgctggggctgaccaccacgtcccacccggtgatggaagggaatgaattcacataacatttcttccatctaacagccagaggcacagaagtctcggtgtgctgttgattcccagatgttcagttgaaccactggtggaaaatataaaagaggccaaaaaaagggaaggattgaaggtacaccttcttctgtcaagtcttccattttcctcttcagaccttagatatccattaaaaagtgcattttggaggaaaaatttacaattaagatacatccagcagagcatggtggctcacctctgtaatctcagtactttgagaggccaaggtgggaggattgcttgaggaaaggagttcgagaccagcctgggcaacatagcaagatcctatgtctacaaaaaataaaaattagccaggcgtgacggtgtgtccctttagtcccaacaactcgggaagttgaggagggaggatcacttgagcccaggaatttgaggctgcagtgagctatgactgcaccactgtattccatcctggatgacagagtgagaccccatctcaaaaattaaaaaaaaaaaaaaaaaaaaaaagacaggtccaatacaggttatttgtaatacactgaagagacatttaaagaatgaaaaggttggcagctgcgttgtttctctggccacctggcacaagggatcttaaatatgtacatcccaggatatgggggtcagtggaatttcacattttctgagagatgcttcatttggaaagtaaaattatacaaattatatgatctaaaagcaaaatatttttgctatttgaagcaaacttttaagatttagaggttagccacacctatgtgctctcttcagccctcttggccatttgattggctacatccttggtatgaggagatgtaacatataactgtatgtagaaatgtcattctttaagaagtcctgctgggcgcggtggctcacgcctgtcatcccagcactctgggaggccgaggtgggcagatcacgaagtcaggagatcgagaccatcctggctaacatggtgaaaccccgtctctactaaaaatacacaaaaaattagccaggcgtggtggcgggcacctgtagtcccagctacttgggaggctgaggcaggagaacggcatgaacctgggaggcggagcttgcagtgagccgagattgcaccactgcactccagcctgggtgacagagcgagaatccatctcaaaaaaaaaaaaaaaaaaaaaaaagttatccaggcaaaacaatcgatgtgaaaatattccccaaagacatccttccagttttacaactatgggtcttccaaaagattctaggagatgttagccctcagaaatgctgacaaccaaagggggattcttggctctacggatgtgcccaaagtgtacagacacagacatgtgacatcacagacatgcgacattcattccggtggggcaggctcagacacttctgctggccatgcgggaatctgcttgtgtggaaaaaagaaagtaacatttacagaagtgtgaggtgcaaaatgcaaatgtacatgttaatacctgacagcaattatttaatacctaaaaatattaattatcagtaaatataaatatgaagtataaatgaatagagtgtattttctatagtatatagtacagtaagtgattggatatacagaaaataacacttaagaatatcatttaaaagactctaaaagggtgaagattttcccagcagatacatactgaaaaaagcaaatgacagaaagcagggtttgaaagagccccagccttttctaaatatacctgggccctgagctatcatcagcctcaccactggtgattatacttggtttctgcaagcatgtttctttgttacacagtgggcccagtgaaggcagaggctctgctgtattcatcctgttgtccatccccagagtgaaaaaacagtttcacctaatggctggtatttttcaaatagttgctaaataaatgattatacaaagttgcgataaagattaaaaagaagaattcaagaattatttcccaaatttcattacagacatggaaaataaagtaattatctggttattttctatttaaacaaaattaaaattaagtaaaaattaaaattgggtataaaatacagcaaaatatttacatacaagtgaggaggacttgagcacaagaagaaaaaacattaaatacgctactaagaaaggtggtggaatttatcagcattctcagaaacctttgaaataaatgcacccctcgcatagggtgaatattcacctgctaaggagtcaagcttgctgggtgagtaaacttcaagtgacttcagagcccctatgggccaatgagccaatatgggcacttttatactaaataaaacagaattataagccaatataggcatttttatgttaagctaaaaactaaatatttcttgaagacagaaacctattcttatttcttattatgttaccaaaggtttttttttttttaaagaatattgagatagagagaagtgcctttcactatagattttctgatttttactcctctgtgttaaagcagtattgaaatctgtagtactgggtggtaatcatgctaacagaataatccactgactcttttcagattaaccaactcagacatctgttgtatttctaaagcatctctaaaaactttcctcacatatagtgagatctgatctcgatatcgtgtatgagacctcagagatagtacagcctttctaggatgataacatttttgaaccctgatactgtatttaagggtataagaggcacgacctacactgcaagaacacatgacctcgtcttacatatgagatgttaagggaaattaacaaagatgataggagagacaataaactgattttattattcaacgtatatctgagttgatttgggagaagaatgaataatgataaatgatgatgaatatttcttaaatagagtttctattacaggagtagaaaggcacacagtaaaaataaaaagaagaggaaggtaaagtcacaaaagtattttactgttataaaaatttttaggctgggcacagtggctcacacctgtaatcccagcactttgggaggctgagatgggaggactgcttgaagccaggagtttaagaccagcctgaacaatgaaacgagacctcatttccacaaaaaaaaaaaaaaaaaaaaaaaaatcaccaggtgtggtggtgcacgtttgttgccccagctactcaggaggttgaggtggaaggacttcttgagcccaggcatttgagggtgaggaggccctgatcgtgccactgaactccagcctgggtgacacagcaagattttgtctctaaaacaacaacgacaaagaaatttttaaaaatgtaagtgagctacgttgagggcttactactcttgtttaactcaacactgctgagcactcttcctttccctaacactgtaagtttactgctttggttcctagccattgtggttaacatccaaatagctgctagagttggtatttctgccagggtaaccagcaagtatacacttccatgctacctttcactgtgaaagcagacgagcaatatagttgaccctaatattttcctaattctaactaacctccattaatatacttcaaaactctttagaaacaaagataacttcagcagcagaaacaatggccttatgttccaacaatggccagctggaaatgtcaaacactgcctacccattataatatctccacctgtatttaggtaatcactgaaatgaatatcactactagatagacaggtacttagtagaaaaattaaactagaaagaagggtatgaattgttgatgaaatattaaagtagaaatccaggataaagaaacaaaagaagaaaatcctagtatcttaaaaataatagactgcaccaaaagtaagatcattccagcactgcgtttctgagatgaagagaaaatgttagaaaaaggtatttttctatcatcagtaaaaaagacattcaactattaatttaaaaacaggcaggagggaagtgggggcaccgataaatttaaaagaccaaacacaattagaaaagcagcctttcctgcagaaatggaacaagtgatacagacaataaacttggaatgtatactgagaacatgggagaaacaaatgagcagacaaaatcaaataggagaaagtataatatttcacactatattttaacccatttgtagccaagcttgaagaatctaacttacaagattcctctcccccaaaaaatcattaaaagattaaaaagaaagaaagattgaaaattaagatgacttactttctaggaaaaaaggagctgaatataggtttaaggattttgaactgcctaaagcatgtcaccataaatctgtcatgcagccttgtaagagcattactgatgtagtcaaaataagtgaatctgaagaaataatgtgttctattttaaactgcaaagatgtggttaaagtacaaggcaggtatacgaggcaaatcaatccacacacaaaaaaatgttctgttttcagcaaacttctcatctctcattccagtttttcaatgggactcctctaattctcatcccagaaatccaactgagttgactggaaataacaagattcggattactcaaatgaccaagagcatctactttcctgcaagatgcacagcaggatgaagcaaaagacatcactcaagatctggcaagatgaccaacagtcagcgagagatctggtaagaattaccattagaaggaggcagacaaaaccttccagaaccacagacagcagtaagattcaaagtctcacaagctacagtaaaactcacagagtttttccaagacaaggtcctatgtcaccaattcttggtccacaaaagataatctaagtgattatttttaaatacacatgtaagtaggtttatttctggtgagtattttatttttagaacttcttttctaaatcaatgaaggaaggcatgggcttaaaaaacatggtgtggtattttcaaactggaacatacagtttatgctgtctaaattaagcatatttagcaggcatctggggtctgagaattcttcatagcccttggtccctcagagctggaggcagagaaaactgacatacaatactctcagtgtactgcaccaaagagctatttaattggctttttaaaatggatatataatattgcttagaaatgcaaatattggttaaaattcccagtttagttgagcatgcacaaggatatatgcgtgtgtgtacataagtacaactgtatacactcaaatatgaataaatggctagaatgaaataaaccaaagtgtaatgagaggtgctcttagaatagtatgacaagttaattacaagattccatattttgcaattagaataatcatgacacagaatcaattaaacagaagagagagaaataattaacgaaggactttgcatagggagttaagaaagaaaaaagaaaaaaatccaatcttaagaactcaacgtcataagcagtgtctagcagagggtcagtgagcaaaaggatccaaacacaattattactgctgattatctaataagcactaatgtggccacagacaggatatttaaattccacatcatattgtcttgaagtcattatctaatggatttataaggataaggcaacatgacataatagaaaactcatgggttatccaagttcagaattccccggtctttataacttttaggcttagctccaggtttttcctttggtaaaacagaacaaatctctatcacgagtgattgttgtgaggattagaagaaactgtgtatgtaatctagcttggttcctcataggaactcatatcatggtaggtatgctggcagtactagcatgagccatttcctagagaaaaggattactctttttgcatatgtacaatttgtggcattaaaaacaaatatataagtaggactttgatttctttaaaaatataattttatgggccgggtgcggtggcaatcccagcactttgggaggctgaggcagaagaatcacgaggtcaagagatccagaccatcctggccaacttagtgaaaccccatctctactaaaaatacaaaaattagctgggtgtggtgaggcacgcctacaatcccagctactcgggaggctgaggcaggagaattgcttaaccctaggaggcggaggctgcagtgagccaagatcgtgccactgcactccagcctaatgacaaagcgagactccatctcaaaaaaaataaaataaaatgataataataattttatggaaatcacaattgtccatttatcttttttatacattgattaatggatttttaaaaattaaacaaattaaataccttaaagacaatttgaataaaaagaaccttccacatatattataaaatcatagattttaaaagctagaaatactctcagatacatgagctcactctaaaaccctgttttgctgaaaaaaatctaggtaagtctaattttcacacacatacatatttaaggagcagacacagcactacaagtcagctcccctcgtactgaaagacatttcctcctacttaaaaatgtacaaattattttgtgtgctgagccaagcaatgaaaaagcttcaccattaaaacatgaatatttaaattttaacatttaaatatatctaaaaggaattttgaccccatatactttgtttcagtattaaccaaataaagggcataaactcaaacacattattacacatttatttaatcaaaactaggcatttcccaatcattacaaaatttattacctagttttaatcccagttcatttagaatagatggacagaacatggccatctatataatatttattatacaatttttaactagtaaagattttgatttaatgtaattacaatcagagcgagagcctcaatgtaaggaaaaggagccacaattaaaccacatataggaacctgaaatagtcatttcctttctccccatatatcttacttttctaccaaatggtcccaagtacccaatcaaatatctatgtgaaaagcagatcaatacaaccattcattaaacttatacagttgagaacttcccttgggagaattatccaaagaccaaaacactgccaacaaaggaaaatatgatataagagggcaatttatatttaactcaaatgatcacacttaataaaaagcacaaatcccagagttctaaggggaggaaatgatgtagcgttaaccagggaaagtctacaaataggactggtggtcagctatgtcttcaccaaagtggcatttttgccaacaagactcttggcagcccttaaggggctaagctagcacaattgaccaaatatggtggggaatgtgaaaacttcgcagatattagcatttatttttgaggctaacataacacagtccacaggcctgccatcagagcctgcagccattaagtgataactgaagcagtggaatgcaaataatccattggttcacattagtgtcatgctcatttgtaaatgttcccagtcctcttctggcccttagggtacctcacttgcattttaggggcaaaacccatgggcagtatatttaaaaaggagttaaattatgagcacaccagttagcaatgatttactcattaaaaagtgcattaggctacggtgccctgagctgcgcgacctcatagctgatcacttctaaaatgcttgaatagacattatttatctactggcagtggcccaagatttatctatttcagtcacaaagttctatcatttatctatacgctccctaactcaatgttaaattttgaaatggtgatttaactataggaggaaactacattgaaatgagtgaaaaatgaatgtagcactctgataaaacaggagatatttaagcaatctggcacctctcctctgagatgttaaaaggatgttttaagtaatttatgaatttaaggggataaagccctcgttatggagaaacaaggtcagaagtctcagagcacttgacccagagatgccattttggactcctgattctggaaaagagtaaaactctgtaatttattagaaaagcctgcatggaaattaatttacagcctagttatctccatgttacagagataaatataattatttctcattttgaagttgaaaaagaaaagctatcttagaataagtggattctcccccttactctctggttctgcttgtttatctttatcatatatcaaattaatgtgccacaaataccagtgaagaagtgaaatgtttaatctgaactttatttcactttctcacaccaaggaagagtaggagaaaccatgggagggatatatctaaaccgacattggctggagactacaaaggcaaagaacgaagtgttttcatagtgctaagacactatgctttagtttataaagatcacagtggaaagtgacgtgacaaggtcgtgactgttccttggtctccgaggttgcctaagtattagagggcagagtccaccttgtcagtctgtgggctgcccgcttcccacgtttaagtgtctgatgttaccatctacttgctattccctacgggacatcgctcctcctctggtatggaacgtgaagaccacaaaccttgtttaaactactgcagtggcaggctggcctgggataccatgctgcatccagccgcaggcagaggggccaattttaccctttcctcttgttccacagctcaaaacaaaggagtcttctgaactcaccaggctgcactgacacagactgagtggttcccagaccgctctgattactgctgtctgtagaaacgtgaagggcagggtaaagtaaagtgactgagccgggaatcacagcatgctattcaatctgaatgtttctgtaattcataaaaaatttcctgcttggtcatttgtctgagaaaagaagaaaagttatgattttcctcctcccgtcctcccaaaaggtaaaagcaatgccaagaatgtcctcttaaaatataacattaatttccaacttgaagaacttagcatacttccatcaagttcaatctccattagaaatccactgggcatatacttttaggacctatcaaatcattctttctcagttgtgtaattctgtcggaattttactctaacaactaaatatcaataaaaaatgagaatgaccagaaatgacacaaattttattctgtgataaatcaaaaaatgtcacatatcatagatggaaataaaacataaattagagacccagttgttgtgaatgcaagtagattttatattattaagacatttcatttacaggggcctataaatctaatagttactttattagcagcattctcaataaaaaatagactactagaattactaatagcattctcaataaaaaatagactgtaagtgtatcttactgagcagttttgtaaggaacaatgaccaccttacttatttaattttaataattacactgatttttttaaatcaagaataaaaacaatatttatcttatatttatcaacaccagtgactcagggaacaaacactaaagtttctgtgtcagaggtaataatgtctggttattataataagaattagatttgactctttcagcaaatattaaactttttttccagcagctccaggctttaatttgaaaaatgattaaattagtagaactcattcttattggttagctctcactaacaattggcagattttttcttatttgctcttagcatttttactctgagtagtaaaagtggtggcaactgctgctactactttcaattgctgagcaaacttacagatgtgccaggctctgcacttatacagatgttctcatttattcatcttcaccaccacatgacataaatacttctatcagatccatttcacagatgagaaaacagacatgtagagagggtaagcaacttgtcttggattcaaacccatgaaagtctgttgtagggccctgttctttaccacttagcagctatatatattattcaataatacctttttgataatcttaataaaaaccttgcaagtagatatcattaccactttagagatgacaacgcatacttggagaggtttacaaaattttgccaaagctggtaaaaggcagtgctggcttctgagctcagggtaccaggagggatcttacaaagactccaggtgttagaaggccatagatttggaaacactttacaaaactgcaagttatcaacgtttctaggtatatttttgattaagtaaaaaaaccccaaatttacaccgaacatatttatgttcggctacctccaaaacaggaagaaagagctatgaaggtgagaatgaggtaccacgtgtttataataactggatccagagttttattctgttatgaattttcttctgctctgccttcattatcaatcatccttctctaccggttcctttccttctgcctttaaatcttaagatttgctcttctaaacaatgtcattgtcattagcaaaaacaaaacctttcttcaaccctcagcaatttattttcttcttcctcccaaattacttaaaaactactccatacaggtattcttcagtatttacagaggatcggttccaggacctcctgcagatacaaaaatccaaggatgctcaactcccttatgtgaaatggtatagtaattgcatataacctacatgcattctcctatataccttaaatcatctctagattacccataatactaaatacaatgtagatgttatataaatagttgcactgtatttttagtttttaggtttttttgttttgttttgttttgttttgagacagaggctctgtggcctagcctggagtgtaacggtgcaatcatggctgtctgcagccttgaccgcctgggctaaaatgatcctcccacctcagcccaccaagtacctgagactacagggatgtgccaccattcctggctatttttttattattattattattttttttttttttttgaagagatgagggtcttgctgtgttgcccaggctggtctcaaactcctgggctcaagctatcctccccatattagtatgttttcacactgctataattactaagactgggtaatttataatggaaagaggtttaatcaactcacagttcagcaaggctggggaggcctcaggaaacttataatcatggtggaaggtgaaggggaagcaaggcaccttcttcataaggcggcaggaaggacaatgccagaggaatgaccagacacttataaaaccatcagatctcgtgagaactcactcactatcgaaagaacaccatgggggaaacgacccccatcatccagttacctccacctggtctctctcttacacgaggggattatggggattataattcaagatgagatttgggtgggaacacaaagcctaaccatatcattctgcccctggtctctcccaaatctcaggtccctttcacatttcagaaccaatcatgccttcccaacaatcccccaaagtcttaattcattccagcattaacccaaaagtccaagtccaaagtctcatatgagacaaggcaagtcccttctgcctagaagcctgcaaaatctaaagcaagttagttactgccaagatgcaatgagggtacaggcattgggtaaatgttcccattctaaatgggagaaattggccaaaacaaaggggacacaggtcccattcaagtctgaaatcagctgggtggtcattaagccttaatgttccaaaataatctcctttgacgtcatgtctcacatcaaggtcacactaatgcaagaggtgggcccccatggccttgggtactcccaactaggcctcccaaaggagggctgggattataggtatgaaccactgcacctggtcagtatttaaaaatatatatgtatatattttgctgtattgttattttttattgtagaatccatggatgcggaacgtgtaaaaacaaagggctgactatgctactttccttaagccttcactcattctccacacactcattaaaactttgtatgtggcttccacctccactggatctatatgaaaaacagcgacctcccaaacatcaaactcagtggctcgttgagtcattccatagcatttccctttgtgactgcccattctgtaaacctgcctctcttccttcactttcgttattctgtgccatcctggtttcttccttatctctcaatcattcttctaccttcttcttggtccttaaaaaaagagccgtgctcccaggttctgcattccaacaacttcactgctctccctccctccacattctccctggacagttggttcacttccacggcttcgactactcttccatgcaaggaacttcacgtttccctctggcacagacctctctcccaagttccaaacgtccactggattttaccctggcatttattcttggtttcttaagatttttactacttaaaaaaatcttcattgatatataattcacatacaaacagattgattttagtatactcagggagtcacacaaccattaccacgatctaagtttagaatacttcatcacccaaaaagaaacactgtacccattagcagtcgttccccatttctggtacctagcccacggcaactacagtgtactttcagtgtctatggattcttgtgttctggacatttcatataaatggaatcatataatatgttgccttttgggtctatcttcttttacttagcataatgttttccaggttcatccacattgcagtgtccattagtgctttttatggttgaataatatgacgtattatggatgaattacattttatttatccatttatgaattaatggacatcattctaccaaaagttccactttttggctattgtgaataatgctgccactaggatccctgtgcaagttttcatgtggaagtatgttttcatttatcttaaatatgtgcctttcttgaacaccgagaaactgtcaaactgctttacaaagtggctaagctgtcttacattatcaatgcacgagggttccaacatctccacgtcatcgccaatacttgttacagtctgtcttttttatcacagccagtctagtgggggtgaagtggtatttccctgtggttttgagcggcatttccttaatgactaatggtgcggcacatcttttcacgtgcatgtcctttcatgtcggctgaatattttctgtggggaaatgtctatttaagtcttgtgcctatttttaattaggctgtcttcttattcttgagttgtaagagttctttatatattctggatactggccccttatcagatatatgacttgcaaatgttttctcccatttggtaggctgcttttttacttttttgatggtgtgctatcagaacagtttttaactttgatggagtccattttatctattttttccattgttgcttgtgctttaggtgttatatatctaagaaggctatgtctaattaaagttcaagaagagtatctctcacctgtgttttcaatcaatcagccttggaaatctggaatctgcctgtaatgtaccttttaccaaagcccacaataaatccacttttaattaagcttttaacacttcatatgaattacttaaaaataacagacacaaatttagcagggtggattaaggttcaatggtgttttcaaaagaaagtgttactattttttaccccagccgtgtcaatgtgaacagttgatgcctcaattttagcacttacatttccagctaggatccattttgagttaatttttgtgacgttccttccccactgatttgtctgggtaccattgttgaaaatcaaccaattacaaatgtatgggcttatattttaaaaatcaaccttattttctttcacaaagccaactcctgatttttactggtattgccatctattctcctggtctgatacataaagccatctttgattcgttcctttcctgtgcctcccccacacaggcattagtcaaaccacgtggtttccatttctacaggttgttttcactcatcctttcctttccattttcagtgtcattatatcaaatcaaatcctcactactgctgtcttcagaagggctgagaaataaattcatgtctaaatgggcatactgtgctgtccaaatccaacctactatacagctagtggccagagaagaggagtttaatgtgctgggataagaaataagctggtgctatgaatggctgtgtcagaacaagagcccagcccattcatattctagcctaatccctgaacttccagagtagattatgctaatttggaaaacaggggcagtcctggaggattcaaaaatttccaagttatttaaaagaaactgccacttagtattaagtacttgatctcctaatttaacaagagaggctaatttttaaaacttggttaccacttccttagtgttaggtcaagaagaggacgaaccgctagggcagtcattcttaaaatgtgggagcaagagtagcagcatcagtatctccagggaacttgttaaaaatgcacattcgtgggtcccacccagatctactaaatgagacctctgggagtgaagaccaaaatcagtgttttaacaagactaccaggtcattcctatgcacactagaagtttgataaccactgagctagaagacagatgaggatccagggctgaggtcatatgacaatatcaacacctcttccacatgctgaaattgccaaggaggccacagaactccacaaatcccatcgactgtaaacattcagtagttacgccatataaattgttaggatccatgcttaacttctgaaggtagcataggcttttgaaattattcaaaatttagtgttctcttaagaaaaaaactataaataatatacttgcttatttttataccacaaatcccacataacagaaacaacatagtagagatgtaagtagcacctattattaaagtatgttcctacttaaatatgacatttcttttctctcgggggagactgaaatatatatccaaagagaaagccacaatacacatacagcttttacctagaaatatgtcttccctagacttgaaatccatcagccttgggaatctggaatctgcctgtctgtaatgcatttcagtaacaaatctgttaccaaaacccactaccataaatccacttttaattaagcttttttctttttagatggaatctcgctctgttgcccagggtggagtgcagtggtatgatcttggctcactgcaacctccactacccaggttcaagtgattctcccacctcagcatcctgagtagcaggattacaggtgcacaccaccatgcctggctaatttttgtatttttagtagaaatggggtttcaccacattggtcaggctggtctcaaactcctgacctcaggtgatctacttgccttggctcccaaagtgctgagattacaggcatgagccaccacacccagccttaattaagcttttaactccctatatgaattacttaaaaattaactattggatctaacagacagacacaaatttatcagggtggctttaggttcacagtgtttgcaaaaaagaaggtgttaccactttttacccctagctgtgtcaatggaacagccaatgccttggcctactgtgactggacacgcattctgacttgcagctgcagtttcccttcttatggctgctcccagataagaccgctgcacagaacccagtcctggcaactgctgcctggtcctctccagcggcctgtgcagagttccacactagctccttgtttatatcagtcccgtaattaagccagggccaggaagagaagtcccaaagagggcaacgaaagtgcaaggcaaagaactggctttcggctgcagcttccccatccacctccttcccacctgacctcaatttaagagagtggaaatgggggcccagctgggaagaaggaaggagcatgagcagagaacaacagtttctcatctctggttttttgttttcttttttttttttttttttgagacggagtctgactctgtcacccaggctggagtgcagtggcgcgatgtcagctcactgaaacctccacctcccgggttcaagccattctcctgcctctgcctcctgagtagctgggatcacaggtgcccaccaccatgcccagctaacttgtatttttagtagagacagggtttcaccatgttggccaggctggtctcgaactcctgacattaggtgatccgcctgcctcccaaagtgctgggattacaggtgtgagccactgcacccggcccatctctgttcccttactgctttgctgccgcaaccttctccatcctctttttcattctcagttgccattttgagctttcttcacaaattgaatcctgttttccaaattggccagtgaaacgtttttgccatgctgaagtcatttccagagctaaatcgggaaagctgaggcagccaggccacctccagctggctggaatgcagctgcaataaaaggcagtgtgaataaggtgtattgaagctacactggactcgtgtgaagggccgtttattcagagggggtggaggtgaaaggagagaaattaatgaacagaagaaattaaattagctcaaccacgcctttaaaaaatatactgaaaaataaccgacctgccatgaacctttttacaaaaatggagacctctgggtctgttctttgcccagccccgctggcaggaggcgctcctgagttagataagaaagagcctggaggggctgaggaaaatctggtttctcttactgcagccagaaggatggaaggcacagttgggaaagtcaatatgcagctgagagacaagaggtcaccggaactgatgaaaatatttaattaactaatcacagaacacctgacacaaaaataaacatgtcttttcatcttagctatcacatttttcttcaacaaaatgaaatcacgacctatcatgttctcaaaaagttattgatcaatttatgagcctaatgctttaattgattgcaataatattttactcacacttctaatctgatcttactgccactctaagaaaagctatggggaattccaatggaagaatgatggtgtagttacaagcaaaaagtcctttatactagacgtatatttcatattttgtgttataggtatttattttatgttttatattataggggtatttattaggacagtgttatggaaaattattccttccttaagtaaccacctaattttaatattaaaacatttcataatattaaaacattaagagaacaataatgaatactggtattaaatatcttaaatgctgtttagtgctttctttacagtttcaaagtgagagcacccgtttatctcattttcacctaaatgtgtcttattacatagagagtgagatgttatacctattttttaatttccacaatcagatatccagtaagggaataaatgtaaatcaagtaccacaggatattttgtcaaaagcattatagagaaatgggatggtaatacaatcatttttttaaaaaattctgttttatacaaaagactgagctccatggagtttggaggttaaatctaaaagtactcttaggtatggccccattgtctatagacactaagattaaagcaacagacatttaggaaatagttattagttgaggtacgggattttactttattacctactgaaaatcttaccctcaaaaatcacatcccctcaaagtaaattccagacaaaagatgttctttttccccctttagggtctacaatttatcaaccggttggatatcttctagaattactttatattccttcccatttgaacacagcacactctgaacctgttcaaaggtcagacaggatttaagagtccttataaggcattgttgtggcaggagttggcacttggactaactttatccgatgggcaacgagtttggggagtgcctgagggtgtggtacctggcttgcttgcccttcatgatttttgatgactgcccagctaaacctgccttccgtccaccatttactcatgatgtgactcagaacactagggtttcttggaaagatgaaccgtttctccgctgcattttcttttaaacctttgtgttatcttcctctggtcaaaatgaactatagtaagcttaacaaaacactgccaagctatcatgtgtagtggggtcagccaaaaaacagacttcagctatgcattgcccactaaggtaaccagtgaccacatatgaccatttaagataatatcaattaaaatgatacaattaaaaactgagctcttcatgtgcataggccacactcaagtgctcaatacacatgtgtggccagggatactgtattgaacagcactgataaagaacatttctatcactaaagaatcttttattgaacagacgtgctttacatgattattcttcccaccttctatgtaaactctggtcattatcaaatagaaatgtgtaacaaaatgaacatgcacgccagttatgccctgtcagtttgaaactagtatcctgcccaataggttttgtacatagttctcagtttactcaccacttggcccctctctttgtttctaaccagaaccaccagatacagagacagatccagagctgacctaagtttaaaacataaagcggtgaaatatgccatcagcttcttctcctactcctttctttccctatccattcttctactcaactattacttaccgagccacagtgcaggcactgaagctacaaagctgagtgattcatcgttcctgacctccaggagcacaatctaatgaagaatatggaaaaggaaaaagaggaatttcctaagggctccaataaaggcacaagcagattgggggagcagagagcttggcttgaggatgattatgtaagggctggagctaaggcagagtttctcaaacttggcactactggccttttagcttggaccattcattgttgccctgtgtatcggaggatgttcagcagcatcctcggcctcaacccattagatatgtgcactccccctaaaaactgtcgccagacattggaaacgttccctgggggcaagattgctgcctttagagaagcactgagctaaggcctttgggacatgtttgtttatttactccataacattcttgaggaacttactgcaaacaagtggtgagaataacaagagggaaggacaaagtcctcacacgaaggacctcaaagtctggcgggaactagagtggacaaatgggcaaaggagaaggtgacttcagaacgtggggaaagcatgtaagaaagtatagacgactgacaaatccggggaatctgacagcggggaagggggctcggtgctgggaggagagggggtgtcaggtgagggccatgtgaggcaggacccatgtgaggcgggagcagagtcagatcatgaaggtgttggtgtgctgcaggggttgtatcaaagttagatttcatcgtgaagaaatctgaacaaaggaatacatgggcaggattaccttctggatggtggtgtagactctgtcccatcaaagtgtgattgacaaacacaagtgccatcaagcgtctacactgcagacagactgactgggagtctttttccggttaagataacaaggttacaaatcacaggtgatataatagggatgaacagggagacagggatttgactgatgtctctgggaaggacagggctcactgttggtgttgtagggaagacgagggcaggactctaggctgatttcccagttttggggcaaagacaacaatgtacatggagctcatatcaacaaaggtgggagattcgggaggagcagcaggtgaacaaagaggtctggacaagggaggcgaaggctgcttagctggttagggctgctgtacctgctgcaccacagactggaaatccaagatcaagacgccacaggtttggtttctcctgaagcctcatcttggctgcctgatggctgccttttccctgtgtcctcacatggcctttcctcagtgtgcacgtactcctggggtctcttcctcttctcatgaggacaccagtcctattggataggtccctaccctaatggtcattttaaattaatcacctgtttaaataacttatctccaaatacggtcacattctgaggtactgggggttagcatttcaacatctgaattttggttggggttaggtggcaaaattcagcccatagcagaggctgaggatggcatcctggaaagggagcttaatgtggggttgagagcatggttaaattgcgtggagtccaggttctgtctcctctagctttgggacctggacaaattgtatatcttgccaatatttaagggacaatctgaagaaacaaagtttgtaataaagactgaaaatgagtggccaagaatgttctttacctcaaacatttatcagttctctgagttgggagcatctcatttctcttttagctactttgaaatacacgataaattattcttaacaatagttattctactgtgcaatcaaacactagaacttatttcttctagctacctctatgtacgtactcattaaccaacctcttttcatccctcgacatgacctgtccaatgctgaatgatccctagacagcctttcatgcaaaagaagctcctgataactgaggttatctaatgagtcccacaggctggatctactccacggccacccttgccatcctggacacctatcctggccacccttgccatcctggacacctaccctggcctcccttgccatcctggacacctaccctggcctcccttgccatcctggacacctaccctggcctcccttgccatcctggacacctaccctggcctcccttgccatcctggacacctatcctggcctcccttgccatcctggacacctaccctggcctcccttgccatcctggacacctaccctggcctcccttaccctcttctgctcagggttctccactgggtggcaaatcccaccccggaagagaccctggaggcctttcccctggcttcaggccatcataaaacttactaaattttgctaaagaaaatcaccttctaaataaaattatttggcaatttaaaaatcagaattgcaagataccttagaaactgcctagttgagtctctttaagatgaggaaactcatgcttgcaggtatagacagctctggtgccagtatgtttcatacaagtgatgtgattacagtcagcccattcgcttcctagggtccaacctccttttctataatatgggcaaaataatagtttccaccctccttgtttggagggcatttaccagttcctaagtctgtaggggcgcagcagtgaaaaattgcacaccagtcaagccctcctgacctcacagtctagcatggaagaaagactttgaacaactaaccacaagtgtcctgtcagttacaaaataaaaaacaggatccaatgcaagcttgggaatgagatgccaatgtaatatgggggatcagaacaacttcctgcggggagatgacactctaaaggaaggtgctgtgagaatcaaatcccagcgtgtattgatctaagagatattccttcccacctatgctgggccagaaagtgtgccagtggctggggatttccaatgaacaggactgacggggctcctgccctaacggaacttacagccaacaataaagaacatcatggattacacaaataatgaattaattacaacggcgataaatgtcataaaaggaaatgaaataatgtacataacagtgcttcatgagctttcgcctgccttataaatgctcctctgtgctaagaataatagaagtggcaatgggagaataaagttagaaagaaagcttcctttcttcctgctttcctctctccctcttcctccttttctccatccatcctgcccgtctgtctggggagctggtaagatatctcttgtgaacacaccaggcacatggtaaataattagatagtcatttatggtgttatttttcttctccaatcttacttagaatgtcagatttaaatgttatcagtgtttgttttgatttgtgttttttttttttcctgcatgctttgatccatcagaatgcactggcataattagtaatatctaactttattactaggagaaaatgtaagaccgtggtccccacgcgtcctggctaaggggactaaagtgagtagcagttacaatgcttgatatggcaaagtggaataaaggtgacccatggaactttttaaggagtagactccgttcaagagagaagaccttcgtcaagaaagcctggtgctatagctgcaatgaaccaagagagaaagccggtgggccattccaggagattatggaagaaagtagtagttttaataagttcactataaaaaatattacatttcaaagccaaaaaacaatctcctaaggcttcagtggaaacttagctcacactgttttgtaaacatgacctaatctttatgaaacgctgcatcatttggaatttggcagtgaaggagtagagcaaagagaacacagtcgccactctaaggccccgtggagacctgcaacagggcaccctgtcgttagctgctgaagaaagtccacacatctgcctacacactaaagagaacacagtcgccactctaaggccacgtggagacctgcgacagggcaccctgtcgttagctgctgaagaaagtccacacatctgcctacacactaaagagaacacagtcgccactctaaggccacgtggagaccttccacagggcaccgtgttgttagctgctgaaaagtccacacatctgcctacacactctgagtcaacgttcaaggcttaagtcactctattttctacatgaactgtcccttccctagaaagtcaagcttggaggagcagggagccttatctgggtcagaggcatcgctctggagccttcttcattggacggggagaaactagggttgtggggtgacctccatggagttccaacatagaggtaggtgtggatggccacgcaggtagaggcagctcctgagcagatgctgctaaaatttcacaatctgaggcgttatcatgcagagtctacagtgaacaccgtcaacaatgcgtgcaggaaaaaattttaaaatgtctgatatgctagcacataacacacaagcaccaatgaaatccatctttttataaccacttcaactttaagacctaagcctttattacgattaaaaatgtgttgataaagagcccctgctgttaagtctgatgtcaaatttcataaatcatgaagtttttaagataacttctactgaagtataatatacaaattaaaaagtacacatatcacaagcacatggcttgatgtattttcagaaactagtcatgaagttttatggccaacttctactaatctttcaaataatgtgacaagaagagacagtttggcatagtgaaaaggaaaaaccagtagccagagaagctgctgggtcattttacttcattctggctctccgacactggataaatcagtgacttatttcagtcttcatttccacatctaatcagagtagacaatttctaagtgtaccttctagtctaaaatgttatactttgaaaatgtatgttcccttaactgcaaaaaagcactctcgatgatatcactcacagtgtttcagacgactcagttatgccaacatgtcgcgctaactcactaccacgcaagggagaaagtagttatgctgcaactttttccttcccaggccacttcctaatacatttactagcaagaaaggcatgtcttcagcaaccatccacgtcagagaacggcgaagcgctggtagcagagcgtaagcagcccttgggtgcctgcacctgctttccagtgagccttttagatgtggctccctggttccgtggctcccggctctcagctcctgggggcaagcatgcctggagtcgccacatggtgcccaatattccgggctacagagatggcctgtgctaattacgatacgtttctctccacgaccgtggaacataattctgatgttgactatggcaagctcttaaagtcagccttttctgaattttaacaacgtgttactacttgggcttggtaacgagatgttcttgctcacattgatcaaaactacattaggtctgttaagtcagcttttcatcccattgtaacaaaaaaaacatagaaaagaaaaaatatataatgaaaaagattctattaggaggtcaggccacctattttaaggaattgcagtaactccttcagatcagttgaagaccccatattatggtttccacaaaataaaagggatccaaatacaaagagttaacacattttccaaaaattcttatatgctaggagaattttgttgctctttcccacaaggctttttttttgaagctcagagaactctactgtggcctttgatatgtcatggcaatgactcaccaaactgtccctaactagtctgaaaagacacaggccagcctttgctcattcagtgtatactgagctcatcctatgtgcttgttactaagttagacgctgaagaaacaaaatgaaacatgcattcttgcccttaacaaaccagtcatccatctgaatagggaaacacataaacaataagtaatcagttactgctatggagaccacacacacagaggggagacagggaaaagggctactgtgggtgctcagatgacttctgcgcaatggtaaaggatacagctttatttaaacacgaaaatacttcaaaattaaaatacaaaagaacaacctaatggatgcgaaaatctggggtgaaatatcacatacgctgtgccatttaccaaatgccaactggctcaaagttctagaagtgtgtaattaattctgcacattgagaattaagtatgcaagagtatttaaaatcggcaatggggcaagcttatttatctaaatttccttgctcttaaaatctagtcctcattctggagacacattgtcctaggccattcattctcacttgatgttattaaaactaaaatatagaataaaaggcaatggtaaatacaaaagttatttatggactaagtaataaagcatgacacagaaacccttctaaaaacataaattatctgaactaatggaaatgtaaatttgtagtaaattattttttctagattactgactaaaataagtaaagggtcctagaggaaaggccttaaaaaacaaagtatcatgctgctagatccttaataacccaaaatgatctaccagtcctcagtaatctcaatagaaatgtgtagcacatctggaaaataggtgaaattcctgtttctgggatatcgcacagctatgttaaaattcatttaaattgatacttcaaccacaagataaggtgaatataggataaaaaaatagtaagacgctatatatgacgactcacaatgtcactattaaaaggccagtggacttctaaaaattccttacaagtaaatatgattgtacatttaaatatctgggtcaaataacaggtaaaaacactctgatcactcaaattaaaccataatatttttcttaaatctgttcagcacataaactattgtttattaacaaaattttcaggtctagaatttaaacatcaatataacattgtgaggaagtaacatcttctggggaaagttgaattttccatggataaaagcttaatgttaatataaagataggctgtataatagcaagccctcctagtcacaaaaagcctatttatatctatcaaaagattccaattatttgcatcaaatgtgtctattataaattgcacagcaatcaggagattcactttgttttatttacaaagtttctacatagctgatttacagatattcagggaaggaaagtatacacattaccacaaaaaaagattgtggatttattagtctttgatgatgtcttcttttcccaacttcagaatcaaatttctacaaatagtggtaaaatttaactttaaagtcatataatatgatcacgatatagggttttgaattatacactttcttgtttcctacttcaaatgcagtactttgcacatacggagaattaatgttgcacattgcttttcatatgaatttcttcaatcggaatttaattaggcacccttttgttgagtacatggaattgtgtggaactaaaggaagacctggataagtcctaatccaaaagctattctcgtctaattcaactttctgtgaataaaaatatctcaaaagcatttcatctacacagcttctctgctctaaacaatttacaggttcagcaggaaccaggcataaatctcactgcatttttttaaaacaatgaaacctctttacttggttcattttcttttgtctcctcaattaaagcacaccttctgatatattacatgttccttccctttaaatactgtacacacacagtctgacatagatttttcttcttgccttgctggaaagcttgtcctgttttctccaaactagataaagttcactcagatgtgcttacgggcgcctccctcccctcagtgccctcccaaccctggatgcctttctgtcctcctccatattcttgggtgggcaggaacctggggagatgcagccaccaggcagcttgctactctcctgaagcacatctgggctttatattaggcctttaattaatcctcagtgaaagccaagctatgacattttgactgggcaggctccagttctggacaggtcttgatttattgcgactgagtcccaaccaactttgatttatttcagcttaggggaggaaggcaagcttggaacagaaaagcgctgttgaatgttgagcacgtgatgtcaggacaggccctccagacttccaggggcacgggacaagcggttcagaagagaatggcttctgagaaagccattttaaaaccctaagatttaaataacacgaaattgtaccagacaaaataaatgtaatcacagaggagagaaaatggctcctgaaacagttggctgattgtggcagggtaggaagccccagccttatctctgggaaaaggaggaaaccctgggggccttactgttaatcaggactctcatttgcattcgggggctgctctgtgtggccgtctgtccttcctgagagcaaaggccaggaggactgccccctcctcggcaacaccaacaactgatagtccattaaatgagagcagatttcctttttgcaggcagacagaataagtcaaaagaaggcaaagttactccattaagcaaagacaaaagggtcagtccatttaacgaacgaatttgtttcctttccggccaggctttcctgacagagccgatagtagagtgctgtgctcactgctgtgtccttgagcgtgggttgtcagaacagtgactcgccggctcccacaccagcaatgcgcagtaccttcctgttggccaagttagggctcagggtggtgcccacttaatacctcactgcaggcttcactgggcctagcatgatgcctcgcacatagccaggagcccccagcacagcagctttgactgctgacaaagccctgttccctccttgggggtggcagaaggagtgcatgagatggacctgtccccagtgtcacatggttgacaaagggcaacgtcaacaattctcagaggcaacgttaagttccttaaaagggagataatggtaggaaaaatgtgttgcaaaacaaagaagaggggaagcagaagaaaggggataagggcagaaaagatggatagaggtagcatggcccaagcaagtaagaacagcacaagctctggcatccatgacatgagatccaaactccatcccagcgacttacctgcatgtgctctgtgcaagctacttaaccaagcgatgcctcctttgggcagcgagcacttattctcagggcagctgtgaggtccaggggaaagccttgcaaagctcttccacactgggcctcacccctggtgccgagggcactggccggtgtcattagaggtggggcctcaaaggtgcctgtgcatctgcatgtggggccagcacatagctgtgggtgctggcgtgtaggtgggacctcaaaggtgcctgtgcatctgcatgtggggccagcacatagctgtgggtgctggcgtgtaggtgggacctcaaaggtgcctgtgcatctgcatgtggggccagcacatagctatgggtgctggcgtgtaggtggggcctaaaaggtgcctgtgcatctgcatgtggggccagcacatagctgtgggtgctggcgtgtaggttggacctcaaaggtgcctgtgcatctgcatgtggggccagcacatagctgtgggtgttggtgtgtaggtgggacctcaaaggtacctgtgcatctgcatgtggggccagcacatagctgtgggtgctggcgtgtaggtggggcctcaaaggtacctgtgcatctgcatgtggggccagcacatagctatgggtgctggcgtgtaggtgggacctcaaaggtacctgtgcatctgcatgtggggccagcacatagctgtgggtgctggcttgtaggtgggacctcaaaggtacctgtgcatctgcatgtggggccagcacatagctgtgggtgctggcatgtgacaataaccccataggccatctgggaacacgtatgcaggtgtccctgagaaggagcgcccaggtggctgttgagtccaagccatctgacatgctcaaatggaaatggaaagtacccaccgagactttcttcacagatccacacagaacagctgttccaaaaaacgatacaatgatctttacatgaaactaccaaataagtgatgcttgtgacaagtattactgtaactgttagctttgttgattagtcttaaaggttgagcagcacattagggacctcagagaagtgctatcacatttcaaagctggctgcatggcatatgtatatatgtatataagccatcctacatatgcatataagccattctgtgggtggtcagttccccattcctgcaaatagtcaagtgccagcattgagagctggggtgccaggactcagtaagccagttccaaatgtgcagtgagcctttgcaccatgaaactaacacaatcctagggattctcaggtactatttagcccacaccaaaacactaattgctgttaagtaaaataacctgggtcaaattagatatttgcacaataaaatgcaattattctgtcattgcagtcagcagattttaatttttattgccttttttaaacctaggttatctgaatacatgcactcactgattttagaaatcaaactcttttcacatctctatgatactctagtttttcaaagaaattctcaagaggttagtggggtgtgaagcccaaaatgctggccattcacaagacctgtgaagcctacgggtcctgggtttgcaagccagggggtttcctgcagttccaaaagcttttgtgctagagggcagggagggaggacaaggaaaggagtaggagctctcccatctgggagctatcttcggatcacacagacagaagcggctgttcccaacggtcccaggctactcaaagcacaggctgcaaggtccttttcaccagccattcattccctaataacactttacatagcaggaaatgggcagagaacccaccgtaggggctccctgcacacagccccagcctccgagaggaggcaagggtggatggcacatgttcctctcccagaccatggagggtgagaactcagatgcactgcaaaactgtcagtctgtatgcttccaggattccttatttttctgtcattgtctcacaggcatatatatttgtgtctgcaagcacacactctaacattatttgctgtttcgcatgtgtaatctctctacccatttgacaactggcttatggggaagatggcttggcatgcacgtgtcagtgtatgtgtatcaacttgaactcaacacgcatagactctgatactctaaagctccacatgacagatgaggggaagatgagaaactggtggatgggtttcagcaaatcaagcaccccacggtcccatgtactgattttcaaagctgaattttaacataatttaagccaacaaaacaaacttggcacaaagcaagatactgagacctctgaataaaagcaactttctaaaaatatttaaaaagaagttttgtttaagaaatcccaaaccaatacctaccttgggccaatacagtattgaaacaagggaagtgacaggacaggaacccttctagaaatgttccacctttgaaggtatcatctcactaacataggtgaactctctgttttatgacatggtgtatttcttttcccaggcaaataatttcctaaagcaaccatcagtgacacatttaatgttacgaagtcagtcggacacagagcaagcatgaaagcctgcttccatgggaggcaggtgagcctcctgagctggtacacattttacaaaagcacagaattttaagggaatatagggttataaacataagttgcatgtccatataaaagagacaataactggccaataaatgaactatacagttctcccctcttatctgtgggagatgttccaaagtccccggtggatacctgaaattgcaaataccaaaccgtacacacacgatgttttttcccatgcatacatatccacgataaatcgtttaaaaattagacacagtaagagcttaacaacaagaactaataatagaacaatgataacaatatgccagcatcaaaacgcttgcaccatggggccattattaggtaaagtaaggattcagtgaacacaaacactacaatacttcaacagtcaatctgataaccaaggaggctactaagagactaatgggtggggaacatcgacagtggggatccaccggacaaaggaatggttcacgtccgggcagaacgaagtgggatggtgtgagatttcatcatgctactcagaaaggtgcacgatttaaaacttatgaattatttctgtaatttcccatttaatattttcagatcacggttgactgcggacaggtgaaaccgtggagagtgaaactgcggataggagggggctaccgtaccattctttgtaggttccttttcttatatttttcacttaaaagcttaaactaatgtttctctgtcccaagtagtttacaaatgtagaccaattttgttctgaaagtctcttggcaaaagatattttcttgaatcaaaattttctttaaatttgggctatgctacaaacctcaataaaagtggcataattttaatttcatcattccagttaataaagaggcatagaaagtgcatcactctactcagccatcctcccttcctcttgacttcttatcattcctctgatcctcagacacacacatggcaccataaggcaggaactgctgctcgaaggcttgatgattccaagagaggtgagaggtaagctcttccctacggctgtttgctcagacagctggacatgtattggaataatctgctgtagtcagtttcttcatatgtttatgtagctaaagattagagcagaaattaaaaaatcaagagttctgcgttaagatcccaggtctgcacctgactcacggctgaccctaaaggcaagccattttagctggaggggggttacaccatccacatctctgtaattagcatgcctataaccaaccagttcagacaaaaagactttgagattcccaggggaaaaaaggctacgtagatgaaagaatgacagggtatccaccagaaaacgcaggatattagtcacaccggtcaagttataaacgtttaatttatttgtattgctgccactaggaataaaaagagcatatcatacatcttgatgaaatgcctttcaaacaaagactttacggtttttggaacaagtaaagtttggtgaattaagtgagataaaccccagagaaaggtgcagctaaactgctctccatgatgaaattaattcttagtctgaagccgaggcacttgagtaaagttttttcaaaattcccacttgacaatttaggttctgcctacttgtgaattacctgcttaaaagaacaggtacaaagactctgcctagtacaaatcaaagacccaaaagtatagactatgttctttggttaatcctatgtcaacaaccagatgctttcttaggtcctttactttagaaatcctgggattctccgggttgcaacaggatcttgctgtgagtgtaagctgccctccttttgagtggggcccagtagtcactgagggtgattcttgtgtggttgcttttctccaaggacaatctgtattctagaaggtaaaatgtgtccatccgtgtgtgatgctggctacagccactccaaaacctccctgaagactctccctctggggagaagactgagaagagtcttctgcttactccttccacatgcagggacggcatggctatggccccatgggtgagtcagtaggcacaaggcgagggtcacatgatcaccacaatgaaagtgatacagtgcttatccatcaagatggcatcacagaagcatccagattttcttttctcaccgctgcccctcttcaggattccataaccgtagttaagaacagtggtttttaaatatgggattccgtgtataagaaagcaaactcccgatcaagatccagaggcctgaactgtggctcatctgagatgaggtgtgctgtgaagtataaaatgtacactggattttgaagacgtcgtacagaaaaaggaatgtaaaatgtctcaataattttttaatattttttacatgcttaatatttgggatttattgacttaaaaatattcttaaaattaatgttacatttttactttttatagtgtaataatcactgaaaatttaaaattatataacatatggcatgcatgtatagcttgaattttatttctatcaggtagcactttctatagtattttttgtcctggtatgtttaaaaaaaaaaaaagatgttagcttagcttaagctcagaataataaatgaaactgaaaaaaaaaagaagatgatactgggctttataaataatttgtttcactgagggattgtacaatgttaaaacacaaaatcataatctgtgtcacagaacactacgttctgttagcagatatatttaaaaacaacataaagtttatactagatggtaaatactgctgtacggaaaaagtgttcaaaagatgattccatattctcagtttctaaatcttaacctgtgttgaactccagccccctccctttgaatagaaggaaagtaagatttggaacggtgaagtgattgtaggaggccaggcagcagcaggaagaggctgaggacccaacatacagcacagcagacgctttgcacatacacgagggtcttttgattctggcgtgcagtcaccaacctcaccatgaaaagcctcagtctgaggaaagtgtagggataagactgaatattccatctagagataaattccacaagtatatatagattgttaataaaaacaagtggtgaggccaatgccctccaggaaatgtgtcacaggagtttttctctgaatgagttaagcattgactttttaaacattgctattaaaaaactggcattgtgtttttaagaaaaatctctggaagctctggagacagggcaattaatgaattaaatgtaccactaaaaagttcacttcatttcccaaggtggtctgatggaaaatctgttcccacagcctggaccctacagtcagggaaagatggaggggctagttctgaagcatttcgaaagcaaagaaaacagcaacgtgtaccatatatttgatgtgggtaatagacagggccctccaagaggaacgtttctaaaagtaataagctttccctacatactgatccgcgtaaccagagctggggaaactgtctccagggacatgctaatgtctcccaaagaagggcagtcagaaagttcagctgttctatctttggaccattaatactggatgttgagtcaggctacatcccaaaacacctacaactgaaaagtaattcttctcaaatgaaaactggcatattaagtgtaccctctgggtttggggaatgtttcccatcccaaaataaatttttaagcacaaagagacagttagaaatggtcactctgctgataaccatgctttattcagtaatctgtcaaacaggaaaaaaatggcagaaaaaacagacgtttatattttaatttccttgtgcctgttctttcccctattaaaaaaaaaaaaagccgtggaatttgtcaaaagaatgaacagcaatcatgagagtatgatatgccttccacgctgcatgggctagttttcaagggaaaagaattacagcagagagaggatgttgccacacacatataataacggcatgaaccattctgacttgcaacataaattgaaccattgaaggatttaaatgttcctcattaacttttattagcctcaatttttaacttttttccttcctcttaaaattaaaaatgagcattcccttcaactttgcacaccttcaagcaacattctgactaagcaaggtctttgagggaccacgaactactctgtagggaaaaaacacctccaaaaaccaaatcctctagtacagagtttttttcaatgtctctaaactcttcataaaaaataataggtctgaggctacatttgaagactttttcaaactaaggagaagaataaagatttcataatcttatcattttagaatcgaccatttctgatcactaaaaataagtgatcttggctgggcatggtggctcacttctccaatcccagcactttgggaggctgaggcgggtggatcacctgaggtcaggagtttgagaccagcctggccaaaacagtgaaactctgtctctactaaaaatacaaaaattagccaggtgcggtggcgggcgcctgtaatcctagctacttgggaggctgaggcacgacaatggcttgatcccaggaggcagaggttgcagtgaaccaagatcacgccactgcactccagcctgggcaacagagtgagactttgtctaaaaaaaattttttaaaaagtgatctaatcaaaggactgtggggagcactccaactttttagagttctttctatgtgataggtaacaggttaaacactttgcattaccttacacagtaaaatttgaaagctttaaatacaaacagttataaaacaaagtcttatccaaatgtgaaatgtagtgcctactgggtgaatgtgataccccaccttcccttaaaaaaagaaaaagaaaatactgtggggtcttcctctctccatagcttgtggatctcaactacccgtgggatgtgcacagaccaaaaacagaaaaagagaaaaaatgaaatatatatatacaaacaaaaccttttggtgactgtttctaaaaacaaagatttagaaagcagtatttcacaaagtgaaaaataagtgcacacttggtcagaaaattttcaaaatctgtagaatattacaacataaaaatacagaatttcaacctcatgcacacacccctctgaaaatgtgcccagtgaccagctgggattctctgtgtgtaccacaagcccaaagcagcattacacattgcccttctggatgagactgaccttacctctgccacacaaactataaactgaatgccacaccctttagttatgtaatttgctcattgtttattgttaacttgctcatttattgttatttgatcaagaaaactagttattaataactgaccctttaagaaagtttgcatgtgggccaggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctactcgggaggctgaggcaggagaatggcgtgaacccgggaggcggagcttgcagtgagccgagatcctgccactgcactccagcctgggcgacagagcgagactccgtctcaaacaaacaaaaaaaaaaaaaaaaaaaaagaaagtttgcatgtggtaaaaatgtctggattatattctcagttgcctcagtttgctgccaaggaaatttggtagcaaactatctaaaagacatttttagaagtgagttttcttcctcaaagaatagaagggtgtgatttgttttaaaagaccatattccagtcacagggaaaaaaaggctatgtcaaaaatgacaataatatgcactttttcaccttggaaactttagacttgaaagaagcccatagtataagttttccatcactccagttgaattctaagaccaccagtgaaacagcaccactcagaaaaccacaggggtggccctgctagaatacacatatagttgctgaggaacaggaaacgaagccagatggttctgctgagggaagcacttttttttctttataaaaccaaaaaagtactaataggtcaaacataaaaatgcagatatggtaaagcggaaagctaacaggaagatttatgtaaataaggcaagcttaagtttgcattatgttcccatctacatcagtgagtggatgtacggggggaaaggaaaaaataatacagtatatccatcctatagatctttctgctgatgggagaaatgctactagcaatcccatttaggcactgctgctaaactgtgggagccaaaagccagcatatgatttgtgttacatagaacgtgtgtcaattatcatgaaagcgttttttgtttgttttttttttttttttttttttttttaattaagagaacttttgggctaggcgcggtggctcacgcctgtaatcccagcactttgggaggctgaggccggggtatcatgaggtcaggagattaagaccatcctggctaacacggtgaaaccccatctctactaaaaatacaaaaagttagcctggcgtggtggtgggcgcctgcattcccagctacttgggaggcgtagaatcctccagttgaggagaatggcgtgaacccaggaggtggagcttaaagtgagccgagatcgcaccactgcactccagcctgggcaacagagcaagactctgtctcaaaaaaaaaaaaaagaaaaaaaagagagaatctttaaatacagagtctgaagtaactataacctagactctggcttcttgcacatctggtttactgtagttattcacagtctcatgaagtcccaatgcagggtgacaagtgacacctgagactatttccagggaagatccctgtgctccaagttcccaaggtgcgcccctcacaatgtcaaaggcagaactgcaccaggcactgggccttagtcttgtgtctcacagggctttggatggcaaattctgaatcctctcctgtcgcgcccaactacccatcattcttgactggtgtctgcaaagctcaacatccagccactgggcctccctgaagcacagcagtgtggtcatgtacacagctctgatgagtgaggtgctaggccctctctcccacacaggcccccctcctgcttaggcctgggcagaagtgtgcgaggttgtcatgaccttgggatggtgaggataccttgggaggtctgcaagtcaggcagtggccagccattgcccaccctgggctccagctacagcaggtggctggcatccactaaagggagagcagcacggaggcctcgcatgcccttagacctcgaaccatccactgtatctgcagagaatatgtgtccccacagaaccagtggttttgcttttcccataaagaagctggacacttggatttgaggctgagttggtttgactgagttcaatctcaggcagttgagcaccggggttcaagacgctgtgagagatgctaggggccagatgcaagcattgtcagccaggccctggcagaggctcacagggctgagaataaagcattgcagacaaggcgggaaatggccaattcttcagtgaagtggccaggagagtagggcccctgaggagggcatctgcagaggcagctgagtgctgagcctgagcagggcaggactccaagggcaagcagcaggggcagcccagggccggcacggtgcagggccagcagctcccagctccggaggaggacgctggggccctgcccaaggccgagaatgcatgctccagacagcggcctttattccatggtggagacagtgatggttttaagttgaaatatgacagtatctgtatctcagaaaggcgactctggcagccatgtgggaggcagagagagcatcacagtgcagggtacagccagcacaagggtcggccgaatgaacgcgcctgatctgggccagactcagcaagcctctctctctatgccttatgttttccctctagtgagaaaaatatgagaatagcacgtatcttaccagactcctgtgaaagtaagcttgtaaaagtgtccagtagttcatgcattttcagtacgcaataaggttttgaacttgaaaataaagactaactggatattttaattcatggtttcaggctcaaggaaggctttgactttaaaataacaactgaccattagagctgttcataaagaaagggccatattgggaggtggcaacaccttcaccattcagacatgtcccgcccagccactgctcacgcaggcttcgcaggtggaagctaagctgtacctgaagatcttggcattcttactggtgtaaaaactgtcattaagcatttttcaatatacaatcatggtttttacgtagtttagccctttattcctatgatgtttttgctaccccattctagactgacaacatggctgtagggaaaggaagaccagcagccacctagttacaaggtagcacgcccacagtgaccagcgctgatgaaacgtgagggtgcagctgaaggaaaatggggcgtctgccagctgctcaccaggctctatcaacccttcacgtgcgggggtggggggctgttcatactcaagatgccattagcgcagattctccaaagtaagagttttcatattgtattcctaccccacaatctgtgaaagaaagggagagagagaggagatgagctgaagggaggggaagggaaaggagggaaagggaagagggaaaaagagaggtagggatgaacagagggaaaggagagtgaaagaaagagagagagacgaaaaagggagggagagaaagagagagagccaatcgtggcacagtgacttaggaagaatcctactgaaatgctcaataaagccagtgtaatttctttgagccccactggactgctaacatttgagagcacaataccacgcgcaattaaacaagcaaacccacaattcattagggataattttaatagatgactcattagccagccagttaatgatgctttgttttcccagaggcccaggcagatgcttaactacaatgaggcttctactgccactgacaaaaggcaatggaatctaaaccacccatgccacgtcttcaagcttcttcaggtttttttttttttgaagataaggatcaaatgaaacgacttctgttaaacttgtatttcctgtacagaatggatatcttcttcaaattatatgattgtacaactattaaaggactgcttaatgtagaggaagtctgtttaggacacagggactggccttttcacatgtggctcctcagatgttctacagtttccttcacactcagttcctcacactggagtggtttcacaggatgattagaggtattaggccagcagtagagatgctagtttatatgtaatacctagcgagaggaatacgtttgctacacaatcaacacttgaagtcactaaaaaaaaatgactttaaaaatctcacaagaatgactaaatataccaaaaatcagcccagaaacatggcacagtatcatggtaagtcactgcactgaggagttggcagagcagggctggaacccactgcctgataccaagagaagacatcaaacaagggtttctcctttcaatgtcagccttttcctatgaaaatgacaaaaaacaatccgtgctctcctaaccatggtcaaatatgtgttgggagaatcaaatacaaagatgtaaatgacaaagcactacaggaatagaataggacaatcttccagggtttaaaataagttctagtgatagatctttatattttattttcaaacttgaaatttgagacccaggcaaaaccagcaagtaattcttgactaaaggacacactgtaagaaaaagcacatgaaactatgcagcccttgaaatcctcatctctgcctttttctgttgagacaaagtaggcgcagctctgctaccttgaatggggtatctgtatcctgtggacttggtgacagaatgccccgagaggcaggatgccagccgagtcaccttcctggaatgcaacctgtaccctccaacacaggcacccacagactatcgctctgctctgtgagtcagaagctggaggacggacccaagaacagggatatgtcgtctgagcatgtgggtgatgtgcgaccagggaggaaatgaaatcacactcacgagggacagaaaatggtactgcagaaggcttttcttttcttcttactgcactgtttccacagatattcccagagccactgtcaaataaatacataagaatctttaaattctatatgtatttaaaaataaagtcctattattacaacatgacctgcttctaatttgcatgtgttggtgatgggtacagactgagagagaggatagagaggggagaagagaagggatgggagagtgtgacggttttccataataatagagccctccttggaactctggctctctagaagaatcctctaacaaatgagatccttgaaaactgagaggaaatagagtgatgatcacacaaaaaggtttctgaatgagctgatgtcaatatcatcaagtactcccatgggtacttggtcttataagctaatggtatattagtgatttttaaatattattttgtaaaacagggccagtttatccttctgcctttccatttttctatctgctcagatattcttcctttaaaaataagaataaggccgggcatggtggctcatacctataatccagtcctttggggggccgaggtggacagatcatttgagctctggagttcaagaccagcctgggcaacatagggaggcctcatctctactaaaaagaaaaaaaaattcagccgggcatggtggtacatgcctgtagtcccagctactcaggaggctgaggtgggaggatcacttgagcctgggagatcaaggctgcagtgagccaaaatcatgccactgcactccagtatgggtgacagagtgagacctacctcaaaataaataagtaaatcaaaagtaaaaataaagctaggaataaagtctaataatagtagaatctagagataatcaggaaactggccactgtgtgagaacatatagacgttacttcctttcatttatgatctgcactcaaccagaaagaaaggtgcttgcaaacattttgctgatatcaagtaaatctagcacaactcaacctaagtgtggtaagatcatattctgggggcaatgtcttgtgctagctaaagaaagcatcttttaatagtaagagaaatggaacacatttcatatatacagatttcatttttataattttataaagaaatgatgggcagggagatccaattcaggtatttactgggcatctgttatgtgccaggcatgttgggagggatgattaaagataaagagggataggatccaggtcctgccttcaaggagcttccccaagagagaccgacatgagatagctaacaaagtcctgactgctcctcagaggtctccctcacttttctctctatagtgagagcccaaccattctctctatgagaaaaaatggtaaaagtgatctcaaatattttacataactctgagaggtacttagggaagctatcctatggagtaatttcatccctttctttgagaactctactaataatttccatatgaggcttaggccaacaatgtaaagacaatttctcaaaggatttctcaattttgcctttacataattcggcttctgtaaactgtacctgtaactaactggccctagtagaagtccaattgtttttctcttctaaaaggaaaaggagactttcacttaactatacctcaaatttatctgtttggggcatatgcagcatagtttctgaagcaactctaacaagtcaaaaatcctctggaaatttgatcccaagagtacaatggcttttgaatattcttcaccttcaataaggcatagagtagaagcacatggaaccaagtccccagcctatattaaacttatttctccagcaagtcagtgttaaacatcttattcttacacgagatctggcccatttcctacagtatccattccgtgttgccaggtcttaccgttgatgccctgggccatcaatcagagtcacagggatttcaggatcaaatcagcactacaaagccatcaattatcccagctgtattgaagtcaacaggtagaaaactgaaataacagatacaaatgacccaacactcacagagaggattgaactttcttctttacctgagaaaaaggataaggagaatctttgtggcattactgctataattccttcccacggaataagcagaagagatgttttccagcatgaagtgaacggggctgaaaataaaatgtgtttctttgctttcgggaacattcaacttaaaaaaggttttgttttgtgtctttggatacaaaggcaagattaacatgcttgtattagagggtcccctgaggatgagcctgggaacctggagcttgggcttgggcattcaggtggcccaaaaaaggacagagcagagcccccaggcttctccaccagagctctgcaaagacaaaacatgtaattttagtcaattatttcctgcaataaaggtgctaataagtaggataaagccaaacagtactttagcatgcattcaaaaacagagatttgacttctagcttgtgtgtgtataggaaagagacagagcaagagagatagagtgattaacgtatggtatgtgtgcaaaagactgccttgattgcaaatacgttttgccctctccagagtgcatgagtataaagatgaagcactgaatattgaagatataagcaaaatcatcactaaatttagatgatgtcacatcttgtgagagatatttacatctatttcctgtggacagtcttgttattaaaattaaacagtcagtttagttcatattttcagattttccagactttcacagaagtcacaaaaaagtgggagacgtcagtgaaagaagagacaggtggggagcagggcagggaaagaggaagggcagaacaggctggggtggactgagaaagctcaaggaatctcatggacttggtaagtgtgaaagtgaatagctaacctaagtgtgaacagttctttagtgtaagaattttcttacactattttcctaggagttttgctctcaagactagcaccatgactttcttaagtacaatgggtcacttcatgatctgcaatggtataatgacccttcacatcaatgagcgtgactaaagggtggagtacaagcttccatcttaatgtggttaattgctacccattagaacttaagcagcacttacatgaagtttcataaccctcataatccacgtccacaggcactatacctaacccattttatatgaacatgcaactttattctctatgcatttgcatcctctctccatacataccctggccaataactgcttttctgatttaatgacatatgctcaattttatgtggtttaaatcaaactgaaaatgtgatctaagaatgcacccagtctcatgtttctaaactatctgtaaatgaaaactcaattcatactagaaatatgggtgatacaggtgtctttcattaaacaacaatttaaaacgggctctacaggttcttatttggggacacagcagcttctgggatgtcattccaatcaagcaagacctagccagataaaacaggcaattgattttctacatttttcttaacttattttaaataatacactgaaaagtttactgcacaggatgaagaagagaaaaaaagagaaatggcaagctgaatttgttatacagagttttccatagccagatcaggaaaatggttttttgcttaatctaaacattttatgtttcaaagatgcaggaaactgttacaagcttttcttttcctataaataaagctgttcttttttctttattaatcaaggcccttgaattgcctttcttaaatgtttggtttgttagaaacaacacagaaaccacgttcttctaaatacagataaaggagagactatttatttagttattttcatttgtatttcttggaatatttttcaaagagagtatattaaatagctccacagaaggctagaagattttttcccacaatggaaaacaatagcaatacctcactaatcaatataaaaagtcaaaataaaaaatcgatgagtattacaacacattcagtgaggaggccactgacatatttcccttccaagaaagaacaccttaggctcctaagtaataatatggaattagactcccacagtgagtagaaattcaattgctgaccttattacctaacaaacagtcacttgacaaagattctaatagaataggttttctaggaaactccccaggtaaatatcctctgcacgtagttacacaatgccttcccctctgctaggaagacaggaacgatgttgttaagatagagagctctcagcagatccctggtttttccagaccactgtcactttatgagacagatacaacctcaccgttgctttctgttaagtaaggccttactaacaaatggattcaggcaccactaacactttagacaatggaaacacaaaaagatactactgctatatgctactctcctgcatatgaacaaacatggtctactgatggtgacagaggcaggaggcagacaggggcaggtccctggtgaagctccaccttcaaaccaaaaagcctgaaactcacggcccaaggcgacaactctactcctgtttgcccactctctcctgaatggttccttcggaataatgcctttttgcccatcaaatgttgcctttttcaaaactaccgatagcccgtcctgtaccccatcctctgcctataaagaccccagactcagtcagtagaagagagaaacgtggtttgactggagagggaaaacttgacttcagagagcagctggactttggaagagagatggcttgactcagggaagagccggctggacgtcaggggaagacttgtcccgtcccatctacagctagctcccgtctctgctgagagccatttccgttgctaaataaaatcctccactaatacagttcagctgcgtcccctttcaaatctcatcttgaattgtagctcccataattcccacgtgttgtgggagggacctggtgggagataactgaatcatgggggcggttcccccatcctgttctcatggtagtaagtctcacaagagctgttggctttaaaaggggaacccctttcacttggctctcattctctctcttccctgctgccatgtaagacgtgcctttcgccttccaccatgactgtgaggcctccccagccacgtggaactgtgagtccattaaacctctttgtctttataaacacccagtctccagtatgtctttatcagcagcatgagaacggactaatacatccaccttcaccatccttcaagtgtccacactacctcattcttcttggactcccaacaagagctcaggacccactgagtgcgggtacccaaaaaaagctgtcacactggccctttgccttcgctggcagagggcagctgctccacgtgacgaggcaaaggaccaaccgagttgataacacactgctgtccacagacggcagagctaagagagcactgtaacacaccctctggggcttcagggtcacaggcacccccacctgtgtaccacagcaacactcacacgaagattgctcctgctggtgaccagagcagctggtcttgctctctcacgtgctccctcccacaaggggttgagcgcagcaggctgagtaaatggagcttgttcctgccagcgcacagagcagcagccagccggatcccgcactcgctcactcacgcgctccctcctacaagcggttgagcatggtgggccaagtaaacggagcaccctgtcacaagtccagtgaaagggtcgtgaaaaatccgacatcaatggtgatgttgcaacaagcaaacttcccttaaataagatctcaaagtttaaatgacgtctcttccttccagatttgtgtaacataggatacaaaatgctagtagaagatggacagataggaaagaaaggactgggcagcagtgggcagttctcccagctctgtctgtaacctatgtacccttccagaggctcctcaccttccccaggtctctgtattagctgagaactgagagctggaatgaaggtaaattcattcagaggacaagggatagagggggctggagacctgactacatattttccccaaacacaccctttacttctttacctgatacagccaatagcataggttcggcaagatctgacagctgtctcagccagactctttcttacatttaaaacctataagaagtcttcaaaagtttctggcatataataagtgcttaacatttggcaattacgtttatttctaaaagtagttttgttatgattcagtctgtgctcactgtcccctgccacctccacacaaaaaaggatgcaggtatatgacgttaaattctgatgaatttcaacgctcacccctaacgatcctcacgtcctctgggttaccagtaggacccttctggagcatctgtgggattagctgtagcaggaaaacctcttgccactttatacatggcttttactgagtcctggaaagaggctggacttaggtctcttgattaaccctgtctcccaagagcaaggggccttttttgtgggtggtaaaagcctgaagatactctggcccagctcctaccatttagcttatcagtcaatatgttctggctatagttgtgtttcacatatttatatcaaagtgggatctcattgggaccatatactgccatttgtagcaaccagaactgtgaccatggcaggaactcaatagaatacatgttgaatgaacagtgccaccctgagaagtcagaggttctctcccttagtgttttctgccaccactgctataatcctgactgctggacattggttgaaaatggcgcattgccactagagtgttctcgtgaagctgcttgagcctatatggagagaggtgggcataaaagcaggttgtagaggggtcaggtaaatacttaagataaaaatattttaaaagtttgaactggccgaaatcgcaccactgcactccagcccgggcgacggcgagactccgtctcaaaaaaaaaaaagtttgaactgctatctataccccataaaatgcaaatttttagtagcttgtgtttgtgcaaattgaatatttgtagctgtaagccattagcactacagtaattacttaaatactaatttttgttcaaaatgcaacagtaattgtagacattaattacagaatctgggtggtacgcaggtgtttgaggtaaaatttattcagttattctgtatgtttaaaaagttttataataaaatactggaagagatctaactgcctatgactttattcagaagtacaatataatttaatatagctgtatatatttttttcttcaagttgaaatacttctcactcatttaaataactttgaaaacatcttgatctaggaagcaagactacagatggatgaaaataaattggaatcagcaacaagtaaggactttttataaatcattgtgaaaatttttacaagtcagaggtaaactttattcatgtatgtatgtatagcacactgatgctaattttttacagggtttatattctgtcctttacacagatggaaaaatcaagataaaacagcttgtctaagctgagaaacaatgtacttgcacagcagggataaccagcacccacctcacaacacgaggagaaaatgctctctgctcttcatgatggaaattcactgacaagtaaaaaagtgtcagtcacttcatctgaaggtttactaaaatttttgcatataaaagagagaggttgtgatacggaagaggggcagggaagtgccgggaggagaagggcaggtccctggtgagggctccacccccaggcctatgcccacggactaggtgaggacaggcactcctgccttcacgcccaaatgctgcatttcccaagaccaccctggcccaccacacccccatgctgtgcctataaaaaccccaagacacaagcagctgaacatcaagaggaacacaccagcagctggatattgagagaatgtcgagagcataccaacaggcaccagcacaccggcaggccacagacgggtggaactatgccgagtttggctggggcggagagaggagagctccagccactgagagacccgactccaggggaaaaccaccttcccacaccatctctcttctggttcccccatctgctgagagctacttccactcaataaaaccttgcactcattctccaagcccacgtgtgatctgattcttccagtataccaaagcaagaacctcaggatacagaaagccctctgtcctggagataaggaaaggggtctaactgagctaacacaagccacctatggatggctaaactgaaagagcaccctgtaacacatgcgcacagaggcttcagctgtaaacattcacccctagatactgctgtggggttgagccccacaacctgcccatctgcatgctcctccaagaggtctgagcagtggggcactgaggaagcaacccataccaccatcacacgctctgcgagggggataagggaacctttcccatttcagctgtataattaaaacgtgtgtgtaaatgagatggtattatgacttgtttgacctacatttgcaaacacttctttattctaaagttgatttcagtgtcagggtgcatgtgtgttttaaacaaacaatacctctcctttttcatttttatgattgctgactttaattttggcaacaaatttacctttagtcataaatctctgaagtaatcttatgttaatacacttaaaattgcaaggaatgatcatatttcttaaaacggagggtaccaagctataaattcttactgaataaacgtaatttagactttgttcagaacacataaatgagaactataaaatgcttcctacatcatcaacatattagaaacccaggagagtccttaatacacaagacccacttgtattatagaacaaatcaaggcttggatggcaaggagaatgacctaactttctatctgtctctccatggaatctgaccatttcaaatttttattcagagggtagcgtgttgatgtatttttattcagagggtagcgtgttgatgtatttttattcagagggtagcgtgttgatgtatttttattcagagggtagcgtgttggtgtatttttattcagagggtagcgtgttggtgtatttttattcagagggtagcgtgttgatgtatttttattcagagggtagcgtgttggtgtatttttattcagagggtagcgtgttgatgtatttttattcagagggtagcgtgttggtgtatttttattcagagggtagcgtgttggtgtatttttattcggagggtagcgtgttggtgtatttttattcagagggtagcgtgttggtgtatttttattcggagggtagcgtgttggtgtatttttattcagagggtagcgtgttggtgtatttttattcagagggtagcgtgttgctgtgtttttactcagagggtagcgtgctgtgtgcacatgctggcttgtgaaaggctgtaatgacaccgccttgtcaaacaatcataaatgacttcactgaacacgacctttttgcaccaacccctactggagccaaaatgtatataaaatatttttattttatgctaattcaaacgtgggcctgttgtgcccagatgtggactacactcgcagcagcgctagcttggcatttgggaagtgttgtgcccagatgtggactacactcacagtggagctagcttggcatttgggaagtgagatgacagcagcgtccttctttcagatctactcgttgacacaagacttcctccttacttacttaacactctcattcattttcatgagactttttggcctgtttctgaaatgtcacctcctaccccggccaattacaaaggtttacacatgttcatttaaaatctatggaaaataaagacagtataaagaagaaaataaacacaacctgtaaaaagcactatcaacattatggtatactgtttccctcactatcaaaatctattagatttccgaatcctttttcacctacgtgcaaaataataaaattgaatgaaatttaatcgatttggttccttgaacttggagaagagtttggataaataatacctatatagggccaggtgcagtggctcaagcctgtaatcccggcactttgggaggccaaggtgggtggatcatgaggtcaacagatggagaccatcctggtcaacacagtgaaaccccgtctctactaaaaatataaaaattagctgggcgtcgtggtacgcgcctgtagtcccagctactcatgagtctgaggcaggagaatcgcttgaacccgggaggcagaggttgcagtgagccaagattgtgccactgcattccagactggcaacagagcgagactctgccttaagaaaaaaaaaaaaaagaatacctatagcttactatgtagctctatgcagatgctgatggctagaaggctaaacaataaatagatattattgagaaaataatgtatttttacataacaagcctcatatttttcagtaggtaaggtcatttaggttagacaaaagaaagttttggcttctcttgccagtatctactttctcataatttctaagcgtgaacctatatattttttgatgtgatgttctgaaaataaatctaaggattaatgtcataaaatgcttctttgtaattatagcttagaagcacatatttaaaagatttaggctgggcacggtggctcatccctgtaatcccagcactttgggaggctaaggcgggtggatcacctgaggtcaggagtttgagacccgcctggtcaaaatggtgaaaccccatctctgctaaaaaaacaaaaattagtcgggtgtggtggcgcatgcctatagtcccacctacgcaggaggctgaggcaggagaatcgcttgaacctgggaggccgaggttgtagtgaggcgaaatcatgccactgcactctagcctgagcaacagagagagactctgtctcaaaaataaataaataaataaataaataaataaatagatctaaatgttgcactattcaaaatctaaagtcaaagctaattattttgtgcataacagaaatcagtattagctgttcaaacacacacacattttttattgttatgaccaaaaacaagatggcaggtgagcctcatctctgcactagcaaacaaactaattgtttgctttcttttgtaggcattaaagtttctttttgaattgcataaatgaacaagaaagctgggtccagtttcctagagagacatcattcaggacagaaataggctcatgagcacaggaaatctgtgagcacttgaacaaggacaggctactccagggaaaggacaatgtctctaccatgcttgctcatgtctgaccacagaaccaacatggatatttaaaagcagggagatcagggcaaagtaaaaggtaaccatttgtttataaaagaaaaatcatactacttgcgtatgtaatatatgcaaacccaaaacagcatgtctaggaatgccaagaatgaaaatctgaatttccctttaacaatatccattatttcacaatagaatcattattaacatctttctctatctctctttaataggtaaagctcaacgacatgcaatataacatgttaagaagtgtgtgatgtaataaccagactcttcagcagcagaaagcagagttccataagaatattactcttggcgggacttagtagaataatgtaagtccaagaatcttgaattatatacattgaaatgaggcagtatttctagaagatctgagaactagtacttttatacccccaaaataaagaggagcaccattcaaacactttttccatctatctatccatcatccagcacaaataattggaagagtatttgtgaaagttttcctcattcaagtaccattcagtgtaagctacctgtacgtctgaaccaccaatccctgaacgactgatccctgaagtgaaagcagcatgagtgtaaacatacctgccttggcaaaggtttgtatgcccccacctctaggtcacactttttcactgtacgcttggcatttagaatatcaatggatacgggtattttcaagaatgtaatgtgtcagttcctacctccacatagtccttggcatggccccaatctcgtttggcatccagatttcccaaactgaaacattccagttgtccaaggtaaatcttagctactgaccggctaatttttcgagtaacgaaattagctcctaaaaagaggcaaaagatgtagtatcagtcaagtgcacttgacacatttaacagtttggtgaaccaaacccgatttcggcctctgggcatttctttcattctacactcccagccaccctgttaaaacaataaaagaaaagaaaaagagaaaagatcattaactgtcatttagacaagttaagaagccctaattccatgtgtcacatcagctctactttcagaacaaacgtttttctttgggggacatcttaacattcctaatttgttgcttcaatatgcaacccaggcattaggccaaagaaaagctgttggaatgccagtttttaaacagaaaattcaaaagggttgtataaagggaaatgccagaatggacgacagacatctaagaccaccctgattttttttaagaacacaaacatcatatattcctattaataaagctactttgggactcatggggagagaaagaaacatagcttagttcacagggtaactagttaaaggaaacaagaaaggaatttatttaggctgcctttctcttaacaaaataagtggtgatggctcttatttagaaacctgcacagccatccaaatgatatgatatggcccctgggcaaaagtttctctgtactatacttaaggcaatgccactttccaaattcatttcagtgttatttacagaaagggctcctaaattttgtgtaatattttgaaatgattggttgaaaggggccatatcttgatgaaagcactgaaattgttttaatgttctctggtctttaatgaaaactctatctgctttttcaaagatcacaaagttaaaaggcacttctgagacagttttaccttgttatctaggtaaggttatgagaaaacaccatttaataccaaattctcaaggtaataatactcatattagctagttaataatggattcatacagtttagatatgtgaatatcatgatttatcacataccaatgactttaactatgttcttttgcagatgaagcagggaggcaaatattatgatcaaagtgtttggcttctggagagctggcacagggataaggggaatatttctaaataggttttccaaattttggcaagaacgtggcttagcgcaagttcaaacatacaccagattcacttactccacaaacttgatacgtacatttatacctacaccattatcattaagaaatacaatgggactaccgtggaaatccaaattttcaattccccttgtcaattcagatggtatgttaagaaatacaaagtttcaactttccacagaggtttatatagcacatagaggtccttcaaaaaaaagtgcctttcgaaatgaaaaactacttattagccagtaagtaattagtggctaattagtaattttaaaaatttttctattgacttgtaagaattaaatttaggttttttgatgtttatcattatttcaatgtcaggactatactattttctcaaagtatactaagaaaccaatgatggcaaactattaaatgaagattccaacataaaacatttcagattaacctgtttaccagtaaagtaatgtttgggagtccaatggaagtatttgaccctattcatacaatttattgattcttttacccagtgttgactacgcacccaccaatcactaagcactgagctaggcactggggatctgggagagaagcagcagcccctgctctcaggtatcacagagagggtcaggtgggccaataaaccagtgctgaacctagtaaaatgccaggtctgcaaggggggaaagcctttggggttgtagcatggctgccaggcgcaacgcacgtgagaaatgcctaccagaaatggagcttgaatggagtctaccagtgaggtcatgaagggactcatcaagctgtgagacagggtggtactccaggcaggaggaacggcacttgcaaagatgaggaagggcctttctcttccaactcttaccacaaccttatgatggttatggcacctccaatgagggctatcgctgatagcactgtgctgagctctttagatggggtaactcatttaattttccgagcaacccatgtgctaatattacccccattttgtacatgaagaagctgagattcagggaagctatataaattaactattctaaaacagcattcaaatcgagagctatatgactaccaagttcttatattaccagaactttcatgtcgtgctagaaaggtggatcttttcttatctggttcctaaagttatcttggataactagccaaaattaactataatttctaattcttttttttttttttttttgagatggagtctcactctgtcacccaggctggagtgcagtggcgcgatctcggctcactgcaagctccgcctcccgggttcacgccattctcctgcctcagcctcccgaaaagctgggactacaggtgcccgtcaccacgcccagctaattttttgtattttttagtagagacggggtttcaccgtgttagtcaggatggtctcgatctcctgacctcgtgatccacctgccttggcctccgaaagcactgggattacaggcatgagccaccgcgcccgctcaaaatgtaattttaactattatttagaacagctattttgagatataattcacatagcatacaattcattcatttaaagcatatgcttcaatggcttttcttatattcatagaaatgtacaaccatcatcacaatcaatttcagaacactttcatcatcccaaaaagaaaccctgtatcatttagcagtcactcaccagttttctcctagtaccctagccctggcatacagataatctaccttttatctctagatttgcctattctggacacttcctataaatggaattatattaatgtctggtctttgtttctggtttcttttagttagcataacattttcaaggttcatccatactgtagcttgaatcagtacattgttccttttttatggccaaataatattctattatatgtatataccaaattttatttaaccgtccacgagatgactatctgtggtgcctccatcctttgccttttgtgaataatgctaccatgagcgttcatgcctttttgtgaacgtatgctttaatttcttttaggtatatacctaggggtggaattgctgggtcatatgagaactctgttttaccaattgaggaactgtagacttttccaatgtggctgcaccactttacattcccaccagcagggtaacagggctctgatttcttcccattctccccagtacttgttatggtctgttaaactgtagtcatgctagttggcaccgagtggtatcttattgtggttccgatgtgtccttctcaataactaatcatatgaagcaactaccttttcatgtgcctactggccacttgtatatcaattttggagacatgtctattcagatcctttgtccatttttaaatcggattacttatctttttattatagagttgtaagaattctttatacattctggatccaagtcccttatcagctatataatttgcaaagattttctctcattctgtaggctgacttttcactttcttggttgtgctctctgaagcataaaagcttttttatcttttaattttgatgaagtccaatttgtctacattcgcttgtgtggcagatgcttttggtgtcatattcgagaaggcttcgttaatccaaggtcatgaagatttattcctatatatttttatgagttttatagtttttcttcttacatttgaatttttgatcaatttttagtaaatttttatatatggtgtgatgaaagggtctaacttcattcatttgcatgttgacatccagctgtctcagtattatttgttagaaaggttatttttcccattcaatagcattttcctcaaaaatcaattaattaatgaaaaatgtgggagacaatttctgactttcaattcgatttcattgatgtacttactctatgtctatccttatgacagtaccacacagtcctggttactgtagctctgtggcaagtttaaaaattaggaagtatgagttctccaactttgttcttttttaaggttattttagctattctctgtcccttgaatttccatatgaactttaggatcagcttgttgatttctgcaaaaacaccaacagggattctgaaagggatcatgttgaatctgtagatcaaaatggaggctatgcccatgctaacattattgtgccttccgatacatgaatataggatgtctttctcctttattttggtcttttaaaatttctttcaacaatgtttaatagttttcagagaataatttttacacttctgctaaatttgttcctaaacactttattcttttttattttattataaatacaattgttttcttgatttcaagaaaaagttttggattaattttaaacatttttgtaaccacatgttttactacttaattctcaagaaaggcttaaaatgattttttttttaaatttgctctcctcatttttactccatgttacagaagaatgctcttttaaggaagaaactatataaaagcatagaacatgagggctgagactatcccaagtgagaggtgaagaaagagaaacgcacagaggctgcacacctgtcctgagtcaggacaagtagccgagccggacccaggcctgtctcactggctttctagccttgtgctgttttgctaagccacagtgcaatgcaggaggaatctcttctgcgatgagatgacctaagtgtttgtgaattattatagcacatgtggataatggaacccctataattaacttaaatacatacttgatttataaagccttaaactataagattctcgttagaaagaggactaagaaaagttagctcaatgaatggagggaaagccagctctgttagtaaccagctgtgatatcttacacaaaccatttaaccactctgaagtcatagtctcctctgtgtactacttgcatattaacatttgccatgccaaatcactgggtacactaatgtaggttaaatggcatttcttacagaaatgtaagaacatcactatgtccttgtttgtaaaataaggatagtaatagtacctaaaagctttgatgtttaaaggagaaaatctaggttttctggttatcagtaagtactcagtaactgttagacattattataatgattacattacaatgttaatggtatctacaattaagtctcaatggaaagttaagatttcttagttcttttattaatagatgactacatctcttaattctctgattttgaaagtctgagattgaggaaaaatcaaaataaacagccaggcatgtgggcctacacaggaagcaataataaacatttcttgaatgactttggctttcaatattaactcattaacctaggaaagagagtatgcaagtaaaagtatatccataagaccgagaacaactaataaggtttttagcctaaacactcgttggattgagataatgagttttgccagcattgatagaatgagaacagaacttctgttcacgcaatgcagtagacaacaaaaactgccacattaaaaaccagtatatgctgggtaaaatattactattcctattttgttaaatacaaagctgagcctcaaagaaatgaaagaaaatccccaggtgaagggggatctccagagcacagatcatgggtgggcactgaggagtctgggctggaagtgaaaatggaaggccatctcatgccctggaaacaggttcagctttaatatctatctgtgacaaaggacaaaattttcagggtagattactagaaccgtgtctaacacactatgttagttatgcataattctgcttgctacttttgtcagtgctattatcttaagcaagtgttttaatttctcagttctcttaccaataaaatgggatcacaatccacactaagaataaaatatcatgctacaggaagcagtgaagcaaggctcaatgtgagcagtggcaagagggccagcaggcctgcatggaccctaaggcagtcgctgaaatggtgcattgagacttgaaggctaagactacttaagagtaaagctcactccttccatgaacctagggaaagtgaagcctgtgaattttaccagcagcagacaccaggcacagccagaagtgggactaatcccacctcctctgtggccacaaggcaagggaataatagctcagaccagcaagtcatcagctgagaccaggaggcattcagaatgtaccacaaacacctgaagacaccacctgccccttttccaacactaggtcaaataagccacatctacgtcccatatagcaccacacgccacaccacaacgtttaggtcaagcatggaccgcttatatgacaatggtcccgtaagattacaatagaggccaggcacagtggctcacgcctgtaatcccaacactttgggaggctgaggtgggcagatcaactgaggtcaggagtttgagaccagcctggccaacgtggtaaaacctcatctctactaaaaatacaaaaattagccaggtgtggtggtgcgagcatataatcctagctactcaggaggctgaggcacgaaaatcatttgaacctgggaggtggaggttgcagtgagctgagatcaccccactgcaatccagcctgaatgacagagtgagactctgtctcaaaaaaaaaaaaaaaaaaattacaatagagctgcccaatacaggcatatcttttgtcctttatatggtatttttactttaccttttctatgtttagatacaccaatacacattgtgttgcaactgcctacagtgttcagtaatctgctgtcccagtttgtagcctagcagcgataggtgtgcaggaagatataccatccaggcttgtggaacactctacgtctacaaccgtcacacaatgacactgcctaatgatgcatttctcagaacaaatccctgtggttccgtgacgcatgactgtaggtagatgccatcctgaacagaaacaagaaaagaaagcacgcctagaaaaaagcttcaacattctgttacattaatagcagacactgaactttcttttaaattttaatttgctgtttttgaaaaacaagtataaattaactgttaaggactatattagttcctagggctgccataacaaactcccacacactgggtggcttcgaacaaccaaaatttcctgtctcacagctctggaggcttgaaggttaatatccaacagggccatgctccttcgagaatatctacaggagaaccctgatgctgtctcagcatgtgatggcattccttggcttgtggtccaatctctgcccccatattcacaccatatgaatagtgctttctccaatgtgtgtctatgtctctggctcttctttttattatgtggacacttgtcattagatttagggcccaccttggtaatccaggatgatcccttcatctcaagatccttaactaattataactgcaaagacctcatttccaaataaggtcacatcaacaggttcagatattaggatgtggacatatctttctgggggctaccacccaacccactataagaacgaaggtttagaatatttgaggctaggtgcggtggctcatgcctataatcccagcacattgggaggtgggaggatcacttcagacgaggagtttgagatcagcctgggcaacatagcaagaccccttctctactaatttaaaagaaaaaaaaagggggatacttgaaatacatgataaaacatgagaggggcattgtttcctcacttaaacatcattttaagggtaactacattcctttcgtgagcataatagccaaatagggtctccatttgtagaagattaatttagaggtgataaagtaagtttcccctctgtttcagctctgcaagttttcctcagttaatttaaatagctccctgggtctccttcttcaggggaatatacatcttcttataatttcagactgaaaattctgtgtgaattcctgtgtctaccaatttcctttgtcatcattctttcttgcatctttcttgtggcataaattcccttcttaaaatgcatttttagaagttcccttaatgtggaaaaattaactagctcgtatttgaaagaagttttgctaagtgcacagttcaaggttgaaaattatcttctcttccatgctgacagtattttcccactgtcttctggtttgcagtttctgctaggaagaagtgtgtttccggtctaattgtcattcctttgtaggtaatgtaatgtctttttttctcctgttaatgtaaagatattcctgttttctttggtattctggggtttcactccaatgtgtctacgcatggctttctgcttggggtccatggtgcttcctgcatctgtgactctttaatcaagtctagaaatttctcagcaactatctctttagatattgcctcttttcactctattttcttctgggaaaggatattagactactacttttactttctactctcttaatttcttttttttggtaattttcatctctttgctcttatctgtaatagtctgggttaatttccgtatagccatctaattgtccttcagcaatctaatctaagtcggccatttaacccttccttcttcccttccttcctcccttctttcctcccctcccctcccctcccctcccctcctctctcctctcctctcctcttctcttctctctctctctctttcttttttggcacatccaaagttctctttggttctttttcaaacctgcctgggcatttttacattctgttcttgcttgcttattttttctgatttgacatctttatttacacatgtttttgtaattttatattctgaattagataattccagtatctgaagttttggggggacttatttattacttgttatttatgctgactttgactgatggtggtttctttccttgtgcatttagtgagagttcatgtttagtaaccttaatttgctggagaccagaggacatcaacgcaaatgacggcttcctcctgagacagtcactgtttgtttctcctgggggccaggagatactaacacctgggatgctcatccccttccagaatgcacaggttaacaaggttctgctcttccccttgactgctatctactgattaaagaggctgggtgttccctaaagacccaaggatatacatatacacacatgcatatatatatacacacacatatatatacacatatatacatatatatacatatatatacctatatacatatatatacacacacacacacacatatacacatacacacacacagagtccatgttaaagtttctattatattataaagcataccaacataacatctctatcttctataacaaacattaaaggaaaaaaactgacaaaatttggaaaacacactttaaattgccagcattaaactgaaaacaatggaattgcctttaagacatgaataatagccaatttattaaagaatttgattgcatattaggtcacaatcttttccacaatgtattacttcaatagagatttatttttaaaaacaaaatgcaaccttgggcgccctctgatgatgccgtagacgtaaggaagaaaccctatgggaggttcactaagtcctactagggacagttctacttaccacactacacaaaattacttctttttgacaccctctgatgatgccgtagacgtaaggaagaaaccctacaggaggttcactaagtcctactagggacaattctacttatcacactatacaaaattacttctttttcaaatgtatatttcctatggccctgtggcaatttttattgtttgtgtgtctacagatacacgattgtatatgtgcatgcatgcatgcatacatacatatctaaacattatccatccatatccaaatggtacttgaagtaaccaaaatttgtctaataaaaattctattccattgctcaatacttcatccaaaagcttttgatttaaagatttttttggagttagataaagtacaatgacagtttggacaatattcattggaaaacagaaatcattccaatttatcctgaaccccacatgaacctccgccttggggccctgcatttttcccctgtggtaatctctggccaccccactgtgaactgcctgggccatggctcagtggagacagggtgtggaaagaagagacactgagaaggtcatggctgactgagcagatgactgagatcagagagatcatacctcatttgctcactaagtcctgccaagagcaacactatttaactgcaggtactcaaaatccaataggcacgtttaaaggaatctcaggcttaaaagaggacaattcacaatgtgcatttgtctgagatagctaccaccttttggcaactatttaaaatatgtgtataaagagaaatgttcaaactactttgctatttgtatcaaatgttcaatgcattttccactgacagtgagataattcaaatttgtaagtcttcctttcaggttttctccagtttggtactattgacatttaaggaggaataagtcctttttattgctggttgtgctgtgctttgcagtgtttaggagcgtcactggcctttacccagtagatgccaggagcaccccctcaattatgttcacaggtgttgccaacttccccctggggggacaaaactgccctggttgagaaccatggccttagtcaaataaaacaaccccacaaagacaaaatccccaaaataaaaaaaaaaatgtatagcttttaagtacctctattcattcgatacactaacaaaactatcggggaactaataaacatgaaatatttaaatcaggatgagacaagggtgagtcttcatttaacactgcagtgaatctataagcctggccttccaacgagggtctaggctgagggcacacatttgggaactatttatgtatggatgatatttcaagtcctgaggccagctgagaccaccaagaaaggaatgttagcaacaaaacataaatggtcagagaaccaaatacactgatgctataatgtttacaggccagatgaggaggaagcagtgaggggaagcaaggacacgggagtatcctaacagtctggatagtctgtatccaggagggagtgatcaccatgactgcaggtcagaaggacaaagacagaaacgtgaccttgatgggagagcttctgaaagaggtggacaaaagtccaaggaaggagagggctcaagaaagaatgggggtgagatttcgtagacaaggagcacaaacagcttctgaaaacttctgctgtcagtgagagaaaggggtgagactgggaggactgcacttcaagatgggcatgaaagcagcctctttgcatgctgagggaaagatcctagtgatgacggagaaactgatccaggagagaggtgagaattgctgatgccaagtcttcaaggaggtggtagcagacaggagctccagacagacagctcctccagggcacaggagagcaggtagggagaacacaaacgcaggaaggcagagttcagatgttctgaggacttttcttcctgctcaaatcttaaacacacaccccatcctgactacacgactcaaccccgcctcgctcacctctcccactgtctctgctcctacgccgtgaactgagtcggagggagaaccttcgcacacctatgctgactgcgctctccagcgagagctaagctcgtgctgcctggtcatgatgacctgcaacttcctggtcggatcttcctcctgttcacctcaggagacattaccattaactctagttcgcttctccttttaccccaagctaacacaactttctggatggccctgcatggtgaatggtctcaccctgcacccagtagcccgggagtcctctttgattcctttctcactcttccattagtcaactgctcatcaagtccttctgagtctgtttcttcagcagtcctaaataattccccatcccagcctctagtaggccacaaatgaggtggctgctcaatgcagattccccaaagcatgctttggtgctctttcctacttcacatggttctaatgggagtagcctaaccctgccatcctgactgcactgatttattcaaggtaagatcctggcccaagctggcccaaagcaccactcactggctactgggactggttgagggagtggaaacctgaccaaggccctaccccaggccattccagatggagttgaaagagaaaacagttttcctccaagtggcaagactgaaaggggcagtgatcctagttctagtttcatagaaaaaactggactgaaaagatgaggccaagacagaaagaaaaatggagacagaagataaaaagggagaatcctgaagatatctgagttactggttccagctgtccctgaaatcggacgttcctgccattcccatacttgggtaacacccatacagcgctatcttcaattatttcacttaagcttagcgtgaggttcgctttttgccatttctaaagccagagtcctgatagacgcacaagcacaaactcagcgaataattccatctggcccaggcccttatcattttctttactggattgctgtcactgctaccaggtactctctttgccctgactctcttcctgctctgcacctgtcctgaaaactcatgacttccaaatgcaaatgcaaccacaagcctctttcttcaatggctataaactgcctatgggccggaagctcctgtgtgccctgtcaccggccccgtccccagcatctcctcctgccctgtccccctcacagctctctccagtgacatcctactgtgtgcagaccccccagcatgcacaggtgtcttctccttctctggacggccccttctctgagaaacatctgtatccacagctagttcccaactgcctggcactccaagtgtcatctcagtggaagggtttcctgactcctcccctggtgggggctgtccctcttctgtgctcctccatcacccttgcacaagctacctgctctcattacactccactgcaatcttcagtttactcacctcaactgtgagcttcttaaagacaagcattctattctgtctctctagtgtctcgccagtgtctaacacagtatataacacatgataggtgttcaatcaacattttctgcagggagagggaggggagcagggctattccacagtttaaacaggaaggtatctttacatttacacatgtaggacataatgaacctgattctcttattgcttctgccataattccagagtctcaggaatgattaaatgcttccactgatacatttatttttcaaggacttgcatactaataagaataaaggtaataccacagatgccagttcagaacaaagaaattatctggtcacactaggcagcttgtctctcttctgacacgtattagggttcttctctgccttcatgtttgtagggacctctgtatacacttttacctctataatcagagctgtagcaaatagaggagggatgtgagaaggataaaaactttctgttgtgacagagagagtatcaaattcaatatattcagtctatgtaagaatgaaaaacactggaacaatatagagatatgtatatcatcttctgaaatcaactcctttttgcagaaatgacttatttgcattaaaaatgacttatcccacatcgttccacatcatgtttgggctttacttcagaattgatagagctatttcacagaaggataatgttcatacttctgtttgaggacactcatactgaaacctcttggattacaatttctctttagctcccatctcgactcggaagtgtagtgacatttaagaagtaaggcagagccacttcctaaaatttcacactcagctgggcgttggggctcatgcctgtaatcccagcaccttgggaggccgaggcggacggatcacgagatcaggagttcgagaccatcctggctaacacagtgaaaccccgtctctactaaaaatacaaaaattagacaggcgtggtggcgggcgcctgtagtcccagctgctcgggaggctgaggcaggagaatggcgtgaatctgggaggcagagcttgcagtgagccgagatggcgccactgcacgctagcctgggcgacagagccagattgcgtctaaaaaaatatatatatattagccaggcgtggtggcgggcgcctgtagtcccagctactcgggaggctgaggcaggagaatggcgtgaacccaggaagcggagcttgcagtgagccgagatcgtgccactgcactccagcctgggtgacagagcgagactccgtctcaaaaaaaaaaaaaaaaaaaaaaaaatttcacgttcgaagtaacttaacaaaaatagtattggcttatagccacccagcataaagactgcaaagtaacgaaatcttcaaaagacctttgattcaaattcttgatctgatagaaaattgggacaagataaatgtccataaaatgatgcaatcatgtctccttccacaagaatcttagttggctctaatgacagtttctgttattctcttctgtcacagaaaagtaaatataggcaataccctgaaaacaaatacatacaaaagatacttattcacccaaggaaaataagtaacattgcctcctctgtaataactattgctaattattgatttggacttcaagcagtttttcaagaagggtcagactccaagaacaagcacaattagaaataaaggatgacttctaagaattgtgtgccagtcagaaaacactgtcttagttgtcgacatacaatataaagtaatactaaggaatgaaaaatgcaaggaagagaaattatggctttcttactagtgacttagcctctctgcttgaatcatatctataactttttgaggttctttataactgtggggttctcagccacaagcctaatgagatgaatgggcatgcaggaggcaatagcgtgcctctcaagctcaccagagcagcagcagagactgagcctgtgtggcaacaggagtgtggcccaaggtacactttctggaaattaggtaatgagcaaaaaaagcatttggtcagtactagatgagatgtttttaacacatactgacaacagaccataatacgcaaggagataaagtttcacacttttttttcttgtggttggttatagtcgggttggcttgaaatttagagtatgcacatacggttacagaggcccttgatagatttgcatgacagtaatgtctgtgaacccaatattcttcacgcctggggtcatggcctgcacccgtagatccagccactcgggaggctgaggcaggaagattgcttaagcctaggagttagatttcagcttgggaaacatcgtgaaaccctgttttctaaacaacaaacaccaccaacaaaaatccccaacattcttcaaatcactcaggaacaaatactgtgaagagaatcacagaaaagcggacttaacaaccatgtaaaacatgtaaactacaaataattctaaaaccgaaggtatctgtcattcagcagtatccctgacatggtattcccaggatagtgtctataaactaaacaccatgaaacagttttttttaaagttaatagactgagttacaagacagcttaacagtttagtcccagtttctatgtcacccatgtggcaaaatttcaggtgaaagatttgcttccatattttacttcatcacttccttttctcactaattaaatttagaatttagcaaacctaaaatgaaaaataaggaaaggaaagaagcaacaaaaagtcaaacaggaagaatggtcttgaggaaaaactagagggccaggaaaggcagctaatgtaactggaaaaatactcactggggcaatgaaatgtgatggaaggggcaggccaccaaaggagccgcacaaggtaatggacagtcacacagttccagggtcaaaccacatgagtccaaatcctatatccttcactactatgggaaagtaatttcacttctctaaactcctgtcaccttacctgtaaaatggatataactacaactacttcatcgttttattatggggattaaaagagatgagtgacagagcatctggcacatggtcagaactaaataagtgttacctgctatgctatcattatcattactaacatcactaacagtcccgtaagttgaaacttttcaaaattctaatatattagctcaagagcactttacacttctcaataagaatttgtgtttaaaaattccagtatcagatgcacttagaattcagccaaagaaagggggatatgctgaaaacatcaagcaggtacggaaggctttccaggaagtgatcacagggcatgctcagcccttggctgcagaaaaggaggagcgtgtgtcaggtacagcccctgcaccaagactcaaagtgaatgggcacaatagctaccagtgggcatgtgctggcagccctcctttgggcaggagtgccaagaagctctctaggcatgtttcacaaggagcactcaactattgcaatccccatcccccaaatctggctcagaaaagcgatttcattttaataaccatcaatcttaattaatatagcagaattcaatggtgtctagcgagttctgcacattttttggaaagaagtagatagatcatttttcgcatatggtatattagctcattttagtgctgggagtagaagagtagatgaacttcttttcctatattttcagttccctgtcttaatatttgcttcctatagggaaatatttccctgtgcttgcagatttatgaaacattcctcaatgtccagcactcccaattaaatgttctctgtgaacttgggaccacacagtcgtctgccagccagaatggggatatgctggtactaaggttctcaccaacctattttgtcttcctcaaaaaacatttatcagtgttcctctgagaaacaccttcatcctccttaaaacaaggtttatttcttatgtacaaattaactgttagggtcataagaggcactggggccagggttgagctctttcctgggtacctctaccaagccttctttacactgtgtgggcattagggcctcccttattcctctgatacaattgtgctgaaaacccacctttcttgctgccaggagggtttctctgtgaccgcactgatgttcacttccttacttgcataccctcatgggctggttatcctcacgtacatcctgctttagcagcctttcaggaatcttaaacttaccaacagaaatagaaggcagacgcaaaccttctgaaacataaaatctggcttaatctgggaattttttactctaggaatcattagagtttgtccacaccagaaacatctaataacaatatctgggaattagcccataaacaacagaagcaaagaccattattcttctagcatttaatattcaatatcccacaagttactttaccagatcttacctactttacttatcacttactaagctctgaaaccttaacttttttaacttgttcagagaaaacaaagtcatatgttcctttatgcattttcccctttattccttctgtttattaattttaagttgcgaggtggcacaaactgagcttacttctctaggtgggacattagcagcagtgatggtaataataatgacgtgctaataacttcacttccacgatttcctttaatgcttataacaaccttaagtgaacactatgattaccccattttagagatgagaaaactgagactcagagagattgagaaactggccagagttgttctagtatgtagtagaacctagactgagtccaagtagttgaacacttctatatccttacgtgaaccacttaaaaaggggaacaatattccataacaaatagtggaaaagaaagttttgactcaaactaaatttcaaaaacttaagaatgttattttgaagaaaaatttccacttacaattaacaaaatttaaattacaactgcatctatgtaatttttgttagtctagtcacaaagtaaagtaaggttttcttcttgtaattgacacaaccatatacatttcatgtaagatttttacaggaccattaaaaaaatacatgtatcacttaaaaaaatacttgaaaaaattagcctggtgtggtagtgtacacctgtcgacccagctgctcaggaggcaatggcaggaggatctctcgagcccaggagtccgaggctgcagtgaactatgatcaccgctgtactccagcctgagcactgtacaacacagtgaggctgtgtctctattaaaaaaaaaatacttgacagtttcactaattttcttaagaatctttcacacgtccttgatatttatccataagcctttcattcatcatcgtcttttcttgactttcctaattcaaatgttaactggtttacctgccaaaatctcgttttgaatggcttttcctgtgattccagcaattcttcaatactacttacattttatttttttgcaattcacgggtgtctcgccgaactactctgttttatctgtcaacaccactgaaagattcttggcttttggttcaggaccatcttctgttggctggcactgcagcgttcacatttctcactgtcctcttatgccagtagccacagcaatcccactaacagagctgcctccaacagggtctttcactttggaagggaaggagtaaaaaaactaattctctagctttcagcattgaaaatacaggaacagggaagaaaagagaaaggaaatatgaaataaatcttcaaaatctactatgcactgtattaatcttttccctgtaagttttccccatcaccttcacagtgagctgaaatgacagagctgcactttgctccatcaggtgggcgttattaacctctccatgtgcagatgcagaaactgagatctgagtaagtgacgtgcccaaatgcacacagctgatgatgagtggccaaattctctgtgtatatatactgcgtggctatattgcagggaactgtgctacatgtcatcagacagttatcagtttggtttcaaacataaatgtcacagacattacaaaacactgaaaaacaaccccttgaattcaatttaacaattccagaaatctcacctcaggagatgggagggatttcattttgtttggtggtaatcagcacctgcattagaccaagtattgcttcaaaagtcttttatgtttaagcaattacacctcatctctccacaaagaataacatgggccagacagctttgtgatcgccaagtgtacatgtcatctatgaagtatcatagtctacaaatgcaatggtaaaccagatgatgtcactttgtgccccaaccagaaaggctacccagaacctggtgggtccaagagtagcggccaacaatctaaccatttatggacagacaaatggtattgtgtaaaacctataatgctctactgaactccaacaggagattacttcatcccctgatttcacaatgggctgctaaaattttttgcaataaattaagtctctgatgctcatctacaaaagccacaaagcaccttttatagctagaaatacaaacaaaatattaaggtatttgctattggtttgcctgtttgatacttctacagtgcatgatttgaatttgccaaactggccaatattcagtaattttttaaagattattttatttagacatgttatatgtagtatttacacagagagaaagtgttttctgcctattgtgattaactgaaaacaagtcccagttacctaatttctatcatgcattatattattccctaaagcactaaaacatctatgaattctaatagttttaaaggaaaattctcatatgcagtgaacccttcacactaatattagtataatcctatgcattgaaagataatcttgaatcagttctaactgttgttttatatcaaagccagatcatggactctacaacttattctcaaatgaaaaatgtgttattcttataactaataacaaaaagtaaacatgttcattgattttggaggcttgggagggtcccaaacccatcttgacttggctcgtgaatcagtgggtcactgaggtgagggttcagcctccaatgattagaagagtcctgggtttgagttgggtctgacctgcagcagaccataatacttaaggccctggagctatttgaatccgaatgttttctttggtgttcacgtaaatgtttgctaaagttctatgaagaatttactgtaaagtgaaagtgatacctaaagaaaaatgagaccctactgttgttctatgaagaatttactgtaaagtaaaactgaagtgtaacgaaaaatgagatggcattcatctcatctgttacaggtggcattcacacagattctgcaagcacatttggaaggatgacatcctagggcagagtttcttatcctcaccaccatgaaccatctggacaggacaggcgtttgttatagagccatcccgtgcacaccactatgaaccatctggacaggacaggcgtttgttatagagccatcccgtgcactgtaggatgttcagcagcatccctggcctctacctaccagacaccaatagtagccccctcctccgttgggacaagaaaaatatctccagacactgccagacgtcctctggaggaaagagccactctctccccattccccacccctagttgagaaccactattctagagcattaatcttatctttacagcaacaaataaagacaatctttaaaaaacaaatcaaaaggaaaattaccccaaattttacttaaattttgacaagtaatttttacatgaattattttaaaaattctgaagattaatttataaagataaatacagtcagacattttataaagcaaagtacttggcagctaaaaaaatgctcaagacgaaaactcaaaaccacaagttcatgaaccttaaaaatgccagattctttcagtcaggtgaatactgtgtttagactgatgtatatgatttcttatgaagcccatatttaaaggaatgtcctatctcatctagaaatggctcagtatctaaacagtgctagtacaccatccatttgtggcaatctcacacggttaattatgggtatatttaaagtactttatagcttcccattgccacatgatttttaatgttttattttttattttgtggtagggatgaggtttcactatattgctcaggctggtctacaactcctggcctcaagttatcctcctgtcttagcctcccaaagtgctggaattacaagcatgaccaccatgcccggcctgatttttaatgtcttttatattagttcttcctattaccaacttcttgataacaggcaagagaagttatttatttcatatcacatttatattctaatattataaaactatgtttattgtaattatttctgtcaaacatcttaaaggaatattgcctttaagcaaactaatggtcttttacaaagataagagcagctgagacattccgtttccaacttgtccacttgcttcactgccaagctgaggtggcccactcagtgtcacaggggtttctttgctcaagttcaactctaaaattcgtatatatgttatttccacaaatatgtacaatatttacatgacttctcctaggattatttctggtctccgtgttagcatttattggcttcacgaccttggacaactcaatctcatgctgcttctgtttcctcattgctgaaaaaagggagatgaaagaagctttaaattcctatttcacaaattctgagggtattttgggagaatacctacaggtggatgttaactggctgctccctagaagctctttcaaggaaaaaatagtatctaatggcttaatacacatttttaaaattaaaaaatagagaaaaatagaagtacacatgaatttcatttccacatacagataaaaaatttgtaagttaaacaagttagtcaaaatgtctctgaaagtacctgtggagtattaaatcactatgtcaaacgcaacacgaagagctaatgagcgtgcatttttcacagtaaggatgatgatgatgatgatagccaaacccctctgattcctcagctgggagatgattaaaaaaagttcttcgtgactcagaatgaaatacaaaataaaccagctttctggaagtatttactaggatctcatgaaattctgaacagacagtttagcaacggaagcgctcctgggggaagaaggtagtgatggatctgttgcaaggccccatggtcagagacagaggagcaaagttacatatggcaagtagaagagaggctcagttaggcgttaggcaaatatggaaaggaagagaaaagaagatccacagggagagagaatgctttacccagactgagtaaatgtcccattcttaaacactgagagaagaaagagtgggaggagaatggaagaaatacgctgtcaacagggaacgtgatttcttactcaggctaaaggtatccagggatgaagccaatccctatgagtgactcacggctggtaaccaacggcccacgaggtaggctcatgtaaccaaacatcacctcctcagtcagtcctggaagtagaggttactacattgcccaaactttcctaatgatcgaaagactaaaatgagtcaacataagaaaaatatcctcatcgaaagacggaaatcttcaactgatctcctgcggaaagcaaagggctgctgggtatgagaggcaggcctgccaacagccggcagcacagaacaactttctccgtcacacccctgggtcagggctttctcctccaggacgtggaccctaggaagtctcacagaaaccgaggctgctgttcttagtgtaggaaatcaaagcggctaattctacactcatactgaaaactgaaaaatcacatttaaaaaaaaagaatgctgaatattatgtgtgtttcaccctttattcacaatagctactgtcatcaaaattaggaaatcagggataatctaatcattaaattttttaaccttccaaaagtagaaggtagaatgtattttttgttccctcttaattatcatgcaaaatgttttttcttaatttagaatacactcatattagtgttatttatagttttgtaaaggtcaccatatttgtatttatggcatgccaaagtactctgccaatgttaagaattaagacataattagccccaactggttacattacatatgtgatgaacagtagttattcttcttatttacctcctaatgtaataaacagtcaaaactagaaatattgttagctttactaaataggcttgcttcccatgttccaatttatagcataatctttaagagtagattttattactggtaaataacatatttgaaaagaaactaatatacttatttatgaactatttttaaataattaaaaaaacctctcaatattttccccatagttcacaacttatataataattaatatctttatgacaagtctgattgtttagtttttcaaagaaatgtaataaggcaagaaaatttttgtacatgtctatttcctcatagatattaaacagtttgagataataaacaaaacctttttccctagagagtctattctctattacagataatgtgaagctgtatttccagtagaaagctatcattatatccacatttgtggcaaaaagaatactgtatgtatgtaaatataaaaataaagatatgtaatggaacagccagggagatacacaatttcaggtttgaagaaacaatacaaaaggaaaaagcagtttattaagtgtgtaataatagtatgtttttaaaagccctgtacaaccttaactaaaaattactttatcactgaaaaccgttaatgaccatctgtgccttttgctggtagagggcttgcctcagtgtcgatggctgctaactgatcaggatggtggttgctaaaggctggagcggctgtggccatttcttacaataagacaacaatgaagtctgctgcaatcactgactcttcctttcaggaaagatttctctgtagcatccagtgctgtgtaacagcatttacccgcagtagaatttgtttcagaattggagtcaatctctcaaaccctgctgctgctttaacaactaaacctatgtagtattataaacccttcttttgttattttgacaacattcacagcatcttcaccaggaatagattccatcttaagaaaatacattctttgttgatccataagaagcagctcctcatcagtgaaaactttattatgagattgcacacgataaaagcagtcacatcttcagattctacttttaattctagctctcttgctatttcccccacatctgcaactacttcctccacttggaggccaatggagggctattaagtggcctaatttcaatattgttgtgtctcagggaacggggcggcggtggcagggggtggtaatggccagttggtggagcagccagaacacacacaatatttacggattaaattcactgtcttttatgggtgcagttcatggtgcctgaaaacaatcacaacagcaaaaccaaagatcactgatcacagatcaccgtaacagatataataataatcagaagtttgaaatattaggagaattctcaaaatgcgacacagagacaggaggtgaacacctgaaaaaatagtacctacagatttgcttaatgcagggttgccacacaccttcagtatgaaaagaagaaaaaagcaatatctacgaagcaataaaataacatatgcctaaactcgtgtatttaagtgtacccaaacagaaaaagtacagtaaaaatgtgactttttaattataatacagtatgataatcttatgggaccactgcagtccatcatttaccaaaatttgttatgcaggttatgattgcctacttttttattttaaaaaactgagtacatatgaaagaaagcacctggttaatgtctgtgaatatcagtatataatacatagtaatagttattcataaaacatatactactatatacattttcatgacttatagacatttaattctaaaattctgttattcttattaatttgtagtaaatattactaaagtgctcccatttcataagaagcaagtctatagcacaagtgccatccaccctcttgctttcaccaacggagtgactggaaggctgactgagggatgcaaagtcgcagattattggctctattccctaaatcagtgatttccaactgttgatctgatgctagcataggtgattcttacatctctagatgtattacacggttctcaaaacaaatatatttagaaagaaaacctaaataaataaatgaagtcttcaaaaaaaaaaaagaaaaagaaagaaaaccaaaaatggttgggatggagaaaagacacagaaggcagtcaaaaccgtaatgagcacgtgtccaagctcaggagttgtggttgttggacaaactatgctacatgtatatcatcagttactagcttatttggtttcatacatcactgacaactagctttcctttagagcacttggtcatagtgcttgatcctttggagcacttggttacctgcatacagcagtgaagtacaacagaaccccaacctgccaaagcacttcagaattctgcttaaggactggctcactatgctctttaacatttataggaaatctttctaaaagactaccttgctaccataggagaaacccacaatcaacccaagtgaaagttttctcgaatgttgaggatctgtctacagctggggccagcaaatgttttcttagaggcccagacaacaaatattttaggctctgcacactacaagactccatagatgaaagcagccatagatgatatataaacaagtgcatctgcctgtgttacaataaaactttattttcaaaactatgctggtaggccagatttggcccatgagtcctagattgtcaacttctggtttagcctattgttagattaaaaaatacttttccccacttttgaaagtcagaaattctcatgaaatgttattcatgcagtgagagggcacctttgacaattacactttgttagagaaaaagtatatggcccccaaaaactgcatcaacttgggctctacaaattcagcatgggtgactggatacctaggactagattgaggtttaccaaggtttttctacaccatgtagaaaaaaaagggtttgttccctgtaataacagggaacaagaagactgatgagtaaatgttcaaccaacttaagaaaataaactcacttaaagtaccacaggaaattctaggtttacaaagattattaacaaaaaacaaattttatctgtttattaatgtatatcagattgaatctttacttcaaaatcatttattagcttttttttttttgagatggagtctcgcactgtcgcctgggctggcacaatctcggctcattgcaacctctgcctcctgggttcacaccattctcctgcctcagcctcccgagtagctgggattacaggcacccaccaccacactcagctaattttttgtatttttagtagagacggggtttcaccatgttggccaggctggtctcaaactcctgaccttaagtgattcacctgcctcggcctcccaaagtgctggaattacaggcatgagccatcgcgcccggcccatttattagctttaattactatatgagtaaaatcaacaatatgtatatatttataaatatcgatataatttctacttttctgtaattcagaccacctagctttcaagtcagtaagctgttcctgaaacatgagatattaacttattcattcatttaaaaatatttactgaatgcttattagcaattaggcattgcctggaagctggagatgtatgaatacaacacagtcctgccattatggaattttcagtctgggaaagaaatctccttggaaaacaacattactgtcagattaatttaatctgaaaattaatgatcaagttttaagaaatgctgtaaatagtaggcattacatatcaaagtattaatatcattttcacgtacatctctttttctcattatttgatcatatagttaaaaatgtggtaccactgatttccaggcatataataaaacaaaacaaaatggtgtatgctacagttgaggtcaagttcctaaagagatttaatagaagcctgacgctgcagaacaatatgtagagcagaaccctctttgtatgtttaaagagagaacttttctgaaggaatgttaacagtgggtctgaggatagggctggcagttatcacgagggtgggaacttttactttaaaattttattttaaatgaagacgtgttacttttagaacattttttattactttaaaacaatttttttagagacaggggtctcactatgttgcccaggctagagtgcagtggcacaattataacccactgcagcctcgaactcctgggctcaaagaatcttcccaactcagcttcccgagtagctaggacttcaggcacccatgaccacacctggctgattcgttttttatttttttgagagacaggatcttactatgttgcccaggctggtcccaaactcctgggctcaagtgatcccccgaacttagcttcccagagttctgggattacagatgtggggcactgtgcctggccttaaaatatgtttttttttttttttttttagttagtggttaacatctacaaagacaaaaaataagttctcattaggaggtacacaaagagagaattagggggagttatattcaaatttatctttttttactttgcaacccaggaatgtttttccctatcctgacctgattcacaacaattaacttttattttttttttgcaggtggaaaagttgagggaggaagaacacagaaacccaaacaatgtgtatgaacatgtttgtgagaaagaggcagggattaccacgactgagcagactctgtgggcgccctcataccacatgctgcaggcaaccacagctaggatcttccttttcctttctcccttaccgctggcacccaggaccacaaaattcattaaagaaatgtttctcactgcttgtgaatttgttttcctttcaggcaatgtgatgacaggctaggttcttatgctttaacagcccatcatgggaatttttaacttaagcaattataaaataaaaatgtactgacgctaaagattcatttataaacctgtcgctttaatctttcttcatgacttgttggtgtaattaggcagctatatagtcacataaaatttcacggaaaaattatatgcttactagttgttggtcatgaaacaacttataacattggacttcacgtttattctcagactaaaaatctaaatgatagcgaaatttaataaaacttcttggaaggcttacagataatttttactttgtaaagcatgtgcatgctttgtaaagctttctcatgcttcagtaaatcagaagtaatgatgggggtacacattttcttacttaaaacttaatactgggaacaagagaactagcacgttgctacagtctcatcaacaactctgaaaaggcaacaagccaatacaaacaaatacagttttccaaaaatacctgataatacttctaaattaagagctgacttcaagggagtggggaataaggggagatttcttaaagaatataaaattatagctagacagacacattaaattctagtgttctgtggagtgctctatagtttatcatattaagtatttctcaattagctagaaaagaggtttttaaatgttcctaacacaaacatacaataaatgtctgaggtgacagatatgctaattactctgatttgatcactacacattgtttcaaaacattactatgtactccataaaaatgtgtcaattttttaaaatcttgttaaaaaactgatttcaactttattttaaaataatttagaagcatagtaatttctggacgtctatttaatgaaatgtaaagaaagaataccaaatatctaaccattcaaagtcaaaaaataacatagatcctacagattgagtctatttgaataggagtaatttctaaaaacaatcattagtttactacttattcctttgcattcatatagtagcttcctaatactcaggttgaaaacaagcttgataagatctactaattaaaatggtaaaactggaacactgtccagtttttaatgttaaaatttaaaatcccacaaactcaaaataaaattacaaaaaactaaggctgggtatacatttcttcatttgctgctctgacattcatcataattagatacagataggaaatttttcagtctctgtagtacatacaccaaatagacatgcaacttgttgttgttgttcaagtctgaaattctcttttcagttaatatatttactgacctcttctgggactctcatgattgaagagaatgccgttcactgcaaagagattatacgcctcacggaagttcaccacaatccaataggcatagagttttgctgcccctgttggaataattttttttaagcaatgaagtttgttgtaaaagacagtgattctcaccatcttcaacagtaacatcttggccgaaataataacttgtaatgcatccaaatacaaaaaagtatcaaaacccaaagacgaaataaaggttattacacctgtcaatcatgttcaccaggaaatattttaagaatttcttacttttgtaatgccaacagtgcattatttgacaatcgaattgattgaatctttcttagatctttttctctctcattctctctctctaacttttgaggaattagaatggaaaaaaatgaggatcttaacattccaactgctttgaaattttatcactgaagtctttcattaatattctccttacaaacatattagacacaatagtctttttttttgaaggttttgagctcaaggaaatttcatggaaaataaaaaaaaacatgaaaccttatcacttcagtataatctcataacagtttagaaaaagaatcacattgggtctgattttccatttcaagtgatctgtatggaagggctgaatgaacatgggttggtgaagtgaggtggtaatttcaccccgaaggcaatggcagcaaatacttgtagttagcaacgtataaaggtatgcttctcaacaagttcagtcactttagtctaccttaatgttaacctcacacccaaatgacttcagctgtgagacatgaacagaatgaaaggaaaaacacacaccccccacacccacagataacgccacacatgtgctccggtgtgcacgcatgttctcaccatagggtgaccggggatagaaaggggtggtctccttctggggtatttcctgcactttcccataaagttcacttgttgaggcttggtagaacttcacagagttgataaggccacaagtcttaactgcatctagaagtcgtagagtgccaactccgtcaacgtccgcagtgtactcagcgaggtcaaaggaaatctggaaaaagcaggcggagacagggctgcattaatagcttcatagcacaaaggtgctgtcagcaggaacaaagactacaatttcacacactgtgaaatgttggtgagaaaatattattttctaacagcacaataagaacgtggatgtcatctacatacagtatcaaattgctaaaaatatcttaattcctattaattacctatggtaatgtgaagaacactttaaccgcccttctactactcgtaattctaggctggagttcctagggcatgggttattatagggcaaaccctattcctcagaattatctgggatcttccttaaaaattcagtctgaaccaatctctttggggggtagggacctaggaaatttacatttttaatgagccccagttgatttttatgtacagagaagttttggaacatgtgctttagaacacagctgaatttaaaaagggttgttttattttctattctaaaggtacaataataaatttgtaatctattacacgaatgcataatctttttttaatttgagacacagagcatacagcaagatgctaatgtatatatgaaccaatttctaagcgaatgctgaggaataattcgatattttgcagttctttagagcactttttaaaaacaagtgtgactgatatgctttctgaaattattctatttatgcataatgaacaaaataatctaatattaagtcccctaaaataataaggctcaaaatctttgtcactggtttattcgtaggctaatatagctgggcacagtgcaaacaggcttcccctgctgcctcgtgaatcctcaactggaaaaacccctttgaggggtaaggtcactggtcttcgtcactgctgggtcctgcatgtgtgccctggagcagaagctgtcccctggcacatgcaaatggtattcaggcaactgctcaccagggaccctatttagaccactaaactcatgtcatttaggcctgtgagtaaaggtcatgtggctgccgggaaatcaaaagaaaaaaagtatgtttcatccacagtctttcaaaggtaagaaagcaaatttggaagtctgttatttttattcttttctaataacagttcattaagatataattcacacccataaaattcacccttttaacagtttacagttcagtggtttctagtacattcacagcagtagatgccatcatcaccatctaagcccagaacattttcatcaccccaaaaagaaactccgtacctagtactcagtacctcagaacctagtatcagcagccactctctggtccccaactctcactctgaccccaacagccctgtcactatatatttgcctactgtggatgtttcatacaaatggaatcatacaataggtggtttttagtgactggcttccttcgcttaccatgttttcactttggttgagtatatacctaggaatgtagttgctgggtcatacagtaacactatatttaacattttgaagaactaccagaccattttccaaaatgcctgcgtcatttcaccttctcaccatcaatgaacaagagttccaatttctccacatcctacatagacttgctgtggtcttttttgttatatccatcctagtggtgtgaagtgctatcttgttgtggtttttctttttcctaataaataatgttcagcatcttttcatatgcttatcagccatttgtatcttgtttttgtagaaatgtgtatttgaatccgttagccatttttaaattgggtcatttgttgagctgtaaaagtttatatatatatacatatgcatatacatacatatatatatattctgaatacaagtcccttatcaaatatatgacttgcaatctttcctcccattatcagggttgtctttttcttttcttttttttctttcttttttttttttttaagatggagtcttgctctgtcacccaggctggagtgcaatggcgcgatctggactcactgcaacctctgcctcccgggttcaagtgattttcctgcctcagcctcctgagtagctgggattacaggcatgcaccaccacgcccagctaatttttgtattcttagtagagacgtggtttcaccatgttgactagggtggtctcaaactcctgatctcatgatccacccacctcagcctcccaaagtgctggaattacagacatgagccaccacgcccagcctacttccttttttttttttaaagacagggtctcactatgttgcccaggctggagtgcagtggctattcacaggcataatcatagcaaactatagcctcaaaacctgctcaagtgattctcctacctcagcctcttgctgaatagctgggaatacaggcatgtggtacagtgctgggctaatgtcttttcacttcttacaggtgtcttatgaagcacagaagtcccatttatctactttttcttttgttgtgtgtgctttcaatgttatatctaagaatactttacttaacccaagatcaggaagatttactcctaatgttttattccaagagttttatagttttgtttcatgtacttaattctatgatccattttgagttaaattttgtgtatggttaggggtccaacttcattttttgcagatggatatctagttgtcccagcaccatttgttgaaaaggccagtttttccctgttgaatggtttttgcactgggtctttttgttatcaggaaaagccatggccttattttgaggaaacagtgcattgagaaggccttgggagagcgggtgtcagggctctgggaccactggtagtggccactgagcagatcactcaaccacttcccctggccgtagtttcctcaccacagcagggccacaactgtaatttatttgacactttacaattcaaaagtgcttttgttcaagctttgtaacaatcctaggagaaacagaaactaggtactgaggttcagaaagatggaggtgctaaaagccacactgcctaggagcagcagaaccaggactccaagtgagtccctggatgaggctcaccacaaaagcaggattcagccactccctccgtgagggtctcataaaagccagatgctctgaggagaaacacatacgcacacacagacacaaacaattgcctacgctttccagagatttgtggattgcagattaagaaaccttaaactagatctttctgaagatcttctctgacatcaagtgtctgtactcaaaatatttttaggtataagttcttatcccatggtatttgcagtctttttcaagggaccagtcaattttgaacaacaatgagaatgttgtgagttttttctctttccttgactagtttttcatttatagacatgccgcctaaacagctccaagaaggaatagctagtatttgttaagtactcagtaccagacacatgcatatcatcctaggcattttgcgagtatatattatttaatcctaagaacaggtaagtatttccactgacacagagaagctacagcaagtggtggcactaaatgttatattcgtggtgaacgttctatatacattgaatagattatatgtggatatgttacattcaccgtgaaccacacatccttgcataagcaccttaaccattagaacatagaataaggaagctgtacaacatgaaagttttcacttatgctagggaatccaatttagatcactaataggtcattattaatttttttattatactttaagttttggggtacatgtgcacagtgcgcaggttacatatgtatacatgtgccatgttggtgtgctgcacccagtaactcgtcatttagcattaggtatatctcctaaagctatccctccccctaccccacaacaggccccggtgtgtgatgttccccttcctgtgtccatgtgttctcattgttcaattgccacctatgaatgagaacatgtggtgtttggttttttgtccttgtaatagtttgctgagaatgatggtttccagcttcatccatgtccctacaaaggacatgaactcatcattttttatggctgcatagtattccatggtgtatatgtgccacattttcttaatccagtctatcgttgttccaggtctttgggttagttccaggtctttgctattgtgaatagtgctgcaataaacatatgtgtgcatgtgtctttatagcagcatgatttataatcctttgggtatatacccagtaatgggatggctgggtcaaatggtatttctagttctagatccctgaggaatcgcctagagcacataactcatggaaaagaattaagcactgttagactaaagatagtaaataagataggggagcatgggggaaaggatggttgtgtgtttgcagatttttaggtaactgcagagaaaattaagcatatgtgtttgatattcaacatgctacaggataagattagctgataaaatctaattggttacaaagtgttttacaatataaagtaacaaattaagtggtttccttaaaaaaagaaaatctgaacagtacattgtggctgatcaattcctaaagcttagaagtgttggccaggcacagtggctcacacctgtggtcccgacactttgggaggctgaggccagaggatcagttgagccccagagagcaagaccagcctgggaaacacagcaaggtcctatgtctacaaaaaaaattaaaagtaaaaaaaattagccggctgtggtggcacataccagtggtcccagctactcaagaggctgaagcagaaggattactcgaacccaggaggttgaggctccagtgagccatgatcatgacactgcactccagcctgggcaacagagcaagactgtctcaaaatgaaacgtaggttaaaaaaagaaagagagagagagagattatttttaagtaaaactaaaggttagaagtgtgattctgaaacacacgaaaacatggaaggtccagagagctacagcccacaggccaaatccgacctaccatctgcttttgtaattaagttttataggtcatagccctataaacattcatttgtttacaggtcttctatgcttgtttccacactatgacagcaggcttgaatagctgcaacagagttatttcccatgaagcagaaaatatttacgatctggacctttacagaagaagcttccaaacccccaaaactaaaccatagttataactgggagccaaaatgagtagggttttggttgtggttggtttctatcattatctttttctctatcttctcaatactatgggatgattatgaagtatgcatccaatcacaaagagagttgcattttcagaggcatgcagaccaagttaacagtaaaaatcttatttcacctaataaggagaacaaaaaatcagactgatgaaaaaaaaaaaaaaccaagcctacaaaatactgcccaaactcgctttcttgaaagattttcttcagtgggctcccacatcgcatattcttccaattttctttccactcgattggcatcaagtctccaggctctttcttgtgccagtgcctgcaggtctaccaggtcccctgcaccccgactctagccctgggctcagtgctgagggttttctccccgacccaccctccagctgtgtcatcactcagtccgaggtctcaattcaccatctgtccaaatgggcccaaaggcccacctccagggcacctcttggagcaacagcctctcatatgttcacatgtcacactgagatggccccaaacagggttcctgaagctgtctccaaagctcttctttcccatggcccctccctgtctgtaaatagcacccattccaagcaaaacctagaaatcttccctaacacttccttccctgcacagttcactgaaatttaaccagttcccaccacttagcccacaccttaatttagtctggcatcacctttcatgggaaccactgcaggaacctctaactagttcaatttgagtcctcccccacctggcaccctggcacttgacctcataacctaccacacttatcccccactacgacgatgcagcctctccggccaccctgctgtcctagtctggcgtcagctggtcctgcctggagccttcacgctgctgacccctctgtatgctgtgcccctcaccactgccctgcctccctcgctaaaaacatcccgtccttgccattctatccttatccacccgtctttatcctgcttcatttcacgttaactttaaacttttatctgtttacttatttatgatctatctccccaattaaaaggtaagctccatgagagctgggtttcatcttgttctccgcagtgtctcccatgccggaagcacgccttggcacagtatttgctgagtgaatgaagacagtgagtaaactaatgagaaatctaaatgtcaaatatacaaacatcaacacaaaaacacaaaaaccagtaggaaagaaaatgagctatgagaatgataaaacaagtttgataatttaatattactgaaataaaaggtaaaatttcaaagggcaagacagataaaactctctataaattccaaagctctagcataacaataacaatagttttcacagttacgctatataaagagtcagaactcagagtgcagaagaagaatcttagacatactcgaagtgcaggcaggaggagatagttaggaaaatgcgcaaagacactgcgatgggatatcattcttaaggcgcagtcagggcagcctcaggggcgagtagcaaagccagagaaatgagagaaagatttaaagtcataggaagcaggaaatttaagttcaaacataaagttaatttatcaacattcaaagatacaaacagatacccaaagaattgtccacatttatttgtgagtggtaaatcatagcctttcttaaaggaaacagaaaattagaattagtcctttaaatgggctgaaagggaccagatatagatgctgaaagttcacgtgtcaattctgtagtctacaaaatggaatgtaaatcccatgtgcttttaaagctgcatcagggaaggcctgagttcactgtgctagacctcacagcaaataaaacaaatgacaacaatcattccaggatcactgaagcccttttacccctccaaactcattataactaaatgttaattttataactatgtgaaactgaacagagatgaaagagggcatgctaaccaagtaggataagataaatgccactattcacatataatatattgactagtcataataatgacaaactatcacttatattagatgattacaagagaaaatacagtgtgtctgattagtggagtggttgtcatgtgttggtaactacagtgctcacaattttacatatttaaaatgaccaccaaaactgaatccttgaggtcagaaatgtcacacattgtgactctttttccaagaagcacagcaagtaacattccagctcctgaagccaggatctttgatgatcctgagacactgctgatcaggcactattctggaactctctgcaaggcccactcccctcttgcggggtttacagtgttccaattcctcgccttggtcctgagtctctcataatggactagctctcttcctcaaatggtagtctgggaggggtaaatttcaggttcagggagagaggcggctatagtcatcaggagtctagtgtgagtggtctgccaacactgacccactgcatctccctcatatttcctccccacatactgtactcttacttcaaaatattaatacaattaaagagcacacatttttaaaattctgaaatctactgaacgcaaaagctggggtaaatgaaaaagatcacaaacagcccctaccccactagactgtaaactctacagcagcagggcccttgactctgttcaccattaaatccccaagaatcatacagaggtaaaaatatatctgtaattttaaaacagaaagccacgtgaagagaaagttcatttatttataagaaattggcctggtgcggtggctcacacctgtaatcccagcactttgggaggccgaggcgggcggatcacgaggtcaggagatcaagaccatcctggctaacacggtgaaaccccatctctactaaaaatacaaaaaaattagctgggcatggtggcaggtgcctgtagtcccagctgcttgggaggctgaggcaggagaatggtgtgaacccgggaggcggcgcttgcagtgagctgagattgtgccactgcactccagcctgggtgacagagtgaggctccatctcaaaaaaaaaaaaaaaaaaaaaaaaaaaaagagaaagaaagaaaaaaagaaattagatgaaatatatatttatatatttaattatcctgtaaatgttaatagaactattatcttctaaagtgtaaatgaattaagggaaggtatttgaataacaattttagtaaggaaaaacatttcaaacacagcagaagagaagtccataacacattaatgagtaaggctgaacacattacaggcttttcagctgaaacaagaagaagaatatatgtaggaatgtgaagacaggcaaaattgcttgtaacatacgttgtttgcctcttcagtcccgtatggttcagtggggcggcctctaagttccaagtgatttgtcctttccagtttgacttcctcccatctcagagtctgggtgttgccctttccctctactcagaacattttccccagggttcactcctcccttccttcccccaagaggccttcctggacctggccatctctaccttcacctcatcctcccctggcgtgcttcacctcggagttctcagtccattggactctaagtacagagaaagcatcttcactggtttagtgagcttgtaagctccatgaggttaagggctctgtttgttttttctcattgctcccaccacttaaagaatacctgccacatggagagtactcaggaatattacttgaataaataagacaacattcagtctgaagtttaggcatataattccccaatgatttcagtacacaattaagaatggaacaaactttatatatggagcaaattccatttaaaaaatctcaatgaatgagccaaagtttcctgactacaaatgtggtgtcggaaaaagagatctgtctgcaaaagaactacatgtggtaaaagataaccagagaacaggaaatcttttcctctaacatttgatttcacagacacaagaggaggctcatgataccagtgagctggaaatgcctaagaccacacaagcagctgcactgtttactgcttctctgtaagtgaaagttattaatcaaggacagcaacaataaaaccttacgttccatcatgaaccagtttttcccagttagcagctcagcagagctgacattgacttagcagctggggccagatgcagatctttcccccgcccccgccccgctccagagctggataggagtcaggcaggtgcagacctagaagcactgcggctcagtgggcagggaaggaatggagagaaggcgctacccgaccaggagcaggccgcaggctgtgattccaggaaatccaaaggcgacagagacagggccttgccttgccctcctgtagcctgtagcctgccttatgggtgtcgagtagacagaggtttgaagaggctacaaaagggaggccacagggattaagaaaggcatcctgagatggttacaaagtgtggggtgggaggatagagatccaaaggagggacagatgacatggacagatcaaagtagggtccgcaggcacagggaggggaacaacacacactgggacctgtcagggaggtggaaggagggagagcatcaggataaatagctaatccatgcagggcttaatacctaggtgatgggatgataggtgcagccaaccagcatggcacgtgtttacctgtgtaacatacctgcatgtcctacacacgtatcccagacttaaagagaaaaagtagggtccatgggggtgggcaggggtgggggatagggactgggggagtgggggtttggaaaggtgaggatgagacattctaaagggggcagtgatcatcagcatgagcaaaaggagagataaatgcaccggcaatgtttggggaataaagtgctatatttatgtaatgtaagtagaagctattctggagcaaattatatatgccagtctatagtttgttcagtgggcactggggagccagcagtggctctggagcagaggacagcatcactttatctgggccctttcaccagtgctatactcccagcctcttctatttgcctccagcccagcccaaggcccagctctatagttcagaaactattcttcctcacactcataaccccaattttgtatgatttttccttattctgttgcaattatatttttcttcaaaaatgtttataattacaatttggaacatcatacagtcacagggttgttactccagagtgacaaatgctaaccagactaaacaaatgtgacatctttgtttgcctttgtatgctcaaggcatattaaggtatagttccactagagttttgaaatgctcaaagtagactaagggctctcacagggaatcagaacactgattacacatgacaaggtaacaatccccaaacgcaccctgctcccagtgactctgatgagaggcaaggctgcacacactgcttctgtctgtccgtccactctccacactgtgggggccatggctttccatctctcacccctactgcttagcacacaggagggctggaaaatatttgttgaaataatggtattgatttttgtcatgtgtttacattttagccacagaggcgaattggagctctcacaagtcagagtagaaagcatatgcagggctctgttctcacagcaccctccagctcttgctttttttctaaggactcagccactgctctggaagactgaccgtgctttaacaacctcaccaagtctgccagctcttctgacttactccaaaacgaagaacagctgccccagcaacattccttgagtttgagaatcttcatttctaaaatgttgagttctgcaccccgcaccctgacttcagttataactccgtggtcacaattctttgccacttccacaacctctgagaacctctggtgccattcctgaaagcctttcattctttttcaattaaaaaatatataattttaaaataaattctaatttgttctaattagttaaaattatttaaaacaaatattaaactaagtctcctgggtttttgttttttttttttttttagaaaatcttaatttaaaaatactttgtgaccccaattatcagaaattagccatattagatgccttttctctgtcattttacagtttatcagctgctgataaatacagaaaaatctgtcatgatttctgtataagaaaatggcaccagaagtaactatccgggtcttttctagagaaaaactcactgagattctttacagataaacagaaataacaaatcaacttacttaatggaatttattatagcaggaatacttaaccaaggattcacagggtccatggataaaactcaggagagcacacagatttggattaaaaaattttaaaatgcatgtctttattttcactaaattctatctgaaatttagagttcccttctattttgaatgtaagccacaatcctcagtagtaatagtacttgtgacctttccatcaatagggacaacagccatttcaacacgactatacagtcgccgcagatgcctggaggcatcacttctgcccatcactgcttaagttccaatgtttaccaggcccactgccaggtcttgtgctataatcacaaacctggtttttaagtatattaacagattaagagtcagtttccttggcaattctacacatttggttttatacctctaaaaacattattctgagaatatccatacacttcaccagattgctgaaggagtccatggcgtaagaaaggttaaaacgtcccctgtaaatcaagtggtagtgacaaaatttcagtattttagaatgtgcttaaagaaaaaaagtcactaaatctctcttaccacctatatccagccagataaataagctctcatcagccattttgaaatctgcacgtgtgtgacctaaaagcatcattgctacataaccaattgctcaatggtttgggtcattcaataggttcctgacctcaatgacaaagctccaaaagtacataaatacactaaggcattaacatgacactagagatgtacacacaatcaaaaattaaacaattacattagcttttgaatgcattttgtaatgtttataactttaatctgagttattttgatcatatatctaccaagatgagttaacatccccaagctctgttggcagagagtgatagcacaggagtgaataaagggactgattatatgaggggtatttagccaatggcctgtacccctggggattaaaaatcaggggattaaaaatatttgttggaagataatcaagagataaatagaagatttaatgtttgctgccagttaccacccagattatagtaatttggggacaaataatgaaaagtcacttcagctgcatataaagagactgaaacacagtaaacaacatacagtcttcattattataatattattataaagttttactttccttttatgaatactataattacatttaaaatggtcactactataacattaaagtaggaagagagcaataaccttggcatctaaatagctaataattctttagttaatagataaaatgacagaacaacaacaaaaaaaagagaacttactgaaatgcttcaatgactgagacgccacaacatggcctgtggttacaacaatgtaagtctcaactatccatatgggagagttcatttaagacaagaagtagagctaaggcttctaggcaggacaaataactcagtgttgggagccttcaatcccactggcaagtggtatatccaagtctttgtaagtcacaaaacaagagaggccaaagcaacatcatattatgtggataataagctgttttccctccttcctcacctcgatttctcttgacctctctcctccaaaaatagcagatagtaaattaattttagaaggaatattaaaaaaaaaaaacctaagctgtgagagaaatgtaaaagagcctttttaaaataagtaagccctcatgagatacctacatgtttcactagaaacattttattgaaagacttggaaaggagggccagaagctcaaaaccaacaagaactgtgtgatacactggcaagcaaaaggaaaatgggaaaaggtgcctttaacaaaatggagtaaaattaaaataatgctcaagaaagaacagagtggggttcaagcacagaaatgcaaaataaataagaacagcaaccagatacagagagaaggctgctagagaagtaggcacaggagggatgcagaggtccgggaaaggaacagccacacgttttctctctatttgctgtggaagacacaaggcaggttccaagtctcaaactgatgtttgagacaggcaggtaggaacactggtaaatatcaaggagcctcttgatctaacagacaaactaaaatgtcgacaaattgctaagaatgactggcattcaagaagtcaggagtgatactgtagaactacatgcactatgatgaaaatgccaacagattactaatgcccataaaaaggtaaccaatgggctgggcacggtggctcatgcctgcaatcccagcactttgggaggccgaggcgggcagatcacctgaggtcaggagttcaagaccagcctggccaacatggtgaaatcccgtctctattaaaaaaaaaagaaaaaaaaattagccaggcacgatggtgggcgcctgtaatcctagctacttgggaggctgaggcaggagaattgcttgaacccaggaggcagaggttgcagtgagctgagattatgccactgcactccagcctgggcaacagagtgagactctgtctcaaaaaaaaaacaaaacaaaacagggtaaccaatggtcacactgcagatgaactcaaactgccaggatattgttagatatcattttcatagtgaaaaatctagcaacgtctatggcagcacaccacataaaggaataaagataatcccatggcagaaagtaaagtggctttgtgagaatcaataccgcctcacgatttttacaaaattctttaagggataaataagcatatgggcaaggaagaatgagggggaaacccatggacataattcacctagactgtcataggccttgacaaatactgtaacaaagtgcatttcagaaagcagtaacactgactctgggactgggagaatgttccagctcccagtcaccaacagcagactctgctgcatctccagcacctcccaccccactataatcaggaaacttcggacagaaaactaaaagtaggagtaaaacatacaagctgaaaaagcaaaatatacaaagtagatcctgtcaatggccagtttagagattattcttacttaatgttttaaaaacaatctaggaaagggaatacactatgaaaatctcctaaggctctaatgtttttccagaaaagtagaaagtcacattaggaataggaaactgcaagatctcttggggctacctaaaggacttgaaaaatgggaagaacattcaaattggaccatttgaagacaatgcatttcaaacaggaggggaacaaagaaaactgtacccatagtctcagagtactgaatatcctcagtttcctaaagacaccaggctttggtttgacactaacaagccaagaaaatgtagtctcaacaaagaataagcagagtagaaagcagagtccctctgcagaagcctgaggttcctgcacccctaggaggctgtgaagtcctggtaaccacactttgagatggtcacctggaactcgaaaaatatctacacaactcaagaaaaatgttccaggaaatacagtggctagtatatgaagaatgtcaccaaaaaaattagacttctttggcttgtgaactctaggtcaggaagtagtacaatgatttaggctttgtaaaataataaagaatatggatagagatcatagatcagcccattatgagtccagaagacctgaatgagggtatactctttgtttaagtctgattaaattaatagaaaagaaggttgtcttcaactgaccaatatttgaagaacaatgtgcttattctgctccatttggaggaggccaatctcttgagaagcaaatcatacatacataaaaccatgaattttagaggcaaatttaataacaggaactacctctgtcttgttcaccagtatgtgcctaacccagtgcctggcacataacgggaacacagcaatgtttcttgagggaatgaatgaataggagcagggtgttccaatatcatccaatatggcaaagatcctcagagaagacagtatttccaaaaggcttcttcctctgtagatgcctttttctaaattccatgtttaagcttctaatggagaataatttcaataataacaatgatgtaacaaacctgatataagcatatgattaggaaattcagcaacagatactataagaggaaaaaattaatgataatagtatactggtattaatacttctggtattaatgtttagtagtattaaacattactttaaaactagcatctttctaatagaaacaaaaggtattcaccacatagtttccaaaatggaaaaacatgaatgctgtgttttcaactttttcatatttaaattgctgtgcaatacagtatttagattttatgggaaaacacaccctacactgaacaggagatatatcttattttcttttgaatattgctcatgattattctactacaacgcaggtcaatgtctgtttccttgggatctgcgggctgatgagaaacaagcaaagcacctgaagacaagaggctggaagagaatgatgcctgtacctatggtactgtaggaaagcagaggaattgagaaatagaaattagttcaaagtaaaggggaaaaaaatcactatccaagttggagttcagcaaaagaatcacaaagcagaggaagaaaaatactaatttgctatgaaaagtaattccattgggtaagtgaaaagatgcttgtgtatgtatgaatgatgaatgagaaacaagaagaaattgacatagaaagttacttatgacaattaactaaaaatccatattttgccaataaccaacaggcaaataaatgagcctctctaagcctcagcttctttctcctaaataccataccctgactcttctatggaattcaggatgccacacaagtatctagcaaacataaatttgaagttcagaagaagcaaggaaaaccaacattcaatgttcaattcaaaatagccagtgagggagaggcaccaattagaagcagctgcagtccatggcactcatggagaggagtgaaaggggtgagtgaatacagcacccttagctgaaatacctaggttatcgcattggaacggactaggaaaacaactcaacccatggagaatgaagaaaagcagggtggggcaatggcccacctaggggcatcatggaggcaagggaacccccacccccagccaagggaagtgatgagtgattgtgtgacactgggaaagcatgcttctcccacagatctttgcaacccacggatcaggagatcccctcgtgagcccatgctaccagggccttgagtctgacacacagagctgtgtggagtcttggcagaacagctgctcaggcacagacacagacccagaagctttacatactccagccccaggatatccagcaaatatgtctacagctcaggcaaggcaagaggtctgcacataccctaggaaaggggctgaatccagggaaccaggcagcatcattctgcgggccccacttccactgcacttcacaagataagacctactgtcttggaattccagctggccaccagcaacagagtggagactgcctgagaccagacggagcccacggagagaggggcaggctgccacctggattgctggataactcagctgttccaacctgcgggctttggagagtccaaagggtcccaacgaggaagggtccccccagcagtgaaccaaagcagctttgtcagttaaaggccagactgctactttaggcaggacatcaatccattcctcctcactggacgggacctacctggtgggcccaccagccatgcccaagcgcatgtattagggacagagctctgatgtctccctgggatggagtgcctggaagaggaaagggccaccacctgggttggttggataactcagccattccagcctgccagctttggagagtcctagccgactgaggcaaagggggttccccaccatgaaggctgttttgtagaggtgtggccagactgcttctttaagcaggactccgttatactcctccttgtggggcgggtcctcccagctggggcctccagccaccccctcccaccccatgttctttggggcctaaagagctctaatttcaccctggggcagagcgcctgagtggtggggcaggtcatcaccttgcctgtttgggctgcctgtgggccatggagagcccaaaccaatcaggggctgaagggatccccaacacagcatagctgctctaccaaaaagcagccagattgtttttttaagtgggtctctgatcttgttcctcctgagtgggtgtgacttccaaccagggtctccagccacctcctccaggtgcgttcaggccagcaataggtcagtacccttgtgggatgaagcttccagaggaaggggcaagctgccatctttgctatatcacagccttcactggtgataggtactggaaaaactgaggcaactagggtctggagtggccagactattaaaaacaaacaaacatacaaacacaaaacaacaaaaacaaaaccacaagaactccatccaaaggtcagcaactcatttgtaaataagcccacaaagatgagaaaaaaaatcaacacaaaaactctgaaaactcaataatctggagtgccccttttcctccaaatgactgcagtaactccagcaagggctcagaactgggttgaggatgagatggctgaaataacagaaggagacttcagaatgtgggtaataatgaactttgctgagctaagggagcatgttgtaacccaaagcgaagaagctaaaacaatacatatgggagctgacagccaaaatagccagtctagaggaacagaaccaacctgatagagctaagctaaaaaacatgctacaagaactttacaatgcaatcacaaatattaacagcagaatagaccaagtggagaaaagaatcttagagcttgaagactgtctttctgaaataagacaggcaaaaaagaatagagaaaaaagaatgaaaagaaataaacaaaacctctgagaaatatgggattatgtaaagagaatgaatctacaactgactgggatacttgaacaatatggggagaatggaaccaagttggaaaatatacttcaggttatcatctaggagaacttcctcagcctagcaagataggccaacattcaaattcaggaaatgcagagaatccctgtgaaatacttcataagaagatgatccccaagacacataatcatcagattctccaaggtcgaaataaaagaaaaaatgttgagggcagccagagagaaaggccagatcacctacaaagggaagcacgtcagactaacagcagacctctcagtggaaaccctaccagctggaagagattggtggccaatattcaacattcttaaagaaaagaatttcctatctagaatttcatatctgtccaaactaagcttcataagtgaaggagatttaagatccttttcagacaaacaaatgctgagaaaattggtcaccaccagacctgtcttgcaagagctcctgaaggaagcactaaatatgaaaaggaaaacctgttaccagtcactacaaagacatactgaagtacacagaccagtgacactatgaagtaaccacataaacaagtctgcacaataaccagctagtatcatgacaggatttaatccacacataacaatactaaccttaaatgtaaatgggctaaatgctccaattaaaagacacagaatggcaagctggataaaaaaacaagacccattggtatgctgtgttcaagagactcatctcacatgcaaggacacacataggctcaaaataaagaaatgaaagaaaagttaccaagcaaatggaaaacagaaaaaagcaggggttgcaatcctagtttctgacaaaacagactttaaaccaacaaagattaaaaaaaaaaaagacaaagaagggcatacataatggtaaagggctcaattcaacaagaagagctaactgtcttacatatacaaacactcaataaaaaagcactgccaagttcataaagcaagttcttagagaccttcaaaaaaagacttagactcccaacaataatagtgggagactttaacactccactgataatattagacagatcatcaaaacagaaaattaaccaagatattttggacctgaactcagctctggatcaagaggatctgatagatatttacagaactgtccacccagaaacattcttctcatagccacgtgagacttactctaaaattaatcacataatcagaggaaaaacactcctcaggaaatgtaaaagaactgaaatcataacagtttctcagactacagcccaatcaaattagaactcaagactaataaactcactcaaaactacacaactattaatacatggaaattgaacacctgctccttaatgactcttggataaataatgaaatgaagacagaaatcaagaagttctttgaaactaatcagaacaaagagacaacataccacaatctctgggacacggctaaagctgtgttaaaagaaaaattcatagcactaaatgcccacatcaaaaagctagaaagatctcaaattaacaacctaacatcagaattaatagaactagagaaccaagagcaaacaaaccccaaagctagcagaagacaagaaataaccaagatcagagctgaactaaagaagacagagacatgaaaaaacctgcaaaaaaaaaaaattcaggctggtttttggaaaaaaattaataaaatagactgctagctagactaatcaagaagaaaagagagaagattcaaataaacacaatcagaaatgataagggggatatcaccactgttcccacagaaatacaagcaaccatcaaagaatactacaaacacctataagcacataaactagaaaatctacaagaaatggataaattcctggacacatacactctcccaagactgaaccaggaagcaactgaatccctgaatagaccaataatgagtctgaaattgaggaggtcaaaccaaagaaagcccaggaccagatagattcacagttgaattctaccagaggtacaaagaggagctggtaccatttttactgaaactattccaaaaaattgaggatgagggactccttcctaactcattctatgaaaccagcatcatgctgacaccaaaacctagcagaggtacaacaaaaaaaagaaaaacttcaggccaatatccttgatgaacatcagtgcaaaaatcctcaaccaaatactggcaaaccgaatctggcagcacatcagaaagtttatccactacaatcaagttggcttcatgcccaggatgcaaggttggtttaacatacacaaatcaataaatgtgattcatcacataaacagaactaaagacacaaaacacatgattatctcaatagatgagaaaaggccttccataaaattcaacatcccctcatgtaaaaactctcagtaaactaggtattaacagaaaatactttggccaggtgcggtggctcacacctgtaatccaggcactttgggaggctgaggcgggtggatcacctgaggtcaggagtcccaagaccagcctggctgacatggtgaaaccccatctctactaaaaatacaaaaattagccaggcgtggtggtaggtgtctgtaatcctagctacttggtaggctgaggcaggagaatcacttgaatctgggaggcagaggttgcagtgaatatgataaactcacagccattatcatactgaatgagcaaaagctggaagcattccccttgaaaaccagcacaagacaaggatgccctctctcaccactcctattcaacatatattggaagttctggccaggacaatcaggcaagggaaagaaatataaggtattcaaacaggaagagatgaaatcaaactatctttgtttgcagatgacatgatcctgtatctagaaaaccccattgtctcagcccaaaaacttctgaagttgataagcaactttggccaagtctcaggatcactgtgcaaaaactactagcattcctgtacaccaaccacacgcaggctgagagcaaaatcatgaatgaactcccattcacaattgccacaaaaaaaataaaatacccaggaatacagctaacaagggaagtaaaggaccccttcaaggagaactacaaaccactgctcaaagaaatcagagatgacaaaaacaaatggaaaaacatcaaatgctcatggataggaagaatcaatatcatgaaaatggccacattgcccaaagcaatttatatattcaatgctattcccattaaactaccattgacattcttaatggaattagaaaaagactactttaaaattcatatggaaccaaaaaaagattccaaacagccaagacaatgttaagcaaaaagaacaaaactggaggcatcatgctacctgaattcaaactacactacaaggctacagtaatcaaaacagcatggtactggtataagaacagacacatagaccaatgaaacagaatagagaacccaaaaatgagaccgcacacccacaaccaactgatctttgacaaacctgacaaaaacaagcaatggggaaaggattccttagttaataaatggtgatgagagaacttgctagccgtatgcagaaaactgaaactggattccttccttacaccatatacaaacatcaactcaacacggactaaagacttaaatgtaaaacccaaaactaaaaaatccctagaagaaaatctaggcaataccattcaggacataggcacaggtaaagatttcatgaccaaggcaccaaaagcaattgcaacaaaagcaaaagttgagaaattgtatctaattaaacagaagagcttctgtacagcaaaagaaacgatcaacagagtaaacagacaacctacagaatggaaaaaaatttttccaatctatccatctgacaaaggtctaacatccatcatccattaggaacttaaatctacaagaaaaaaataaaccattaaaaagtgggcaaagaacatgaacagacatttctctaaagaagacacacatgtggccaacaagcatttgaaaaaaaagctcaacatcactgatcattagaaaaatgcaaatcaaaaccacaatgagataccatctcatgccagtccaaaaggctatttaaaatgtcaaaaaacaacagatgctggcaaggttgtggagaaaaagaaatggttttacactgttggttggagtgtaaattagttcaaccattgtggaagacagtgtggtaattcctcaaagacccagaggcagaaataccattttatccagcaatcccattactgggtatacattcaaaagaatataaatcattctattatgaagatacatgcatgcgtatgttcagtgcagcactattcatattagtaaaggcatggaatcaacctaaatgctcatcaatgatagactgaattaaaaaatgtggtacatatacaccatgggatactatgcagccatgaaaaggaatgagataatgtcctttgtgggacatggatggagctggaagccattatcttcagcaaactaacagaacagaacagaaaaccaaatactgtgtgttctcacttataagtgggaggtgaatgatgagaacatatggacacactgcagggactaacacacactggggcctgtcagagggtggagaatgagaggagggagagcatcgggaagaatagctaatgaattctgggcttaatacctagatgatgagatgatctctgcagacaaccaccatggcatatgtttacatatgtaacaaacctgcacatcctgcacatgtacctctgaacttaaaataaaagttagaaatccccgcccccgcctccaaaaacaagagaaatagccagtgagtaatctaatgagaggtataattaagaaacagggctggccctgagggtgaaaacaagacatctgggcatcactgaatatccaggccagtacactacagctgctcctagtgaccctaatgtcctttataaatctacccccttaacaccttggatctctcatgactcattggcctataggcaaaattcttcaaacaggtttcctggtctctatctggcatttctacaatccatcctccatgctaccaaaattatctttctaaattgtaaaacctactcaggtcacacccttctaaagtataatggctcccagagctttcgggtgaagttcaacagcttagcttaaataattccagtaggccacaattcccactgctgccactctctgtacagcaatgatgaaattttaaattagaaaattaaaaaggcatgactgggtaggaatggcccaaaacaacacaaagctactgaaaaacaaagcagaaagtaaggctgaagctgcaagtctgttgggagttcaaggcaaaggtgggatttcagcccccatgagtaacagggtaacagctaaaagcacctagtgaagagggaattcagtcaggcttgttgcttaaaatccaatgcagaggcagaattttccagcccatgaaaaaaagatcaaagaagttgtttcttttttatttaacataaagttaagtgtctaaaaaaagaggcacatggcaacagacaaagctttacacaagggtctgctccagatgcctgctggcttttccactgaacagagctgttagatttccaatatcagagctggatgaagctctatgccaccaatatagaactagttctggaccagagcatcctagaggctgaatggtggcagccacacaaccattaaccatacgggataagaatacaagaggggtaggggtcctattcaatacaggcttgcaaaccgatttttttttaaaaagaacattaatgtcaagaaagaaccaataagaactatttaatgtaactgaagagaacatttactacagagaacatgaaaataagatagcattctgaaaatgactttgaaacatctctctttaacaatgacttttaaatatatcttaaaccaagaaaaaaaatcagctaaaaacaagaaagcatttttataagcaggctaaaatgaaacaacagatttgaaaaggaatcaaaattctggaaataaaacattcaaacaacaaaactaaaaatatagaaaggtgcaagcctttggaaaatacacctagaaaactcatagcaagaacagacaccacaagaagacacacaggcagaaaacatcccagttcagtgaaaagagggagcaagagaagggtgattggtgaccacacaaggaagaggcgggctactaaaaccgagatcttcaagaactgaaaggtggcagaagtttactggtcttaaaatctagcttagaggaaaatgggcaagtcagaatttgcccctggcactagtggtatttgggaaatggttcatttccataatacaagaaccactttatttttccacagcttcaagatgcacaaaccttagcttggtacactggcatatttatgaccctttgaaaaatggatgacctagaaaactagtgagggaccataattttaagtttcaacatttcttttactcaaaataacattgctttccttgaagatttattttaataagacaaggtcttgaatcacaggtaatctgtaaacgtgttcttaaaaacaaatgagaaaaggagcttcccaggggagttttctaaagtcaggtgagatgttacctgctttccctacctcaaattactcttgcttctttccaggttaactatccagggaagtaccagtgccgtctggacaagtataatacgaaaacagtgtgcttccctcaatgctggaggctgatacgtggtacaacggcagggaaaaaactgataaggcttctaaacttaccatcaacaaagacccagaacttgcatctgtgaattccctatgaaacctagtctttcactaccttaaagagggcagaaaatatattaagaattaaatacctaagaaagttgtcttaagtttctaagaatgtggtgctacattatcacaaagctgtattaatagctaatcttcagacttctctgtgaaggcagactttacataatcaaacactacagtatgaaaatgaaaggagggctgtaggagtgatctcaggagaccctgagaatcatgatgactccaaacctctgtcacaaagctttaagcatgccattagttttgcttatctctccactcattgctattaatttaatggtctggggagctgtcagggatatttggtaagagcaatttctcttccaggataatctccagcccattattcaaaatttttttagctttaagctacacagaatgagagtaagggggctgggtagggaagggaggtaagaaggatggtaaataagctaagaagcaagagacaacattttttcaaaggagatattgtaaacactattctctttatttcacactgcaaaagcacaataaaccagtagttgagccagaagaggttttgttgtttgaggcaacgttgtaccctctgtgatgagtgacatggtagtgctctgtgagtttgcttacacaagccagagccagctgtgctagaagcttccctactacacagaagttaggggcagaaaagggacttgagaaaccaccagagaacattagtatgaagatgtaaaaagatagcccattcatattttccttatttgtgtcaagggaaaaaagactgagtctaaatgtgggaaaggaatttttaaaaccttttttcaactttttttttcttcctttctatttatatacatacatttaaaacacactcgaagtttaaaatctactgaaaattgctgtgtctctcaattggtatggaattttctctcattttactcttttcagtttttgcttaagacacattgagtatttgcaaaactatcacttgacagtcgtatttttgttcattcaacaaatatttatagcgcaacacctaaggccctggaactgttctaggcaccaggacacaatcgtgaagggaacaagcaaaaatccctgccttttagagcttacattctagtgagaggagaagaaaactgacaatataaagaggtgaaatatatagtaagttcaatagtgataagaactatgggggaaaaaagctggaaagggagaggacgttgggttgtacttttaaatatggtaaagcttttctaagcaaaagaatgaaacataaaaatggaaatgtagtaggcactgaagaagcagttgtagtctacttcatagtaatttaagtttgaaatttgccatgtgccaggcactaggccaagtgctttacatgcactctgccatttaagtattatgacaagtctgtgagtcagggactactattatatttattttacctctcgaaaaaaaactaaagctcagagcaattaaggagcttgcttatggtcacagttagtaagcaacagaactgggattaacaccaaggaaaaaataataacataaggaaaacaaccaaaccaccaacaacacatacacatacatgcatatgcacagcccccatatgcattctttactattttctataacatatactattttctttaactacaagctagatacagaattggtagcctaattttctgtgcaatttaacaccaagatgatgcttcactttttctaaaaacaaggtggttgtgatttagaatcaggttgcctctaagagtatattttcatgatggtttttcataattcagagtatattttctcttagatacaatatagtaaatagtggcttaacttcatataagcctacgtgattcaggctgaagctaaataaatatacaagttaaaaaaaaaaaagaatgtgataatatatcctccctgcaactgtaccccttctccagcccaatcccaccctcatctcctccctttgggatgaaagagctccttcttggcggtgggggcgaggggggctccaaacccagggtgctccagagtgtgctccaatttgggctccctatccagctcaccccaactgcacgttcttcccggtagaataaccctccatgtgaattttggaacatgcatgccatctgtaataatgccatgtcctgtgtatttaacaagaaagaattattttgaactgtagaaacaggcaatcagggcctgataggcttaagtattgtcaatgtttaaaaacaatatttaaaaacagtgtttttaaaaaataacaaaagaaaataaatcaatattttaaaatgagaagtggattttgaaatattttgaatgtttgttagctagctttgagagatgaataggatatagataaatggtttggaaaaaaacacaggtgagaaccaaaaaaaaaaagcttaagaaaaccccaggttgatctgggcaagctgcacttgtcaagagttatgccgggagcagtgagcagtaagagcagaaaggctggccctcttggattacagaggacttccaagagtcagcaaggactcagagctgcagggggcatgagcccatgctcattttttcttacagtaatgatcctgacaatgggaacggagaacgttgacacaagtttattccacatgacagaactggcatagtggaaggtcatgggggtatgggaatttaggaaagtcctacaagttacaatctggtggttaatgcaatactttccaagacatttaaggccaagaaaagaagtagatagggctaagtactttagaatccgagagctaagaaatgggcatactcttggtgtgaggaagagaagcagagagttggtaaaaaggctgttaatggaagagaaggttacatgtgcaaattcctacatcagaacagctaggctggtatgtggtcaaggtcagggaaaaaagagagagagataaagagtttgctctgaggggagagggtaaccctgagatccccaaagaagaaaggctaagaaaggctttgtgttcacatgttcatattttcacccagcgtgacacttcacatttaaattcaagaggcagaaaattcactctgcagatttgtaaggaaaaatccaaaagactttgtttaatctttgaaacgcaaaaaagctctgagtacctagaacactgtgggcactagatgactaactcctcctagggtcccctgccacaacaaaccaagactggtacactcccttccaaacactcctctctgatgctacccctcggcctgaccctcatctggagattcacaatcacactcctggctagctgctctctgtgacccctgtccagcctggccctgccttccctggtctggagcacatccaatgtgaggggctgaagatacgcccttggggccaggcccagctctactttttagcaggagtgcaattttggacatggtactgaaccttttagtactttggtttcttcatatgtagaagatggatacaaatattattcaccctacaaggcaactgtgaagattttccacgtaggtgcttaagaaatgttagccataggctgggcgcaatggctcacgcctgtaatcccagcactttgggaggccaaggcgggtggatcatgaggtcaggagatcgagaccatcttggctaatacagtgaaaccccgtctctactaaaaatataaaaaattagccaggcatggtggcacgtgcctgtagtcccagctacccaggagactgaggcaggagaatcgcttgaacccgggaggcggagtttgcagtgagccgagatggcaccactgcactccagcctgggagacagagcgagactgtctcaaaagaaaaagaaagaaagaaagaaatgttagccagcgccaccaccaccaccatcccatcctaacaagtccctgtccctttggccttccactgtgacctcttaaagccacattctggtgtaaaggaaattctccattgacttcaccttctgctcagatgttgtctccactttctttcagtaatctggctggttctctgttgatcagtcaattaacctgtattcttactaatacatagtggaacataccccctgacaaatgtcaaccccttatcaattgtttctgttttattctttttttgttgagacagggtctcttgtcacctaggctccagtgcagtgacacaacctcggctcattctaatctccgcctcccaggctaaagcaatcctcccaccttagcctccagagtagctgggactacaggcgcagatcagcacacccagctaattttttttttttttgggggggtagaggcagggtttcaccatgttgctgcccaagttggtctcgaactcctgggttcaagtgatccttccatcttggcctcccaaagtgctgagattacaggcataagcctccgtgcccggccaactgtttgtttttccttctactctaactctctggctgccaaaaaatgggtgttaagtgggcattatcaacttgtggatgttaatattagtaaggatgttgtaatattagtcagtatagtgttcagtcatgtcacatatttttaattagctcccttttgggttctctacccctcctctcaatgttcctaccccttcctattcctcttattctccagcagactatccccttacctcacccagaaaacagacaagtcactggagtgtaagttttctcaaatgctgtacttggataactccaccagtcttcccttctttctgcctcttagtgggagagatgtccctattcctttccaggaccaatcttctcccaggccccgactcccaggctcttccacagctccggcattttcaacttcttcttctggtctcatataagtgctcaagggcccccctaaaaagctccatctcctttcccgcacctggcctactccccacatcgtcacccaccccacttcacttcattgtcaaacaccttagaaagaacagcctgcttggctgcttcccttctttaccaccagtaaccgctggtctcctgtgaccaggctcttaggagggtggccaatgataggcttgactgccaagtccaataccctttctaggactatgtgctcctgactttcctgagtgttgacttctctctctccccaggactttgatcacttcattttgcccaaattctcctctgatccctatggttgttctttctctgttttctttactggcttttctggatccagggcttcgttcatgttgcctagtgtgggattgaacagtgtccccccagaaaagacatgtgtaagtcctaatccctggcaactcagaatgtgatctcatttgtaattagagtacctgccgatgtaatttgataagatgaagtcatacaggggtagggttggcacacagtccaccgtgactggtgtccttgtgaggagagaagacacagacacaaagacacagggagatgtcgtgtgatgatgaggacagatcggagttacgcagctccacggcaaggaaggccaaatcgctgcaaatccctagatgcgaggaagaggcatggaaggagtcccccacctgcttcaaagggagcacagccctgctgacaccttagttttggacattagcctccagaatggtgagacaataaatgccttttgtttaagccacacagtgtgtgggcctttgttagggcagctgtacctgagcatatattctgagtttctgagtattccccaaggggtatttctagcccagtacccccgctgagctccagactcacactacacaacgaattggcccttaactgggcactctgcgagcctctccatctcaccctgtctaaaatctcctcactaacctggtgatctctctggccttcgctgttcatggccaccacctcacctgaagcaaggctggtgatcatccactcctccctccccttcttcaggctaacctcaggtcttctctgctccactgccattttcccaggccaatcctcttgcctattcacccacatcagcgtccaggctgttcctcaacacaccaggcatgttcccgacctaggggctttgcagcacctgttcctactgcctaaaatgtttcccctagaaatctgcatggctaccacccccaactttactcagcttttcactcaaatgttgccttccacatgaggtctctgtgacccatgcccacactgcctccgccctagcactcccaatccttggcctacaggattcatcatcttctaaaagaatatataacttgctggcctgttggcttatttactcagtattactgtcttcagtcatgaatgtactccccaccagggcttaccttgttccccaacaggtcccaaacactgagggccagtgcctggcaaagagaagctgctctttactttcctgctgagtgtgttgatctacaggagatgaacaggcttcctctggtattccaatgaccagctctgtcccaaccaacacatcccctgcacttcccacaaaaagcacagtgacatttcaataggactatatttgaaatagtttatgaatgaaaagaaagaactattaaagggaaaatgatgcagcaccacagatgtgagtagatcgtccagctgcttttcctacagaataaatactagattctctcgggaacgctcacagtgctctgtcacctggatgcagtcccatctcctctcccttgccccagccttgcccagcccacactgcactgtatatccagtccaccaaacttctcttccttctcggagggtatgggtattctcgcttctatgctggctcgtggttttgttagtttcattgctgccttagtcatgtgggggaattcctgaccaattcatccttctttttaatccctcaatcctgaattaggtaacttttcctctatcactttcaacattacattatcagctgcaatagaagaccctacacttctgacttgtggactcctgagagcaaggtctgtgattattccacatgtgtatggacaacacctctgcagagggcctggcagctgctagatgctcaataaacctctgccgaaggcagctgctaaaagaaaaaagaaaatcttactacggaaagtaaaagatgatcctcaggcaagaaacaaaaaagtgcgacggaagctctgtttctatctcttcagggccgtgcttcattattatttcctcattctccaattcctcacaaagctctattttataaatgtttgcagagctttaagttaatcctaacatttactctccagccctcaatctttaatgactccttctctaaaaaaaaaaaaggcagaaaaagtaaagatttatataagttcaaaagaaacttaaaaatccagacaaagacttatcatcagccacgtatggaatgtgagtggattcttgcctaaaaagctagctctagctgcaaatttcctatattctcccagtgccacgggacggtgatgagaggtctcccactccatggggctctgcccacctctgctcacccactccacacctcccaccacacttttctagtgcttgaaggaagtgaagacagtagcctttaacatgttccattacagcaactgctttggtgtagtgacttacaaggaagcctgcaaaggaggcatttaagaactggttttataagttcatagaatagttaagaatctgaataattttcttattccttgtatttgtacttagatgtggctcccaagataaagtcacattgtctcctttattttcttgttctttttatgctaaaaaacatttagaatattttatcaacaaaacacacagacacaaacccctttccaattctctcaaccaaaacaaatatacaatcatgatagaaagttagtatgtgaaagtagaaggctacactcttaggtgatattaacatcactcctgaaactaattcttagtatttcagttttcccatgagggaaatgatatgctatattccataatttgcaagcttttaattttcacaaagcatcaagaaggcaggccataaataacccttcagcaaacatttatgaaccatttactcaggccaggcactgtgctgagtttgggaacagaaagataaatgaggcgcaaactttgtcattgaggaacccatgatatatctgggtctcatagatgcaaagcaataataacattaaaatctgtttactgcacaatcagaagtatgggcatatggtacgcagagaaaaaggactttagcaagtatgtgtatatatgctctgggagcctggggcctccagaaggaggtggcattaagctgagtttcactggataggttgggaggaagggcacacaggggatacatggcctgcaaagacacaacatagtcccacttttaagaagaaaaactgataactcacatttatttctcctacttaaaaaagtcatatggaaatcactaaagcaatataaaattaagaaaaatatcaatagcagctctaggaaacagaaaagggaacacccaacaaaggaaaaactaaagaacttttttgaacactataaagcatgtatgattggatcacacaaaaataatccatgcttagttagcatcaacacaacacagaggcagtaaccttatacgaaggcaccttacaaacccctaaaaacctgcaagccgtaagcagcaacctggctgtacaccacagccagggagaaatggggcagcagaaactgaggggccaccatggcaatgcctggagaacacggctcaccatgtaattgggagggtaggtgttgtgccacagatcgtttacagtggggtacaagggaggaccacagtgacagagagggaatgggaagaccagtcttgcaccacacctccaggtctactcctctgctagctacagctctgactggacacaggctgcctgtgaccccagccctaaccagtgcacgggctctaccaaaaagagtaaggaagaaggagaagatgggaagcaaaccaacacacttagggattctatcaaaaactccaatagagagtggctgtccacagtattccatccctgtgttgtctcagagagaacatcaacaacaacaaaatcaactccatccgcactaacatttccatgggtacctgcgttaggtttactagagatcctgcacttagggagataaacacatgaagcatttaatcttccaccactgcccccagctgcactgtcaaatactctttctcctaagaagaaccttcaaccacatgcaggcagatccaagacattcctggttactttctgacatcaccactctaatgcaagccagtcctatggctcagggcacgtggcttgggaagggccaggctctccactgactgggaagagaagctgaacctggttctgggaacacctccctctttctggtcctgcttaactgcctgaggttacatttccttctttttggtgatctctacttctttgtttaacaatgcccagctgggtcgctaggtggcaaatagacacatgctaactcaagcatgctttgctgaagttggatctgcaaaagcctgggggtggaggggaaggctataccactgcacagttccctgagggagggagaaacatggctttgggatagcctcttcttttcttttctttctttccttcttttcttcttctccttcttccttctccttctccttcctcctccttcctccttcctcttcttcctccttcctcttccttcctccttcctctttctcattcttctataactatggtaccaagggacagcctcttctcacacactccctgcccccaacaactgcttcaagcacagccaacaacaccacagcttacagtgtccagctgctggggtttcctcactgggagtgcatcttctgggtagtgtacctttttaagagacagggggtggctattccactgctgtcctttctctctgccctgccatttctcttcccattctcttcttccctgctttagtagactacctctattagaactaagctcatgtaacagtgatagaaaagctagagaagtttaaataagatgaaggtttatttctctttcacttacataagtctgctggtagacaggaagggctagcgtagtatcctaacaattactagggacgttatttttttctatatatttctccactctctgcatcatatggcttccaactcttggtacaaaatggttggcagaattcctgccatcacatgcaccttcccatcaagaggattatttcccttctactttatggattcttctaggaagctgcacacatcatttctacctaaaagtgatttcttagaagggggtcacatgaccacacctaggtataaggggagctaaaaaatgtagttcttcatgtctgaggacatgtactcagacaaaaattgagaattccactactcagaagagaaaaacagaaattgacagacaaccaacagtgttttccatactacctaaacagatttccaactaaggagtaagaccctagtctttttttttgtttttaaagcaccatcgaattttccaagtaagtcttctgatgcccacctcacttagcttggtgagaggagggaacggccatggtatttcctagtgggctgatgattctcagccccctccttctactcaatgtgctctgacagccaggcagaggaagggatggggtaaagagggaaggtgctggcagatagcaaagttggttctgataactgcttcttaagacctgaggaaggaataggtctcagttattgatggttttcttgagaaagtgaagactggctgggcacggtggctcatgcctgtaatcacagcactttgggaggccaaggtgggcaaatcacgaggtcaggagacggaaaccatcctggccaacatggtgaaacaccatctctactaaaaatacaaaaattagccaggcgtggtggcacacgcctgtagtcccagctactcaggaggctgaggcaggagatttgtttgaacctgggaggcggaggctgtagtgagctgagatcgcgccactgcactccagcctgggagacagagtgagactctgtctcaaaaaaaaaaaaaaaaaaaagatgtgaggacttcacatcacatctctaagacctctgctttggacagaaatcatcagtgtgcagaaaactcctcctcaacccctgtggtggcttcctaaagggatcatgattcttgtctgttcccaggaaatacacctggaagggaaggccaacttttggcctgtggaccctagtgaggttcatctccactggccaatttggtgagcagagacccctgggagacagcaaacagagacttccacaagtgcatcgaggggcacctgccaactacccacattgatcagtttatacctctctataaaaacaagcaggctatgaagggtcaatgaacactggaagaagaccaaaaatgggataggagccaagctgagtaggcaggggaaacggcctttcctctgtatcttctgggaaatgcaaagatactgcctctcagaggcagtacaagaagcctatgaagaaggaagagcaaatgagtaccaagaaagagctccaggaaatgaaaaaccagttacttagggaagctactcactggagaccttaggcaaacaaataaacatcggggaagatcaaatcttgatttagaaaatgatctgaaagtgaccttccagaatgtaaaggaaaaataatgaaagaacaaatgagaaacataaatgtcatatccaggagttatcatagctgtgaaaacaattgaatgaaagagaaagaatcatcaacctaacgaaaaacttccaagaggataaacagcccatgaaataccagataagaatattgacagatcatctacgcacaaactcctggtagagtttctaaataaaataataaaaagaaagtcactatgagctccctagtaagaaataaggaaaggaaggaaaaggagggaagaaaagaagaggaagaaagggacagggaaggcaattctaaatgctaaaaagtatagagcaataattacacaaatctgaggaaaaggattataaccccagaatggaaacaaaatattaacagtcagcccttcgtatccataggttcagcagctgcagattcaatcaaccacaattcaaaatattcagaaaaaaattttaataacatacaagaataaaaagtattactttttaaaactacagtgtaccaattatttacatagcatttataatgtattaggtattataagttatctaagacgatttgaaaaatacagcaggatgtatatatgctgtttgcaaatatcacatcattttacataagcaacttgggcatccatggattttggtatccaagaaggctcctggaagcaatcccccatggatgccaagggacagctgtattaagcataaaaataaaggaaaactgttttttttaaaacaaaaagactcagaaattatacaaccaatgcaagatattacttgggaaatacttcagccaaaaaagtacaaatagataagacatgcaacaagcaataagtaataaagataataattctaattatcccaaaccattttaaataatgcagataataggccaggtgcggtggctcacgcctgtaatcccagcactttgggaggccaaggcggccatatcatgaggtcaggaaatcgagaccagcctggccaacatggtgaaaccccgtctctactaaaaatacaaaaattagcagggcgtggtggtgcatgcctgtaattccagctacttgggaggctgaggcaggagaatcgcttgaaccagggagttggaggctgcagtgagccgagactgcaccactgtactacagcctggtgacagagcgagactctgtctcaaaaaaaaaaaaaaaaaaaactgcagataatgaattaactgcaattgttcagaaagatattaaaagatgtaaaaacaagctgatctagtatttaaaatataagttatttctacaaaacctagaatttcaggtagaagatggcagactagcttaaaagtttgcacaagatttcctttgatccttggcaaggatacagtggcatgaagattttgctacagtcttggaatttacaagttcaaatattctaatgaggaacaaccaacaaaatatagttggactcaactggaggtagaatatagttttaaaaaaattagatccattagagacatcagaaacataaaaaaaaataaaatgagaacataaattttaaaaacaaacaaaaatgaatgacaggaattaggacaagggtaatatgctgtgaaagataaggaaatctcctctcccaattttgctagatgatattactcccctttcttaaaaacatagttaacactgacattcttatctgttgccatagttcacacagctgtttggtcttacttttcaaaaataccagttttattgagacataacgatatatataatatatatattatatacatattatatattattatatataatatataatatgtatattatatatatattatatatatattttatatatatatattatatatatatattttttatatatatatatatctatatctttttttttttttttttgagatggagtctcattctgtcgcccaggctggagtgcagtggcatgatctcagctcactgcaagctccacttcccaggttcacgccattctcctgcctcagcctccccaagtagctgggactacaggcgcccgccaccatgcccggctaattttttgtatttttggtagagatggggtttcaccgtgttagccaggatggtctccatctcctgaccttgtgatccacccgccttggcctcccaaaatgctgggattacaggcgtgagccaccactcccggacagtatttactatattaactggtttctacaactatcaccatagtccatttcagagcattttaatcattccaaaagaaactatgtattcattagcagtcacctccccaacccctgtcccttcaaccctccccaatccctaaaacccactcaactattttatgtctctattacctattttggacatttcatgtaaatgtggtcttttgtaagctacctctttcgattagcataatatttttaaggttcatctatattggagcatgtatcactactttattaccttaaaaagaaactgtcaatctcacttgtgtatgaagtctctttttttgttttagtggttctttgagagacagggtctcgctcttttgctcaggttgaagtgcagtggcacaatcatagcttactgcagcctggaactcatgggctcaagtggttctcccaccttagcctcccaagtaactggaactataggcatacaccaccatgcccagccttcattcctttctaagaaatactattcctttgtatacccaatgtataatacatttgtttatccattaaccagccgatggacattcggattgtttctatattttagctgctatgagtagcactgctataaacattcttgtttaagtttttgtgtggacctatgctttcatttctcttgggtagagtagaattgctagatcatcaagtggtagttctacggttaacaatgtgaagaactacagactgtttgcagaagtggctacactaatttacattttcatcagtagtgtacgagatttccaattctctaatttcttcaccaacacctgttatgatctgacttttgattccactcatcataatagatatggactggtatttcattatggttttgatttgcatttccctaatgactaatgatgtcaagcatcttttcacatgcttattggtcatttgtaaatcttttttggagaaatgtttactcagttcctttgcccactttttaattgggttgtctttttattactgagttgtaagagtttttagatattctaaatctctatcccttatcagatacatgatttgcaaatagtttctctcattctgtgggttgccattctctttcttcatggtatcttttgaaacacaaaggtttctaatttttttcttttaagagttttatgcttttagctcttacattaggtttttgaaactgatgcactgattttaaaaaccatatgaaatagcaaaggatccagaataaccagaaaaagaacaaagttggaggactcacacttcctaaattccaaacttataatacaagcaacagtaataaagaaagtgctgtactggcataagaatagatgcacaaatcaatggactagaaacatgagtccagaaaaaaacccatgtgtctaggatcgactgatttcgacaagagttgctaggaccattcagtgggaaagagtagtcttttcaacaaatggtgcacggacaactggagagctacatgtaaaagaatgaagtttgcccttacttcatagcatatataaaacttaactcaaatggatctaagacctaaatgtagcagtctcagttttatatttaaatacattcactatttgccaccaattccttttactgtggctttactattccaattttattttgcttcatcaatttgctggctgaattatactctcagatggtttccaagtagaagtgcataggtgctgaataatcacaattgtttaatattcgtttttaaaagtttgttttaaaatggtcttgaagggaaaattggatttatataaagttctggaatcacatttcctttgttccaccatcttctaagaccaagaacttattcattcatttattcatttaacaaacattgttgcgtgcctaccgcatgtcagacggtagtggcgaaagacagtgtctctgccctcagggctcctttatcctattggaaggaaataatcaacaaaagttatgtatcaggtggtggcaaacactacagagataaggcaggatgaatgagggatatagttagagactgaattataaatgtaaacatactgtcaaaaaatgtgtcaacttctgtttttcataatcctttcttacctttactgttgaggatcttttaggaactaatgtcaaatattaatctaatgaaaaggaattaatctgaagttgaggagttctttcaatgtcactatttattccttaaactgaaaatatgcttctatgaaatcctaccctgtgctaatttcaagaacttaaatattgaagaaggttctaggccatacagctccatttcataataatttcaaaccacatcagagataagcatgatagacttctgagctgaaaatccatgcatgagacaactttttaaagacactgtaacagaaatcacaaatactacccctagaaataaattcaacatctactgttaaatctctagtaccttcaaagtgttacacctgtaaaaaatcccatacttaatagagtattcttatcttcacaaattagatgtactttaaaatcatgccagaaatatctaccactcttacatgggtgtggaaaagttcttgtggacaggttattttgaaaatttgagcttttataaaccttttttccaactaccaaaagtcagaaaaaaaaatacatttaacatgaagaatccctgtttgaacatatagaacactggctaccacaagatcatcttctataatagagtacctgataataaagtatatgttacctaagctaacatacttgtaaaagagtgtcagagtgaaaatcagattccatatatggaataatttactccttagtcataattaatctagatacagagaaaaccttgacgacaatgttgctaatggatgataacgagcaggaggatgatgataccatatatttatgtggcatcagaatcccactgaggttgggaatgttaccttattaatattctttgtatctctttgaggtaaggagagaccacgtatttcaattttgcaaattaggaaaccataagtaaaataatttacttaaaattccaacaaatcaaagcactgccaagcgaaatgactagtgtaaacaatctgcccattaaaccataaatttagcaagcacttgtcatttatatcccacccactccccaaaagaatctgtgacaaaaattaaagcagaaatgtccaagtggcagcaccagcatcaaattccaaagggattacctagagtaagacttgctacgactgaagagctgcacaggacctaccaatttccttaatcataaagtatttgccttacaatctcaaagcagttaaattggagtacaaaacagttaaatttggagtagcaaattcttgtgttttgaaacaacttgctgtgcaataaggaaggataaaatcgtctcagaaataaactgacacctttcaaaggtcaaggaaacaactgccctgagctagggtcagggccattaagttactactgcaccaaactcctgtttattatgtcccttttccaatgctgtctttgcccaagacagctattttgcactaaatttctggtaaagatccaatgtaggtaattacattctggcattagacatctaccacacattaaattaagattgatatcatgttcacatagcatcctgaactatatgccacagagttaaactcttccatggctatgattcagcttgtgacaaggctcttcttctctttgaaatatacaaaatagtcagagatcaatgaaataagtcatctggacatatatctctacatttaaaattatttattcaagcttttagagtatgttcattgccaaatggctctagggcaagcccttccattagactgacaatttgaaagtacttattggtcatacaacgcctacagcctaaaaggagtgatacagatttaaagcagcatagtctttaaaggactttttctggatatagtgctttgtggagatcatgacctatggaggccatcaagacgccgctatttattatccctcaccatgaaatagctacctattactattaatatttcaaaacaactcaaaatttgagagtaaaatgtagccattttttgaattttacaactcagtaatttactatgatattaactaattttaaaaacattaaaggtatttctcctcttaagtccttccagatgataccagatattataccagggaagtctgacagctcatagttgcttaacacaggggagcttgatacaaagacacatcccctgggcttggctcaatattcttactgacagaagccttctgaactatcactgaacttagcgggtgataccacaacttgagacttctggaaacaggaaagaaatcctgaacacttcatccaatgacatttcccaaaattgtgtgaggagacagcagaagtgatcaaaataaggattgtgggatacaggagcaaggagtacaaagacagaccctaattttaagaaagctttcagtgggtttctgatgtttggatttaataatgctcgttagaaaattatttgagcgaatgtttgacattagcggctgaaatctataaaatacagcaactggaattaaactaataaaatcttacacagtatcaatccacagatttaataaccagataagggtgatttgcaatgagtatatagacagtttataggtaagtcagagcttctcaagtacttaagaagtacttaagggtgcttataaacaaagtcctgttgtaagtagttcaaacattcttgctaaaatcttgtttgcactattagtttgcttagtggaacttttttcagagactgttactgtgagttttaataaggcttgtgtctggaatagctcaagtccttactcaatggggcctggattaataacgttttaaattacctcaaaatacaaggcctcgtgcaatatgttaagtatcactaggattcagggaattcaactgtatggtccaagctagaggtaagaaaatcctagtcgaagccagtgcataatggccatttacccctcaggaaacaattgccgctttatgatttcaactctttcaggggaaagcagagacaaatttatgtgtcttggaatggacagagcctggagttgcatcctaaatcaactggcattttgacatgtaaaatctactttaacagttttcgtttctgctggctcattttccatcagaaatcttggtacagcagaaaaaagtctagaccccatagtctgtcactcgactcactctatcaggaccaatatcttaccttcttgatcttccattaatccagtacaacctacccatttgtcttctccacttctacacccagtgtgttcgacctcaaagagaaaaccacagaggtctgccaactggcacacacctcagatatccaacttccagactcagctagaccctccagaccacctgggacaggtgacaacatttgactcaaggaggctgtgccatgcttcttgaaatatgttcccttcccttggtctttatatatcaccacctcctaattctcctgctacttttctaatcactcctaaccaggctcttttcactcgacacccttgacacttggtgttcccaatgtctgtctctgtcccctacagaactcattttgtcagactgatttcctcacagtcacctaccattttatacactaatgacctccaaatcctcatttctaattcaatcaccttctgagttccagacaagcatgtccagcttcctccacctgaatgccctcacctccattcactcagtggcaccaacagaaacataaaaattggccaggcacggtggttcacgcctgcaatcacagcactttaggaggccgaggtgggaggatcacttgaccccaggagtttgagactggcctgggaaacacagggagaatttgactctgcaaacaattaaaaaaaaaaaaatagccaagagtagtggcccatgtctgtagtcccagcaactcaggaggctgaggtgggaagatcgcttgagcctaggatattgacgttgcagtgagctatgatcatgccactgcacctctgcctgaaccacacagcaagatcctgtctccagaaaaggaaaaagaaagataagacaagtatagacatcatcaaatccactggtttctggcatgaaggaaaaagcgctgggttctaaatctctgctcataattactatgcatttcttaacaactgccacaaaatacaatttttactaatttctaggaaaacctacaaattaatattttatatactatgtgtattgttttatgtttctatattagctgaaaacacacttttcaacatcattttcctgtgtctccctctcaataatttctaccaccttttccattctgtaaccaaaaagctagcaaggcatttagctttcccctaaataaattaatcacacaaaattacttcacaacattctgacctttaaattaatttatatgaatacaaaatatacgaagttttgcaaacacagtgttcaaagcaactgggagaattatttgcaggacacacggcaaataatttgccctcaaatgcagatgtgttttgagcaatacgcttagtaaatgcttatgcagaagaaaaatgcccatctgtcatataatttcttttcttataactttccctaggaatagagaaaaagtgacaaaagattaaagaaagtttcatatacagtactcttataaacacaatagaagataacaaattactctagaaaacacagttttgaacagattttgatgaggtggaataattgtacaaagatctcatccttaggtagcttcaaggcataaaatacagaaaagtacctcagattctgtcaggcatgcaattatcccatgaaaccacaactttaggagctgtgtgtgtgtgtgcatctgtgtaacacaaagtgtgttactgaatgaactaacaggaccaatgcaagtaataccattacagcacaccataagcattcccctaattaaaacatgccattctttcacaattctaagcgtgtacacttccggtaaaacatgccactctttcacaattctaagcatgtacacttctggtaaaacatgccactctttcacaattctaagcgtctacacttccagagaacattatctgtccaggcttttataacgaaaaattctgtaagaaatttagcctttaattagttttctcttgttactttcagttttttcttttttcttttttttttagtttatttaattttatttctttccaacttttattttacgttcaggggatacatgtgcaaccttccagttcttctacattcaagaatattacatagcttgacactgtttcctcactatgttctcaaatttacttggttttctcataaaagagcctgatgttttaatttcctggcttccaaagcttaagggcttttgcactgttgaaaacaatcttatagttcttcaaaactgaatggctgatattataaagtggtatatttcaggggaaaaatgttcaaataatagaaggattctcagcacagcagttgagtcagcagtgctaaagggtatattcttttttcttgagtatttggttccacaagttttttcagggtcaactgtaaactaaatatcaaaacttaagtgcttatcaccatgtattacaaagaaaatatactatgacctcatgttactattttgtgtaatttcagaacattttaaaatttatcttttctactccatttatttccaaaatacttctaaaattgcaatttatagtctatttacattcaaaatactttagaaataaaatataagtaggttaaaaatcatatctttctcatcatttgattaagagtatccatattagttcttcccaagacagcaacattttcttagcactaaatttcagtaggaaagcatttttaacatcgttttaaatgtaaaatttcttgttaggattgtttcttttatttattcttgatgaaaaacaaaatatatggctttgatttatacatatttaaaccaatacttgtcacacttacatatgatgcgtttttcttcactgactgtggagttaatatgttatggctgttatggcatacatgtcaggactggctgatctagtggatggactcagcagtgtgtcccttggctgcctctttcataactactcagctcttctacccctgagctgagcagctgacagttcactatcaagcttgttgatgactgatagaaatgctgatactctatattgctgggcaaaaagagaagcattcttgtagataacagacaattaaggagcttagcttgcatgtacctaaaccatatcaataggccaagactgtagaaaatgactcatttagaaaaatattttatatcttaaatgaatctcagagattaactagtgcttcatacttgtcctgtgagtcctgctggaagttcctttgctcccaaggtggtgtagacatgtgctccacagcactgatcttagtttgttacatgccctagcaggtacgtaacatacctcattttttggttttgtgtttaagtttcagctttctctcttacttactttgccaattactctatgaaaagcaagttgctagattggtaactgagtttataaaaataaaaacaggaagcaagatgttaagtgctgttattactgtcagtattttatattcagcatttcatttaatctttgtaacaatccaatgagctaggtatttttattctaatttaaaggagaaaagtggctaggtttgtatttagtgccacttcttgactgaccagtcacatttgggaacacattttaggctctttgttcccaaactaaactcaagatacgaacattcacacatcctgatgcctctacattctgtatttcctgattgacatttggttaaaccatgaagaagtagtgaccaaccaactctcaacagtgaaacaggctccatttaggtgactttttatacagatagcttcccaaatcccatactacatctatgatatcagacacttgaggaatgggaattcagaacgttatctttaggtacatggccagattcaggaaccaatggtttagtaaactacacctcagagatcttaggtcctgtaattgctgtcaaaagcagactagaatccaagattcccagctgggaacttttcacaatgccacaaagatatgctttttaaaaggcaggagggtctctttcacaaatatgttagatctgagcacagaaaaccattcaatccttggttcgtttaaagcagcacagataagtctaagcaaggaataaatcaagcagcaaagatttaatgtgaacccaaaacatcaggaacaaaggagatgaaaactggtaaagatactaaaaaatggaaagggaaaatgattattattacagaatgtgataaaagctgccaatgtcaatgacaaataggatcttcatctctatcagcagaattctacaaagtatcaaaaaacacgttactgtactctccaaaacagattgcttatatttattttgaacatagcctcaatgaccagttggaaaaagtggtctaacatgctattgaaatacaagaaaaatacttgaagatataatggctgaaaactgtcataaattgataaagactgtaatccttctgatccaagaaacccaacgaaccctgagcaggataaacacaagaaaaacacacagcacatcaggctgggcacggtggctcacacctgtaatcccagcactttgggaggccgaggtgggtggatcacaacatcaggagttcaaggccagcctggccaacatggtgaaaccccgtctccactaaaaatacaaaaattagccaggtgtggtggtggtcacctgtagtcccagctactcgggaggatgaggcaagagaatcgcttgaacccgagaggcagaggttgcagggagccgagatcgtgccattgcactccagcctgggtgacatagcaagactccatctcaaaaaaaaaaaaaagaaagaaagaaaaaaaaaaacacatagcacatcaaaatcaaattaccctaagctagtgatatagcaaaaatgttgcaaacagagtgaaaaagacccatagagaaatgaacacaaggatgatgagattacttgtcaaaatgttaaacagaatctaatctaaaaagagttttaaagtgctaaaagtcactagcattctatatctatgaaaataacactcaataaggtaaaatgaagatgttggctgacacaaacaagagctgaaaaaattcactgagagcaaacagaaactacatgaaatgtaaatcagactaaacaaaaactataccaaataaaaacttccatctatgtaaagaaatgaagaacatcagaagtgataaagatgtgggtaaataagccttttattcatttaaaaattgttttaaaaattgtttaaagtcaaaataataaaaatatattgcagggttaaaaacatggggaaataaaatctatgaaaacaatagaacaaagaccaaatgaggaaatggaagtatattattgtcaacctcttacattatatgggaagtgatataatactgtctacaaatagagagagataagatacaggtgcttattacaaaatctagagaaattattttttaaaaaatcaaacaggtataaacaaataagataaagatttaaaagaatgctttaaaaataccaaattcaacccaaataaggcaagaaaagacgggggaaaggatccaagaacaaatgtgacaaataaaaaccaaaacattaaaagggcttaactcagcaaaggacatgaacagatatttttcaaaagaagacatacaaatggccaaaaagcataagaaaaaatgatcacaacatctctaatcagggaaatgcaaattaaaaccacaatgaagtatcatcttacaacagtccaaatgactattactaaaaagtctaaaaatagaagatgttggtgaggatgcaaagagaaggaaacacatacgctgttggtgggaatgtaaattaatacaacttatatgaaaaacagtatagagatttctcaaagaactgaaaatagaactatcattcgatctagcaatcccactacttggtatctatccagaggaaaagaaacaattatataaaaaagatacctccaattatatgtttatcacggaactattcacaatagtaaagatgtggaaacaacatacatgtccatcattggaagactggattaaaaatgtggcatatataccatggaatactactcagtcataaaaaagaacaaaatcagggccgggtacggtgactcatgcctgtaatcccaacactttgaaaggctgaggtggaaggatttgcctgaggcaaggagttcgtgaccatcctgggcaacataatgacactcagtctctagaaaaaaattaaaaattaaaaattagctaagcgtggtcgcgcattacctatagtcctggctacgtgggaggctgagatgggaaaacccctgagcctagaacttgaggctgcaatcagctatgattatgccattgcattcttgtctacagcaagactctgtcttcaaaaataaaaagtaaaataaaacaagaacaaaatcatgtcttttctagcaatgtgtatgaaacaagaggccattatcttaagtgaaatagctcagaaacagaaagtcaaatactgtatatcctcacttataaatgggagttaaataatgtgtacacatggacatagagagtggaataaaagatatcacagacttggaagggcaggaggggggtgagggatgagaaattacgtggtgggtataatgtactctatttgggtgatgattacactaaaaacccagatttcgccaccacacaatatatccacggatccaaaccgcactcacaccccctaaatttatagaaatacaaatgaaataaaattaaaagactgtaatctaattagatgaataattacattaagtgaaatggtctgaatattctaattaatagagattttcacactagataaaattgttgtaagactcaataatatgttttttatgtgaaatataagtatgaagacagattggttaaaaggacggacagttttatcatgcaaacactaatgaaaagaaagctgggtggtttcagctacaaaatataaagaaattgggtttaccactagtcctcacaacaagaaaaatgctgaggaaatggaaaaccgatgacttttcttaggtccatgtgagaatttaggtcacagggcaaacaaccacattaaaattattcttttttattttttttctggagagacaggtgaatatagagaatggcggttgagattggcttatctgaaggagaaaccgccaggaaaatcaaaatggtaacttcagtgaattcctgcagaatgaatatgcactagcttgggagttaaaaaaagtcccaggagccccaacttagaggagtccccacacttttaagaattttaccttcaagagctccaagacagtctttacggtgaacatcagagaaaaccccctcctgttgcagtaacagttttgaaatacaccaagggtgttctggtctccctaacaaaaacttgccttctcagggaaaatgcttcgacaaagtcttctctgacctaggggaaaagcagacactcaactctggccgcatctatctgtcctgtctcctttgaaagagaaagaaaaaaaactgctaagaaacaattctggccacaggccagaaattcagcctcattttaaaaataggaccttaccaacattcatcaacagggcttccatatagtaagagtggattacaactgagagagcagtaagccacagactctatttaggaaatagttctcaaggtatcctagacaagagagtgaagaaacaacatcacaagtcaactatggaaaactaaaacctgtggcacttacagctatagcaaatactaaacaaaacccagctcattgtcagattaacataaaacctcacactaaaagcttactatctcagttcctattacttgacaagtcaagtccagctttcaacaaaaaaaatgacaaggtcatgacaaaagaaaaacaagaaaaagcaccatctaaaaaaacaaagtgagcattagaaacagattcacatataacagatttttaaattatcagatagggaagttaaaataattatgattaatattttaggaaacttaatggaaaaagtagacaacatacaagaagatatgcgtaatgcaagaaaagaggtgggaaaaagaaccaaaagaaaatgatagaaatgaaaacactgacagaaatgagttcccctggcatgaccacagaaaaagtcagtgagcttgaagatatatcaatagatgcatcgcaaactacaatgcagagaaaagagaataaaagaaatgaaacaatgtccaagaactgtgataccattacaaaaggtgtaaccaacatgtaatgagaatgccagaaaaagagcaaagaaaggaagaaatggctgagaatttcccaaatctagcaacaaataacaaatcaaaagtcaaggaagctcagagaacaccagagaggataaaaaccatatatatatatatatatatatatatatatatatgcatatcataactgcaaaaaaccaaagagaaagagagtattttgaaagaagcttgtcaaaaaacaagcaagccaaaagacaactgtatgaaatatttaaaagtattaaaagaaaaacacccaacaaactaaaattttatatacaacaaaattatcccccccccccaaaaaaataaaaataaaaactttctaaggcaaataaaactgagggaatgtattgccaggagacctgcctggcaagaaatgctgaaagaaattcttcagcgagaaggaaaattatataggtcaaaaactcaggaaacaaaaacaacaaccataaaaaaaaagaaagaaacaagggtaaaatgaaatcgtttttattcttaactgatttaatatataactgttcaaagtgataacagaaacgaaacaacatatgggtgattatagtatatggataagtgaaaagaaggacagcaatgttataagaggtggaagggagatgttcaaaatactctgttataaagtacatgaactatctgttaagcagcataccgttatttaaaagtgaatttaaattagctactaatgtatatcccaaactttagggcaaccactgaaaattttttccaataagttttttggttaagacaggagaaaaaatagaatataaaatgtttaatgaaaatcagagaaggcaagaatagagaggaagatgaagaataaaatataactgcaaaaaatagaaaactgatgcaaatatcacagatattaattctaccatatcaataattatttgcaatgtaaatagtctaaatatactaattagaaaacaaagagtgacacagtggataaaaaataagacctgactatatgttgtctataagaaactcacttttaagtataaagtcacaggtagatcaaaagtaaagggatggataagtgtatatcatgccaacactaatcaaaagaaagttataataggtatattaatctcagagagaacaaagaaaattatcaggaataaggaagacattatgtaatgataaaggggtcatttctccaagaaaacataataatccttaagaagtaagcaccctacaaaagaacaacaaaattcatcagacatgactaataatgcaaggggaaataaagccattattagagatggagactatacacctccctctatcagtaattcacagatccaactggcagaaaatcagcaaggacatagctgaagtgaaaaacgccatcaatctgctaaaaagacttaattgatatttactgattacttcagagtacacattctcttcactgtcacataaaacatttactaagatagaccatggatgggaccataaaacacacagtaacaaaattcaaaaaacagaaattaaactgtgcccccagatcacaacaaaattaaatttagaaaatacttggagattaaatagcatactttcaaataaaaaatagatcagagaagtatcaagataaatgtttaaatatttttaactaataaaagtaaaactacaatttatcaaaatgtgtggggtgcaggaaaagcagtgcttagaggaaaatgtatagtattgaatgcaacattaggaaagaggaaagttctcaaatcaataatcttaggaaactagagaaagaagggcaatataaacctaaagcaagccaaataaagaaaatagagcagtcccccttatctgtaaggtgtattttccaagatctccactggatgcctgaaactgcagacagtaccaaatccaactactatgaattggaacacacgtttgttcatgtcttctacccacaaatttaatgcctttccatcttaactggacatttatcatgcaatgtggcccaaattttgcagttcagcaaaactagcaaaacagcaaaactagcatgactttttctttcccattttaagaatagaagattcattcttagcaacctcagtttatggtttttttctttccttgttgggagatttcaccttaaaggaaggctagatgtagcagcacaggtctgtaatcccagcactttgggaggccgaggcaggcagattgcttgagcccaggaaatagagaccagcctaggcaacaaaaccctgtttctaaaaaaaaaaaaaataaattaaaaaaaaaaaaaacagaaaaattatctgggcatggtggcacacaactgtagtcccagctacttgggaggctgaggtggaaggactgcttgagcctgggaagttgaggctgcagtgagctgtgattgcgccactgcactctagcctaggcaacagagcaaggctcggtctcaaaaaaaaaaaaaagcagaaagcagacgatgaaaaaacagacaattgtccagaaaacaaacaaacaacagagaatcaaggagtacttccagaaataaaggggaagctatcgcaataaaaaagtggtcaattaataaagaaggcataaccatcctaaatgtacatggacccaataatagagctacaagatatatgactcaaaagctaccacaaccaaaaggagacagaatcaaattcagaactattattggatatttcaacagttttatcagtgattgctgaaactagagaacaggaaatcgagaaataacactatcaactaacttgaactaatggacgattaatgaacactatatctaagagcagatgattatatattctttccaaaatgctcatgtaataagactataaaatggaccaaaaccatgtttccacaaatttaaaaggatcgaaataacaaagaaaatactctcaacaacaatagaatcaaactataaatcaataaaaacgacttctagaaaatatgcaaatatttagaaagagcatatttctaaataacccatgggtcaaagaagtcacaagagaaattagaatatgtattttaattgattgaaaattaaaacatatcaaaaatcagtcagcaaaggcagtgctgggaggctaattatggttttaaacacttatagaaagagcagaaagatctaaaacacataatctaaatttcatcttgagaagctaaaaaaaaagacaaatcgatccccaagtaagcagaagaaaagaaataaacataaaagctgaaagtaatgaactggaaaggaaaaaacaacagagaaaaatcaatgaagccaaaggtaatttgctgaaaagatcaataaaatgaagaaatatttccaggtagcactgaaaggtggtgggggtggcgagggtggaggagaggagcgtggacacaagacacaaaattttcatgccaggaatgaaagacagcaaattatctgcagatcttacaaatattaaaaagaaatgccataaacaaccacagttgattctttttatttttttttttccccctgagacagagtctcactctgtttgccaggcaggagtgcagtggcgctatctccgctcactgcaacctccgcctcctgggttccagcaattctcctgcctcagcctcctgagtaactgggattacaggcgcgtgccactgcacccagctaatttttgtatttttagtagagacagggtttcaccatgttgtccaggctggtctcgtactccctacctcaggtgatctgcctgcttcagtctcccaaagtgctggaattacaggtgtgagctaccgtgtccagcccacaattgacccttttaacaacataggaattaggagtgccaacccccattgcagtcaaaaatccatttataaatttttactgccctgaaacttaattgctaactacttactgttgactgaagtcttaatcatggattaatatatatttcatatgttatatgtattatatactgcattcttaacaacaaagtaagccagagaaaagaaaatgttaagaaaattgtaaagaaggaaaaaacattacatttccaaaaaagtcaaatctaaaattaagccatattgtcaccaggtcaccattctaacactactgaagaaagctgcatacgctgcaggtatacttggtaaagaattaagcttatcttgttttttaaaaatagaaataatttttaaatttaaaatgttcaacttaattcaaaatattctgccatccatagtcttcctcaccctacttgtcatccacaaaaacctttacaatttttgtttcttcattgaaatcttcagctacagttctgtataacttttattttctcagagtattaatttgaaccttctctatctactggcaacaacctgacatataatctgccttaaactttaaggtctataatgattatagaatagaattacgctgatgctatgactcaaatcgtatctaaacatacatagcttcacttagtgaaacaataaggagttatgtcaagttctagacagtggttttgttgagatataattaacataccacgtaattcacccatataaagtgtacagttcaatggttttcagtaatacactgatggttgttgagcaaccatcaacatagtcaacttcagaacatttctaacactctcaaaagaaaccttacaccccttttagcagtcactggccatttgttcccaatccctcaaccctagacaaccactagtcagccttctatgcctatagatttatctattccaaactcttcatattaatggaatcataatacgtggtggtttttactaactggctttttcacttaccataatgttttcaaggttcatccaagttgtagcataagtacttcattgactttaagtggctgaaaatatttcattgtatagataaattacattccatttatccatcaataaatgaacatttgtgttgttttcatcttttggctattatgaataatgctgctgtgaacattcatgtacaggtttttctatgaatatgcattttaatttctttggggtatatatctagggatggaattgctggggtacatggtaacttgacatttaacctttcaaggaactgcccatctattttttaaagtggctacatcactttacattcacaccagcagtgtatgaaagttcccatttttccacaacctcatcaacgcttggtactgtcttttttattatagccaccccagtagatgtgaaatgtcacctcactgtggtcttgatttgcatttccctgatggttaataatgtttttatgtgcttattgaccactgagagtgtatagaaatacaaatgatttttatatattgatctagtatcctgaatctttgctgaattatcagctgaaataatttttagtggattccttaggatcatctatatacaatataagatgatgtcatctccaaatagaaatagtttaacttcttcctttccaatgtggatgtcttttgtttctttttcttgcctaactgctctagctccagcctccatgcaatgttgaatgaagcagagacagcccataatctcctcttgttactcatcttagagggcaagcatcctatctttcactattaagtatgatattacctgtgagttttttctagatcctctttttcaggttgcagaagttctccttttccttttttagtctcactctgttgcccaggctggagtgcaatggcatgatctcagctcacttccaggttcaagtgattctcctgcctcagcctccgaagtagttgggattacaggcacccaccatcatgcccggctaatttttgtatttttagtagagacggagtttcaccatgttggccaggctggtctcgaacccttgacctcaggtgatccacctgcctcggcctcccaaagtcctgagattacaggcatgagccacctcttcctgccagaagttcttttattcctagtttggtggctattatcatgaaagggtgttttattttttcaaatgtcaaatttttcagcatctactaagaccattatgtggtgtttgccctttgttctactgatatgctatattacagtagccaaattttgtatatgaaaccaaccttgcattcctgagataaatcccacttggtcatggtgtataatcctttttatatgttgcttgattcaatctgttaatattttgttttggatttttgcatctattcagaaaagatattagtatattgttttcttgtgatgtctttgactgcttcttgatatttgaaaccatatgtttaacctaaagtcttaaactgtcaaacatccagaaaactgctatgagccttaggagtttatatatgtatgactgatgctgcatatattcatatttgttccaagaaaataatattttaaggctagccttgagaacaataaaagtatgcataaaaattgaaattgtcaacattgaatatgtatgcctaaaggtcataacttaggcatatgttatgcctatataaataaataaaataaattaaataaattaaaaaataaaaacaatgtacatatcagttatgagagatcacatagagaatcctaaacagcaagatttagaaactaagattatataaaaagaatctgaaatgtcttaatattttattggttctactttagcagaggcagaatgcttccaacttctttaaaatttatttttatggaaacggagttttagtttacctttgtaaaagttgtaaaattactacagataatacattttgcatgctttaatacatcatgagaaaacactacaatgcatccagaggcatattttttttaaaaaatcaaaatcagagagccccttaatggcaaaaaaaaatgcttactgaaatagaaatccagtgggggaaattaatatttaatgtaagtgaagacagtgattctgttaatagtcaaaataaacactgaaagaggaaattaggcaaatttaggacaacagaattacctaaaaataatacagctactcataaggaagaatgttgcttaaaccatacatcattagatttattgtttctgcttaaacagcacatgcagggttactttaaaaactttaaaccccagcgctgcatatgtgcttatctactactatactggaaaaataaaacaaatgtgaaaggttttgtaacatcatcttcctctaaatttctgcagcagttctacccccagctgagatggtcttgagcttcctccttctcccagctgcttctcctgcatttggctttaatcaggtgcagagcaggaactccacatcctgttgccttactctgattaggaggagtcaaattctacaaattggcaggtttctgcctgtagtgattctatttgatgaatcatttgcttttaagtatttgaaaagggccattagtgaaggagcagcccagcttgttgctattttctggtctatttataaccagccattctaaggagccaaatgctgatcatctttatctactggaacctagaagttaggaatgaaacaaagaatggatagtcacctgattctgaaataaaaacagcagagatcaacagatgagacactagttgtagtggtctctagacccttaagatagtcgattaacagactaagagatctaggtgcctttttcctaataataaagagacataaagtgagtgtttaaaggcttagtccaaaaacttaagcattcaatcactagaaacaataaatgcataagtaaagatacaaggtggaaaaaaagccaaaaattaatataataagtaaaatatttgtggctctcttagtctccaggtcttgtgttaacctcagttcctaaaactctaatcccagttttgcaagtgggcagcatcttggacaggtaaaacatagcagttatatccactaacgacagcattccaagttcccgtccccacccaactgtggaaatgactctccaccacaccacacaccctgcactcctgggctccaatcgctctgtaaggcgatactaacaatgcatgcaccacccagctggtggggtggcaaggagccaggcttcctcagctggatagtcttgatttagaggttgtgaaatggcagtctcattaagacttggccactgtctctttctcaacatcattaaattgctaacacagcaggcccaacatcaaatggcctttgtgtaatcctaataagccaaaggatgagaaaagctggacttgaggatgagggaatgcttttcattgaagcctgagttttatagcctgacaggctgcctaagcctaacaaggcaacagggtatggaaagacgacacaggcaactcttataagctgtaccaaaagtagaagatgcaaaaccagaaggacagggaacagggtctaaaaaaaccaaagtggagcaaaatctaaagaaaatctcataggagggtaaagaaaaatttaaagcaaatatatcagccagggtaggaagggcaaaccttcaaggtactaattgtaaatgggtggatataggatccacacatagaagcagtagctcttaatccctaactggcataaaatccatgctctgaaagacaagtgacaattttgtggcacttttctggtattttttgcattcgtgagattcatgagattaagaggaccatagtgatgctacaaaatatttaaaataacacgaattcaatgatttttaaaattcaaattttaaaagaaaaggagtggaaaatatcagaaatgagatcacctgttcaatctgctcgcgataatgcacattatgaaataaaaagcaccaccacatttaacagtacaaaactgaacttagctgcacaagatttgttattatctatacccaaggttctagtgcacagaattttagactactaaaatctgtatttttgaatttcattctattgactgcatatttgatgaaacaggaaaagagcattcccaaaagagcagagattttactttatatgtaaaacacagttggaaatcagttaattagaaagcacctcagccaataatagtgaacatttagaacacagacagagaacttccaaaactccaataagccctctgtctgaggaataataaaaactgttcaggcatgtgtcttttaagaattgtgtgttaaatctaaatttatgtaattagagggtttttttaattacttataatttcctctctaatttatttcattaaatacacagatcctggaacttcttggcaaataatgtcagctaatactgacgtaggacctagaatctaggtaaatggtcatcaaactgtgtctccagagatgttctgggcatttttcaaatagctggcttgaatttcattttacactataggaaaactatattcaaattcacatgtaaatgacactgacttttaaaacactagtaattacctagatatgtactgtcaaattaaacttatttatagtttgacttcagaataaagcttcccctgccatctttacatatactcgaacctctttcattaatgatgatggccataagctacaaaaggacaggacttgtgtctcttcctcgtaacaactatgggttggataaactgttctgtgccacaattttcagaattcaaaacataagaaaacttgtttgaaacaggtgaaacctgaggagtcttggcacaagcaaaggtgagacccccttcaggggcccttctgcaggccaagtggacagcattccacggagggcagagatgtgacacacaggagcatgtgcacgccaagaactaaacacagaatacaaaagactctctaaaataactgtatttgaaatgttcaaagaggtacaagaaggaagtaaagccacaggcaagaaaaggtagatttgaagtaagcactaaactgatttttcatatatttagtaaaatggtcacaaaaattatccccaaatgggtaaggtgagtaggagacatcatgctctaaaagacagagatgagaacatcatccaaaatgctgcacaaaaaccaaaaagttaaaaatagatgaaagagaatcttaaagatatggaagagaggctgagatgctccaaaatgtgcctaataaaggttacataggaaagaaatagataatatgtgagtgaagcaaggagacatggttgagaattttcaataatcaaagaaaaccacaaattctcaggttaaaagacaagattaacccacatccagatatactgtaatacaactgagaaacacaatcagggagaattgcttttcactttctaataatcaaaaaaagaaaaaaaattgaggagaaaagaatcttgaaagagtaacaattacaccaatagcaaaaatagatagtaagagataataggatattttcatattgccaagagaaaattactgccagtttagaattttgtaactagccaaaatactattcaaaagtaaaagcaaaatagagatttttttcagacaagacagagagtttataactcacacgccttcacagaaactatcatcaaaggacagactttatcaagaaggaagatgaactcacaatgcagcagcaagatggcagaaataacagtgagtaaagaaactggtgaacatatggatacatctaaagaattaccagccttatttaaaaataacaaaaataacaatgattaattggaaagaaaggcaaacaagagagaatgaaattactggaaagcaataaatcgaaacatgggaagtagcagttcagggttaaagtgttctcagtaggcaatgggaactattaattagatttagacttcatcaagtatgcatgttaaagttaactataaaagcaaaaagaatacaaagagaaagtataaatttgtaaccaacagccatggaaaaggaaatgaagaaaattctatcagactagccaaaagcaagaaagaaaagagaagcaaagaaaaaggacaaaacataaattaacaagatagaactcatctttatatcaataacagcaataagtataagtgcattattacctataaaagggaaagacaactcctaagttaaaaaaaatacctaattatcactcaaatacactgaaagcaaaaaggacaattaattgaaaatattagtagaaaaagaaatctcaggcaactagtcacaaaaagaaagttgatttagcattaatcctttcttcttttaaattctaatactaataagaataaaaaagtataccatatactagtaaaagtatccaccaaaaggatatgataatcatacaacaaggagaaacagataaaactataatggcagtgagagattttgatactttgtaggaatattatagtcttcaatgcaatcatttaggaaaagatactaaaataaatgaacctaacattcaataaaagaaggaacagaagaaaacaactcaaagaaagaagacattaaagttgatttttatttttattttgtaaagacatcaaatttgtttccatttgtattcacatgttgttaatgccattaagatcttatatattattaaatatactggaataattcaaaaatcaaaactattagttctgtaaatctgatggtggggtgtgtgtgtgtgtgtgtgtgtgtgtgtgtgtgtgtgtgtgtgtgtgtgttttggtaaatatttattaagtgcctattaaatggtcaggataaaatgttcatgtcaagaaaataaatatttagaaccaatacacatgcacacacgcacacacatacatgcacagtggaagatttctttctccttgtaattgaaaaaaaaatcaaatcaagcattcacttaacattatacagctattattatccaagtaaattaaactaacatactgcatgagtaataaaaagaaagtatttcctaatacttgtaccttaacctttgggtctataaatgaatgaataaagatgtatataccatgtagccagctgctaagtcagtatgttctccagcaatctgaatacatgcttcaagctcaactcagtatgtacagaatacaaaatggaaacaaagagggcaagttctttcttaatcctaaaaaaccgacataggaaattgcctgaataatcagctctgtaaattagattattctaacagtcacatggcaaattatcatgtctgcctttctctaagatgttacatcttttttgttaaaaaaaagatttttaactgctacatggccacatagtccttagaacttttttacattaccaaataactttttaaattaattttaaggttccttagcacattgtactcaaatactcaagtttcactatatttttaatgtaagaggtttaactctaagaacaattactttagttcaacagatacccaccaaaaacggtgctcaaaaggcaaagggaggtcaaaggccaccacctggtcctaggccagagaccccctgggctttctggccatgtggctcgctctttatctcaaggtgtggaaagcctcccagcttctctcacttcaaactcaaaaagctccatctagtcttagttcccaagcacacaccttcactctccattcatgaggttccatttgttctgctttcccagtcctcacacaagtatcttcagaatgtgtcatggacttaatgacgtggaaaataaggataataataacaccaagtcatgcagaaagatctttgcaatttacacgagacataaagagaagggttaacgcacacatcgtttctcttagcatgatattcaaaaccaccagcagctgaatcgacatttttattttctacgtcactggccatagacagaaacttgttgtgaatctcagttttgtaatttgtacatgttatcagaaaaattgttttaattttagcatgaacatttcctaaagtgctcacagccactctcaaaacttcctgggaattcctcccagtgcctggtttggataatgctgatggatacagagcaaagtgaacttcatagaacccagtgtctgtggatgaggcagccagctgccagagcaatagagaagtgggatgtcagtgcatattaatcaagccgaaattatatactttgtaacttgactattacagcttcattagtttattgaatattgcccacatgaagacctttgtactaattctgagatgttaccaagaaataggaaatgaggtaaatacattttccaaggaacacagatcatataagaaataataatatcaaagaaaatataccaaaaaatcccccagaaattatggaatacattttagcatgtacataatcaaaagcataatggtaaactaagaacaggaaccagagaatatagtttgaaacaagatcattgtgtctaaatggctccatgaagaagaggaccctggctggtactctggaagttgtagcattctgatcttatgaagcgagggagaatgaagtccttggagaaaaacgtggaacaggtggacacagccagaggaaggagcgaacacattttgggcaaggacattctctgtgtgagactggctgcatgggcagaacaagtgaaggtaatgggagaaaaaaggcagccagatatagagagattcacaggtagaaagctctgcaacccagggcttaattaatattttcttttcctttgagtttagcatgctcagaaaggggctaaggtgattttattttaaagcagggaatttgaaagatttttatttgaatatataaaatatgcagagatggagggagaaattcttgcaagtccaggagaaaagtgttagggtttggaataggaagagaaatcatcaacataatgataagcatatttggcaggagtgagaaacaacagcagaacttactgctctatgaacatggcagctaaaggcaaggaagattcttccagaaacaaatgtaaggaaatagcagagtacaagacagttattagaaaacagggtaaatagcatgtaataatacagacacagcaagaagccataaatttacatttcataaagtttatgaaaagtttttattaaaaatatatttttaacggaaagtaaaaacttcacaaaatgatctgcaaaatttgaacatgtacagtagaagaaaatggaggttttgtcatattaatcaaattggctttctatcatgatacaatatataaactcattgccactgcagagtcctgttcttctacacttttggactcttaaaaaaattctagtgtctatagttctttgaacaaaggtttaaaaaaagcttcaaaactttaaagaaaaacagaactcttggcgaaagctactattaaagggcccgccttaaaaaaatctagcttgtaaaacaatatcttacatatttcaatgaattctgatttagatctccattttagcttctttgaacaaacatctttatgtgtaaaatgaatacttttgttcacacaaacagcgcctcattccatttagtttaattcataagactgcttagcatatgacattgatataaactcaccttataagattaaaagaagcacagacaagttcacttaagttaaatatgttttaagtttctctaagtgaagaaaagctaaacacatttttaaaccctaaatcatttagcttctgcaattatctcatctaccagaactctaaaatcaatttgactggactttcatttatgctttataataggaaaaaatgacacatttccaaatttaattaaccaaaacaaaaattcttaggacaccccatgtaattctgagtggactaaacaatacatcttcgtcgctcaggacaaaaggtcatttggaagggatgtacctttaagggtttacaaaggcttgatcttcagtcttgtaacgaaagaggaagcacatctcagcagaggaaggatgcccactttaaataaggaaatgggcttgcaggatgcacacatgctgctttctattaatgataagcacagtctacaaaaagagcctcagaatgctttaactttcatgtagaatacctgcagagaatgtctaacataaacaaaacgacaagtaatgtgtccactcaccgttttatgaaatgatttatgtgttcataatagaggctagtaaatactaacgactatattccagttaacagctgtaattactggtgtgatgattgtatgccaggatccatgccaataatgttttgggagcaaagcatactttaggggtttatgaggatgattatacaagatagatggctctgctgggtgattttttttctttctttcttttttttttaaccagagggaatgagatggcagaaattaagacctttaccataccttttttaaaaaatagataattatatatgtttaagaactggaaagcattttgttaaagtttaatctctttcaagacagaaagtaaatccaatcaaaatcccagcaaatattaatctaaatttaattgtggacatcaccttttggcttcttccatctctgcctgtgtctgtgtgtgtctgtctctcacacacatatatttacacacacaccctaaccagatattttgcaactacattaaaataaatcataacctttatttaattactcagcaggtgactgtccggtttgtcaacctgccctgtctctgactcccctcaaattccttctcaccacctatcagtaatccttggggcattctgctatttcttaacacctcaactaagagatattaaaagcagataaattatctacctggcaaaaatttactgcaaattgtccagggtattggtaatttcccagaattatgtctgcattgacaggacagttttgccaactgcacctgcagtccagcccaacctctcctcccagtataagtggcaaacttaaaaaggctggaaacactttgctcattttacaagacttgtgtcaggcatcacttctattatgaaataatcttgaattgtgttctggagggatctggggccaaccccatgctggatcacataagtcttactaagtgtatgcttggattccatgtgtcaccccaaaagaaaagcttatctttaacaaatttatttaaaattttgacatcaaaatattccaaagaaatattttgaagaaggtactttaatttaaatataaatttaaattttgtgtcattttgaattatatattggggtgtacaggagcagcatgtaatactatcttctgtgctgggggcctcctaaggattttactcggtcctagtcaaacctctacaataaaaacagatagcatgcattacatccaactcgtgaactgcctttctcccagtgatatgaagacagtccagagaagggggcaggttggaggaggagggaagcgggtgcccacacagagatcaacacacagcccatgtggttcccacagcatgctctgcacaaccagacagatccatcactgctggttactgtccatctcctccacaagagtctgtgggtttggtctttgcaagatcatttcgaaattaaaagtggacaaagataatatatgcccacatcttcttaaagtatgtgtgggggtggtgcatgggaacacctgtgtcaaatttgtgatgctggagagccaagaaaaagataagggaggcaaatctgaatctggtggttgtaaagcacctggaggaaattttgctgttctttctccagcatctgcgaatttgtaggacgaggttaagagggagcacacaacttccaatgttgtcccaacttctattttacatggaccttgctccctacataaaatgcatataaaaccctttcttatttaaatttcccaaggatttgcagcagtttgtacaacacatttggccacagtaagtctcagggctctaaatgacctctggggatgaatgacatgtgcacacagaagaatttataagactcactctataacagttcctttggaactattactttctgagggtgaaggtaacagattttttttaagtagtacagttgacaaactatgcattggctccaaacaaggccgtgtgcgctagataaacatagtaaaactgttataaagtggttcgctaaattgtagctatactgtagctcaaaatgtattgcttgggacatagtgatatatagcatatgtttcactaaaatgtgaaaaagcctagaacacaagtattatctttgtgactcaacaccaatacaataacaaggattttctccaattccttttataaacaaaataaattattactgtatcaactctctcacacgtaaagatgatcacattactctctacaccagggtcacaaattcaaatgcaagcatgtagtataaatacataaagcaggccaggtgcagctacggtaaactcaaacaatggttctcacactttaatgtgcatacagaaatcgccctgttaacacgcacatcctgatgcagtagttctggggtggagccatggattttgaatttcaaacaagctcctcagaaaagcaaagaactagagagctcttttccctttcagctgttttgcccaggctgaggcctccacacaggagtgccactgggcttggtgctggtgatttctcaaaagctggaaattcactcattcaatcagtttcccaacctcttctgtgttctaggtatcctagatactaaagatgtagcagtgaaccaaacaactacaaatggatgccctcacagagttacctggataacaggagaggagagacacccaacaagataaataagtaaaatgtatagaccagtgtaagtgcttagagaaaaaaaaaaaaatcaagttgaaaagggtgtgtgtgtcagggtggggatggggatacaatctgagatagggtgaccagagatggtctcactgaaaatgtgatatttgagtccctggaagaaagtgaagaagaaagctatgaggacatctggggaaagaaacagaagcaaaaacagaagtaaaaaacagaggtaggaaatctgggctcagggcattcctggtgtgtgaaactgaactgccccagaggccaggcagctgaggagcagagtgactgtgggcaagcctggcgggtaccttaaagcctaaatgtttcctgtactttcttctgatttctaaatgctaacaactaagttgtaactttagaaaatattttaggcccatggtcaccactttctggcctctatagttttaaaagtttgaaaatacaattaacattttagtgaaatgccttatgaaaacattagccatttttattactgcctaatttctcctaagtcttaaactatattaaaaatttataattgtataatcagaacttattattgaaaatgggcacacacaaagatccataaagaacaagtgtagaagttagaacctctcaatgaccaaagggtggaataaaatcccagcaaaagatagtatccagttgcccatcaacagttgctagttcatcatcgggaagacatatactgtgaactgtttttctggtgctggtgataggtttgaactggagacatacagctattcctcagtctctctgtaatcaatgtcaagcatttgaaaggaaagtagcccaggtcaaggatgccttaagagacaataaatcaaatttgtcttttatcttcttcttatggaatcctatacagctggaaatctcagggccaaatctgcaagccttctcaggaaatctacagaatttcatggatataatttgtatgtgtactaatctcatttttggtaccacaatattaaatttattttctcttggcatattgtatgtatttgcacaatccttaagtctccttaaatccctttcaaaatgagatctggaatccattcatttattaaatatttactgatgcctactacacaacaagtattgttttaggttcttgggtatatatcagaaaacaaaacaaagatgtcggcccttagaaagcttatgaaaatatagagagaggcataaaacaaaaaggtaatttgcttacaaggagtctgatttaaccagtaacctaactggtagcagtagtatctccattcatcattataaaactgctaattcacaggtagctaaaacgtcttccagaaagtcaccatataaaacagaggtagcatttggaatacaacctgtggtgatagatacaatacagttcctcttactgatttgccatgtaacttactaattcctctaaggagaggatgcaaagaaaacttctaacaccaatctggaacttctcaaatttcatttttaaaaattctaaattgaaagcataaaatgcaaataaacatgtaacatgtagttaaattatcttttcaaaggaaaaagtatgttaaatcatgcaaacagttgaatgaattatcatgaaggaaaatgaagtctttgcaattcaagtagtttccaatcccagattattttaaattgatacttccttcatttatagtttgagccaaaccatatgaccaatgaaataataattgcataatcactgaatcaataatgcaatgattcattaaccaatgcataataattgctgaaagacaccacaaacccaatcatgtggttaggagtaaagaaggcagcaagaagtttccaaagtatcatgttatactgctcttaaattaaaaagctagagcaatatttcccttaaacatctatcatattaattgattgggagggttctcaattatttttgaccaagggcctaaggaaatctttccagactttctgaaaaagttgtatactgaaactggtcaggcataggacaaatccttcactttatcactgaaccaaatagtcttctgtcttcttaaaccttttgtaagtaacttcctaaggaaaaaattaacaatgtttgatttataagaataaatttatttcttaaaagaatgctttcagaatataagaaggcttctggaaattagttacttaaggattaaactatcaggtgttcaccgccattgcttttattgccccttttgccctgtgatgagcttagatcctaacagtacagatgagtcgttcctaaactaagttgcacaaagaatcactggaggtactttctaaaatgcagattcttgggtttaacctccagagaacatgtttcagtagctctaagatggaggtgttgaaactgtacttttcacaattgccaaaatgtttctaatatggcctatttgtaaatattctggaatcagatccgaaggagactgtgtaccagtccggaggcatataaaagaacccatggggatactgaaaaaaatattaaaactttcatagtcattgttatgtcatccatttcaattttttagtcacatgatttctaacacacagaatatactggtacaggattaaaggtatttaatgataaatagatatatgtatatgcatatatgtgtgtgtatataagggacacgtacaaaaatattaaatatgtgcacttatcttctataacaggggtcagtaaacttctttagtttacggacagacagtaactattttaaactttccaggccacatatcatctctgttgtataatcatctttgctgtttttcttttacaaacatttaaaaatgtaacaactcctattaaaaaaagattacatactgtattattccatttacatgaaacgtctagaatgagcaaatctacagagacaaagtacatttgtggttgccaggggctggggcggtaggagagaaaaggaatgttggtgccaatgggtatgagctttctgttcggggtgatgacaatgctctaaaattcactgtgatgatagttacgcaactctaggaataaactaaaaactactgaatgttgtactttaaatagttgaatttatggtatgtggattttaatgtcaacaacgctgttattaaaaaacgtaacattcctttttacctctgggttgcaactggctcacaggccaacagtgatctagaacaacagttctcaaagtacggtctggaagtccagagagtgtccaagacacttctggggtgtctgcgaagccaaaactattatcaaaaaatacaaacacatcatttgccttttttgttcttatattctcacacgtatacagtgaagttgtccagagcttacctgatacgtattaaaacacaccaaatgcagaagcagataggagaagccagccaatccgtttctggcctggaaggtaggcatcattcccaaggtcaagcaaccacttttgagaccatgaggaagaaacccagcctgaggatggttggggggaaaaagaagaagctgccacccctgctagccctatggaactgctacaccatctctagtctaccttctctagccttcttaccacataagaaaaaatgatttaagctgttttcaggcctctaacttatagctgaataaaattcttcacacacacaacatcacattgctccacaattcataaacagaaccctccccctgaacactgtctcctctcagatggcctcaagccaggctacaccatgtggagggaaggcttcattatgaaaggtgttaatcattaacaaagatgtcaaattaactgttctcccctcatgtgccaagttttctctcctcggtatgttgaatgctgtgcctgacctgcctagatgcccttctctccatttcccagagctcaaagcttatccattcttcaaggccaacccaactcatgagtcagctcctcatgatatcaggatatgtcttccctgattttccaaggattcaccactatacatctcccacatcttgtgtctcaaatggcacttactttctatttggcatttgacctatttctctgtcttatcattcatttctgtatcccccatcatacataccaagagacttctctcctaaataaaagctcaaatttgtgtcaattatatcaatattattacctatggtcaagttatttaggaagcagaaaataacacagaacaacagagtaaaagagtaacttatttatttatatttatttatttatttattttttgagatggagtctcgctctgtcacccaggctggagtgcaatggtgcaatcttaattcactgcaacctctacctcccaagttcaagtgattctcccacctcagcctcctgagcagctaggattacaggtgtgcaccaccatgcccggctaatttttatatttttagtaaaaacggggtttcaccatgttggccaggctggtcttgaactactgacctcaagtgatccaaccaccttggcctcctaaagtgctgggattacaggtatgagccaccgcgcccagccaaaagagtactttaaaatcctctccacaagtaatctcatgtcgcagggcagcctggcctgggcgactgtctcagccgtcatttattgcacctctaagaattagatgacagtgttctcctttcacctaactttaatttaatgtaagaatttgtgtgcctaatgaaaatcaactcaaccctgaactcccttttcaagtcaatgaaggaaatcgggagacttaattaaatggtgaaataaagcccttttaaggaggatttatgacccttctgtgtaaagtatttaagataacaaggtgttgataaattaggtcttggctggataaagatctaaacacatcagtataacagattatgaagttgtctttcataaacgcagatctcgggaataaactgagttattgattcattaataggtttgctaactggaaaaaaaaaatcactgattttcagagccttactgcttgttggcacctagtaatcaatgcttcttcccaggaaggtctgtcccagggatcacttagtacatcaactgttctaggctttagcaatccatacaaggcatatagaaattcctggcgttacccattatcatacttgtgtgtcccaaataaatggggctccaggcaaaatgccaagacagtgttaaacagtaagaccatatatgctgattaatgataattctcttcctataaatgtcagaaagtaaatataggatatactgagaataagcagttatcctcacgaagcatattctatgggaaaagtaaaccataaacaagataaaacaagctgcacggaaagacttcagagcctatggcatgctgatatgtactgtgaaatctgcatggtaagcagtattctccaaattaacgtggcgtagctcaccttatgctatcctgaaccataaaacacactttcgtaagtaaggttttaaataagtgctcagtagatacatcctaatttctattcctgttgtacctggagttatcttttggaggcgaaaggtaatgaggtaggaacagcctgaacttgtgagataaaaggagggagcccttggtagcatcatgattataaatgacatttctctaataaaggtaactgcacttagggagctgaagaaatggttcagtcaggcaaactgtctgggtatcaacacttcatacacttggagctctcccgtgaactgacaatgccccttcaacttcaccctcaatgagaactgcttcttgtacaagtaaaagaaggtgggaaacagataaaaatcttagtggagagttacaaatggtccaaaaaggaggtaaactagattaagttctcacactgtagaatcagtcaaaaaactacacgacgttgttgtaaccagagcctccaaataaaccattcccactgaagtacgctggttcacactgcagttccctcactagtcagctgtgcatgggggtcctgctcattctggactcccaggacagagaagcagcatctgacacatgtccctcacaatgggggagggagtagcaggaaagaaaactctggtttggtaagtctgagttcaaacagacgagaagtacaatcctatcttgtgcccagaacaagaaaccaaacatcggtgatggcatcaatgtctacgtcatagttcacctcaaattatgtctttgggaggggaaaattctacaaattatgctgtaacataacaaagcgcctggatgctgtgaatagaaagaagtggttgcttgggatttggttctgctgctctctagtgtttacaaccgctcaagccgcactttccttagcactaaggtctcaaaggtgttggcaacctgcacatggtttctaaaggagcctgaaaggaagacataaagacaaggagcaaatgaagacaagagagcaggggaaagagaaaagcggtaaaaataaataaataaatagataaataagtactgtaagtagtactagtataatggttgtttccaaagataaacattttaactattccctgccacaatatctccagtttacctgccttggtacaccatacttttaaagttaaccttgaaccttgaaataaagagggttgggggggaggtggtggtgaaaaaactagctcaccaaagcgcccttataaattaaagcctgaagttgggctcggtcccttttcattgaagatcgcccccctttgccatccccacctcctgacacaaagctggttttgtcccagccttgcatcagctgcacagtacagggtgtacatgctgaaaagcagctgtttgctgacagactgcgaactgggacagctagctagagctaagtgaagtggttaacccacatcccttccccactgataaagtgctttgataagcaaactatactggtaaaagctggaaagactgccagaaaagccgcgctcaagaatgaatgcaggcttgttttgagggagcttatgctttcacactgtcgactttagccttcactcctggtccccacctccactgggcccgcacacttcagtgttccttcagctagcagcaagacccattctttgatatgtcaaatcaatatcctgctcatacagaaaaacaaatatatattttaaaacactgcaaaaaaaaacagctcttcatataacttttctcaaaagtattcttcccaattcagactcctatgagaagcaaagcattaattcctcccgaaatatgctccttggatcagtgactgctgagtaacataagcacataaattttttctccaacttttattaacaaaatgaaatttgaagttaaaaaacatgagggttatttggagtttcaactgctgtgcactctggacatatagttgctcattaatggcagaaggcaggggcaacgtgaaggcacactaaccttaactaatgtttttctttgggaatatgtccctcatttagatttgtggactggagtgcttgaattccgctaacatacagccatgtatcacataacagcggggatacattctgagaaatgtgtcactaggcaatttcatcgtgcaaacatcatggagtgaatttacataaacctggatggtacagcctactatacgcctaggctgtatggtagagcctattgctcctaggctcccaacctgtacagcaggctgctgtactgaatactgtaggcaactgtgacacaatggtaagtatgtgtgtttataaacacgaaaagtacagtaaaagtacagtacaagagatgaaaaatggtacatccgtataaggtacttcccatgaatggagcttgcaggactggaagttgctctgggtgagagtgagtgagtggtgagttgatgtgaaggcctaggacattaatccacactaatatggacttcatgaactttatggactaatatggactttatgagcactgtacacttaggctatattaaagtcacaaaaatataattaaccttagctcaccataaattttttactttataaactttttagtatttttaattttttgattcctttgtaatattacatagctgaaaatgtaaacacactatacagttaaacaaaaaatattttctttctttatatccttattctataaggttttttttctaatttttatgaactttttagattttttgttagaaatgaagacacgagcacacacattaccctaggcttacatagggtcaggaacatcaatatcactgtctgttacctccacgtcttctcctgctggaaggtcttcaggggcagtgatatgcaaggagctgtcgtctcctatgataacaccttcttctgaaatcccttttgaaagacccgcctaaagctgttttatagttaacttttaatataagcagaagcacagtctaaaataatgatgaaaaagtataataagcacataaactagtagtatagtcatttattatcaagtattatgtacagtacataactgtatgcgctagacttctataccactggcagtgcagtaggtttgtttacaccagcgtcacaaacacctgcgtaacatgttgtgctacaatattacaatggcaacatcactaggtgatagaaacttttcagcaccactataatcttatggtgccactgtatatccagtccttcattgaccaaaatgcggttatgcagcacataactgtacttcctctaagcccaatggctcctcattgcccaagtgagagagcacaccagaccacccttgtacctctctacaaagaagggggagtggcaaagggcaggtaggctgctatgtccacagatgcatttaaagtaggggctcaatgcaacactgggccaataagaacattcatcaatgttgatcagcaccaggtggtgggcatatcataaatttggcttaaaccctgtgtaataaaacacaattttatgatcatgctttttagagaaagaatcagtgactgtgggaaattagaggctagttactatccagaacatgggttaggaaacagttatatgatctacatggcttacttgctatcagaaaggatggctctttatagaaagcacattaataacattatctttgtattcattattcatatgttcctttccagcagcaatgtacattaatttttaaagtaaaatatatcagcctgtaagagctgtagaggactttatgaagagaaagtagaggcaataggagatgatgaggtttaggacacattgcccaaaaatatggcacactgacatttgagaaaacagcagaagcaggaaggtcactctcaccttctcctcacccttctcccccgaagcaggtcataaaactctccttccagaggtgtcctcccaatacccagaggaaaagaacacccttatctctgatcaaagagatcaaaccctgttatcctccaatcacacttgtgtagactgtctatttcttcatcaaacacagcacaaaaatacacaggtttccctgtttctttgggtcttcatttctgaagactgccgtgtaacttaaaattgacagcaaataaacgtctacacttttcttttattaatcttttattttaggggccttagcaatgaaccttgtaatagatgagaaaggacattactttttctcccctacagagacaactttacttgcagaattcttgctctgtggttctaaggtagaaagctaactaatactcaaaaggatattacatccatgtacaaatgcatgtaaatatgtatacaaaaatgcacatatgccgacatatatataaacagaatttctaataactgcaaagcctgcagtaaaaggtgaaaaaaagattagataaataaatgcctaaggcagtacttgttataggtatgcccaaaaaatggtaataaatgaaaaaactgaaatgcaagagaatgtgactatttcagtcacctggagagtggtgtgttcactaatggaccacaggtaatgatagtaacacccatgacatttatctcagaccatttaattaaactatatggcatgagacattttttacagagccattctgacaccaaggccattttgactgggcttaaagaaaacaaaccattgaactgtttcgacttttaaaacattatccactaacatgtgctacagacagctgacctaatccctgatcctcaccctcccatcctgggcctgaagaagaggtggggagcaggctgaggtgagggtcaaggggaggtggggtcatggggaggtggaggtcaggagtgcagtagggctcaggggtgtctgctgaacatactgcttgatacattttttaaacatcaattttataccatatgacattgtaaaaacacataaatttggaaactcctagaaaagtttcaggtaaaaatggtagaaagtctattacaaatagcagcatggacagaagtggagataaagtaaacaaatacctttttaaaaagaagatatgtgtccaagagcagaggtgacaatgccacccacaaatgtgaccatttcccacatgcctatgcacatggactgtgtaatattccatcccatccaaggaaatcgctttaatggaaaagatatcacttaaaatttgggtcaaacgccctgatcaataagtgagactttgggtctgaaggagataaccctgagataactgtgggaaatcatgacaaaatgacatataattttagaaaaggcagtaaagaaaaacattttaagtttgcttgcttgaaagctacatgaacttgcatttacgggtgttccactgattgtacttaactttaacaagcattgcctttaacagtgaataccttaaagtattcaacagttaagaaaaaggaaagactattaaaaattatccacaacggctaaggaaatttcctggcctcttttcttctcctaatgcccaatggctgacccatcagcaggtctcctctgttctacttcccagtatctctcaaattcacttcctcccaaccccacctgcactcaaactcgtccccaccccataccctgggcaccctccgtagtgtggccagagtcacctttacaggctatacacctctctccaaagcttacagcgaaagaattacatgggaaaattgttccaaaacacatttacagggctcatctattgacagtccaatttttaaattccaatttaaaaagttgtagcttaaaaaattttttttaagttgtggcttagtaccaaggaacctgaattttcaacatggagtccagacaattttgatgtatgtagtctttagaacctatcttgagaagtgctcttattagattcaaaccctttatcattttcaaaagaaatcaaaaacacatgaaacttaatattttttaaagacccagtaacaactaacaaagcctgctgatgactataattactttccactcggactcgtttccttaaattaagacactaaataaattatggtatgattcacaaacaccctccaaaatgtttaggtaaagtgaagactgactatgacctaaatattcataagcatccatatgacactttctaaagttcccttggttctaataaagtactaataaagacagcactatggctagaaagacatctgtggacgtctctggggtttcatcaagcctcatgagtctaaaagagtgatgtgaagacaaaggggtcctgcagcaagcagaaggttcctgccgtcactcagcacctcagctcgaggaggcagagatggtttgcccacagtgacagctgtcctctgcagctagcttacatggcttcacaagtcagacctctctgttcaaagcaaggttacatcactgttgaaaaatcctcagttttcctgtcccttaacagggctcctgcaaatctttactattcaagcaatcttgtaggaaaagcactcgaatatacctcataagatcctagttgctttcctgatttcatctcagcagtctcaacaccttcataagctggatggagctagagagaagcaaagccagagcactgggagccacagcgggcagagccagcagcacagccctgtctccacagctcccacctgtctgaccacagcagcccctggcacagaaacacttggaagagggccactaccatatggtaagcactcatttggatattttgaattaaataaaacatattattaacactaatttatctgtttaagttttttaaatgtggctattataaaatttgaaagtgcacgtgatactcacactatatttctgtgagacagtgctagcttgcactcttacctgtgagataaaaaataaacttgtttttgagcttctgcacagcaaaataaactatcaacagagtagacagacaaacttacaggatgggagaaagtttttgcaaactatacatctaacaatggtctaatatccaacacatattagtaacttaaatctacaaatttgcagaaaaaaaaacaacaacaaccccattaaaagtgggcaaaggacatgaacagacactttataaaagaagacatacgtgtggccaacaagcatatgagaaaaaagctcaacatcactgatcattagagaaatgcacatcaaaatacagtgagatatcatctcacaccagtcagaatggctattattaaaaagtcaaaataaaacatgctggcaaggttgtggagaaaaaagaatgcttacacactgctggtgggcatataaattgttcaaacactgtgaaaagcagtatggcaattcctcaaagaactaaaaacagaactaacattcaacccagcaatcccattacagggtatatacccaaagaaatgtaaataactctatcataaagacacatgcacgcatatgttcactgcagcactattcgcaatagaagacatgaaatcaacctaaatgtccatcaatagtagactgggtttttaaaaatgtgctatgtatacaccgtggaatactatgcagccgtaaaaaagaacaagatcatattcttggtggggacatggatggagctgaaggccattatccttagcaaactactggaggaacaggaaaaccaaatactgcatgttctcacttgaaagtgcaagctaaatgatgagaacacatggacatacagaggaaaacaacagacactggggcttcccagagggtggagggtgagaggagggagaagatcaggaaaaataactcatgggtactaggcttaatacctggatgatgaaataatccgaacaacaaaccccgtggcgtgagttcacccatataacaaacctgcacgtgtacccctgaacttttaaaagttaaaaaaaatgtttttaagtacagcatagtttcaaagtgaatacaggaaatgccattattaattggaacacttcaagtgtttcacagctaaatatgtctgttaatggttccaggtagaattttattaatgcctggcacttgttcaatctataattttttcttttctgtgtgtgtgtgtgtgtgtttttttcaggcctttgataactttacaattcgattaggaactatctcacctttttcaaagcactccgaaaattaaatggcacaaaaatcatccattcactaaaggcttataaaatgatgaagaaaaagagcctttcagaactttgttttcacaattgttactaatgttttgtaactgttatttctgtggtcactagcctatttagattttcttgaattaattttaataatttatattttcctataaaattcatttcattatttttcccatatcttttatcatgttaaaaagtcttaaatttaaggaaaaatctcctctctaaaagatatttcatctctcatttcttacatttttaggcgtgtctttcttctctcctttattcttgattagcactggcaatcaataaccatattttaaattcattaattatattgtttatatattactgcttaatgttcttatatttattaattccttcctctattttttcaggttcttttttttttcctgagaaagaattgaataattagctgtttttttctttcttgcttaaggacaaaatttcaacatgatttataattgtaatactattgctaaggtcaaaataatccattctcaaagtttcagtttatttttttaatacaaaaagttaaaaggcatcatgttgttgtgttttatatttcaccataattggttttgggggttttgtttgtatgtttgcttgtttctacaagaggtagggttgcatggtgacagtggtggtaagggtgcagggaggagattatcaacctttcctggagtaatcctaaatgtcatgacaatggagttcttaaactagcactgaaataaaaaagagctagccccagtcaaaaaaaaaatcaaattaaatatattttactatgagcttaatttcaacaatcccatttgtaagtaataactataacaccactagacatggatgaaggctacgggtcactaaaaacaatatgcatatatgagacagcttagtttttaaaatcataagctcagctgggtgcagtggcttacacctgtaatcccagaattttgggaggccaaggcaggaggatcacttgagctcaggaattcaagaccagcctaggcaatatagcaagacctgtctctacaaaaatgtaaaaacaagccaggagtggtcacacacacacacctgtagtcccagctactcaggaggctgaggtgggaggatcgcttgagcccagggagcagagtctacagtgagccaagatcatgccactgcactccagcctgggcaacagagcaagagcctgtctcaaaaaagtaaaataaaatcatagactaaagaaaattagacaaaccaatgtgttttgtaaaactttataggattcaaaagctgacagatttctgaaagcacattgtttagtgaaatctcttttttggtcctcatatgaaataactagattatcataggaaatacccattaatcaaacctaaaaagtaacacatttacaaatcacagtattaattacacaggcaaaaccttccttctatgatgtttccttttgttttttcttttttggacacagggtctcactctgtcacctaggttggagggcagttatgcgatctttgctcactgcaaccttcacgtctcaggctcaagtgatcctcccacctcagcctccagagtagctgggactacaagcaggtgccactacccccggttaattttttgtatttttttgtggagatgaggttttgtcacgttgcccagactgatctcaaactgctgagctcatgcaatccacctgcctggcctcccagtgtgctgggattacaagctacaatgtttcttgaatttgcacatcatccatgttccctggctaaaccaatgtccaggtttcctatatttatatattacttgaataaagtaacattaatttgctcattttctgacacatttttcaaactgttgggggcagcgataaagaaatatgggcagtgattggaagactaaaagtatcccccaactccatcataatccttacatgaaatggtgaattcaggaattagttttctttttctactcatgtatactcatgaatttgtgcagcacagaagcagattcatacacacaaagcaattactagaaattctgactatattgagtacaaattttactttttagttttgtttggaaaaattccagacactaaaaaatcagaagcagcttgactatatactaaagtcaatacccaattcacattctagattatagttgtattgtagctgacacttgatataatccactggaacacaaatcttttggccattctctttgtactgccctgcatagttcaagttatattaagagttgtgagcacacaactctggcaatatccttgtgaagtggattcaccaatgtaattttaccttaacaacgaacaagggcagtggaaaagaaagtgtgactactggggtcactgaggagtctgtggctgtgcaaagcaaatttagtacggaattcctcctgagaaagtcacatgacttctaaaacctgaattatattcaaataattcacataattttgttttttcttttttttgagacggagtttcgctcttgttgcccaggctgggcagtgcagtggtgtgatctcagctcgctgcaacctccgcctcctgggttccagcgattctcctgcctcagcctcctgagtagctgggattacaggtgtgcaccaccttccccatctaattttcgtcattttagtagagatggggtctcgccatgttagccaggctggtctcaaactcctgacctcaggtgatccaccagcctcagtctcccaaagtgctgggattacaggcatgagccactgcactcagcccgttcacacaatttttaagcataaaattacataaagaataaacatattaaatatttttttaaatgcactgtcaccatttaaaggaaattccacaaggaaattacatgtagtgttagaaaacttggcaaagtttgataactagattttggattccagatacttttagatgaagctatatcaatgtttccataatgctatacccctgggttcatactgagtaacagcactaaaaaatgtatggtgcaatcactctgaaaactagcgttcaagaagtcaacagccattattcatgtgtacacattctcacgtgctaacagtctctgatgaccaagaggaacctcatcattcaaactgcaaagatcaaaaaactggttaagctttttatgtcctgtatgagagatctttccctaccttaaggttatgaaaatattctactctatcatgttttagaaggctaattattttttctttcacattctataatccatgtagaaatgttatagatggtataagaattttttccatatggccagcatcaattattaaaaagataagtccttcccaaggcactacacaaagtccttaatactctgttccactggtctatatgttactctcaggccaatgcctcactgttttaattaatatgacttaaaataaattttactaaccacctgagcagttcttcccccatgctatgttttccttcaagactgtattgacaattcttgtccctttgcatttacatatatattttgtaatcaacttatcaatttacatattcacatatgcatctgctgaactgcttataaatctacagatgaattaggggagctacatattagtgatattgagtcttcccactgatcaccatcatattacctactttctcttaagtcttctataatttcctctcaataatgtttttcttcttgtgatcttgcatattttttactgcttctaattgatattttatgctatcataaacagcatattttcaaatttttcttttctgtttgttgttattctatagaaatacaactgattttatccactgtattgactttgcatccagcaatatttctattaaggactgaatgtttgtttcccctcccaaaataccaatatggggatggagatgggcctttgggaggtaagcagggttagatgaggcatgagggtgggggactccacatgggattcgtgcccttatgagaagacacaccagagagcttactccctctctctccctgccacatggggacacgacaaggaaggaagcgagccctcaacaagaactgaatttgccttgatcttgtgacttcccggcctccagaactgcaaaagtaaaaacttctgttgttgaagacacccagtgtgcagtattttgttatggcaacctgagctaagattaatgccaaaaattatgtattattccagtaatttatctatagattcattaggaatttcctttgtttacaatcatatttatctgcaaatatgagagatttcttcctgagatcatattttgtttacttatatgcctaaatgtattgggtatgtcctccattccaatgtcaaatacatatggtgttagagggcaacgctgtctcatttgctgtatcagaaagatttttataattaagtagaatattctttacacacattcttagcactgcagtactaagcagaataatctcccccaacacaaatgttcatgttctagtcctcagaacctgtgactatgttatacctcaaagcaaaagggactctacatatgtgatcaaggtaaggatcttaagatggtgagcttgccctggattattacccagatgggcccagtggaatcactagggtccttttaaggaaaagagggaggtagtagggccagagtcagggaagatgctgtgatgacagataaaaaggttagagcgatgcctcaaaaccgcacaacaacatggagactgaacaacctgctcctgaatgaccactgggtacataacgaaatgaaggcagaaataaagatgttctttgaaaccaatgagaacaaagacacaatgtaccagaatctctgggacacatgtaaagcagtgtgtagagggaaatttatagcactaaatgcccacaagagaaagcagaaaacatctaaaatcaacaccctaacatcacaattaacagaactagagaagcaagagcaaacaaattcaaaagctagcagaaagcaagaaataactaagatcagagcaaaactgaaagacatagagacacaaaaaaccctttaaaaaatcactaaaaccaggagctggtttttggaaaagatcaaaattgatagactgctagcaaggctaataaagaagaaaagagagaagaatcgaatagacgcaataaaaaaatgatagaggggatatcaccaccgatctcacagaaatacaaactaccatcagagaatactatcaacacctctacacaaataaactggaacatgtagaagaaatagcataaattcctggacacatacaccctcctaagaccaaaccaggaagaagttgaatctctgaatagaccaataacaggctctgaaattgaggcaataattaatagactaccaaccaaaaaaagtccaggaccagatagattcacagccgaattctaccagaggtacaaggaggagctggtaccattccttctgaaactattccaatgattagaaaaagagggaatcctccctaactcattttatgaggccagcatcatcctaataccaaagcatagcagagacacaacgaaaaaagagaattttagaccaatatccctgatgaacatcgatgtgaaaaacctcaataaaatactggcaaaccgaatccagtagcacatcaaaaagtttatccaccacaatcaagtcggcttcatccctgggatgcaaggctggttcaacatacgcaaatcaataaacgtaatccatcacataaacagaaccaacaacaaaaaccacatgattatctcaatagatgcaaaaaaggccttcaacaaaattgaacatcccttcatcctaaaaactatcaataaactaggtattgatggaaaacactgcattttctcactcataggtgggaaatgaatgagaacacttggacacagggcggggaacatcacacaccggagcctgtcagggggtgtggggctgggggagggatagtattaggagaaatatctaatgtaaataatgagttgatgggtgtaacaaaccaacatggcacatgtatacctaggtaacaaacctgtacgttgtacacatgtaccctagaacttaaaatacaatttaaaaaaaacaaaaaaggttagagtgatgcaggggccatgagccgaggaatgtaggcagcctctaaagcttcaataggcaatgaaatacattctcccctggagcctctagaaggacaccgcctgccagtgtcacctatgttggcttcaggtctcctgtaagaaccataagacagtaagtttttgttgttttaagccactaggtttgtagttatttggtagagcagcagtagaaaacatagatatggcagattttttaagttcctttattatcaattttctgcttctggtaaaagcaccatataatttttcatctttatttagataacatggtaaaatacactaattgattttaaaatgttaaaccatctatatattccgggaataaactcaattggctaatattatgttaggcttattatatataactggcttttatttgcaggattttttgtggggttttttggtatgaaggttcataagtgagattggtctgtaatgttcctttctctaactattctcactaagttgtaccactttataaaggaagttgagaagtattccctatttttgtattctttggaagaatatgtttaagtctggtgccatataccctaatctaagcatatattaaaccacatgatttggcccttagctaaagtgataattgtgttgtttaaatcttccttcttttccatctgcttctagcaggtattaagaaaagtgggctggctgggtgcagtggctcacgcctgtaatgccagcactttgggaggcctaggcgggcagatcacgaggtcaggagttcaagaccagcctggccaacacggtgaaaccccatccctactaaaaatacaaaaattagtcgggcgtggtggcaagcacctgtaatcccagctacatgggaggctgaggcaggagaatcgcttgaacctgggaggtggaggttgcagtgagccaagattgcaccactgcactccagcctgggtgacagagcaagactctgtctcaaaaaaaaaaaaaagaaaaaaaaaaaacagaaaagaaaaataggctaaaatctcctgctatgtttgtaatttgtctacttcaccttttagttcagtcaacttctgctttatatggtttgatgctaggttaaatggagacaaatttagaattgttatctcttcctaagaattgaacctttatattacaaagtatctttctttaccggtagtagtacttttagctttaaagtccctgtattttctgatatttaagacttcggaaaagaagttatctctaagctgaaagttaaaggatgggaagaagtctgttgggtaaacagagagaaaaacctccacacagcaaggtgtgcttggtcctgacaaggtcctgaaggcaaagagaatatggctctttcatggaactgaaatatctttgccatctaaaatctgtgagtaagaacaacagtctccaccttacattccttccttggtaacagccagagtcctaattttgttctggtattcactcttccaggtggtcaggaaacacatggtctagaccaagagcatagattattatggttgcaagacaattgtaagaattctcttcccccagccagtggaatagaatacaggagaaacttttaaaagaggttttctcctctaataccatcatggggaaaaaatccagatatctggagctgtagcaaccactttataagaatgaggaaactagccctaggaccaagataatacaataagactgtcaggcccaaacaatagaaagagcctctgtctacactaacactgctgacctagacctgtgtccaactttctgctttataagcttataaacttctcatcgttaggaaacttttagctaagttttttctgctccttgcaactgatgcaagatccttacataccactttttgattgttttttaaaattcccaatgttaaataataagagattgctgaagaatatttcccaaattgtataatctacacaagaaaatatatatttttactgtttccccatccattgatacatgcatattacataattgcccaaaatatttagaaatgtaaattttacattatcaaaaaataggccttatataaaatgtaaatggtaaatatataacgatttgtaaatggtcaaatatataaccattctataatccttaaaaattaatagtcttacagtgattctatttgaaagtacagtttccatgtctggtcttgacaaagggaaagtacaataaattaagaaataagacataaaaatgaatttaactaaatcccagaaaaacaaccacacaaatggcatatacacaatgcagcctagaatgagacatttcaaaattaaagctcttatggcttttctgagatttttaaacaaattagcaagtataaaaagaaattaaatttttacatttttcattattttccacattgaaacctacacttattaactttttatagttgtcctatcaaattttgcatcataatagttcaaatgagaaaattgtagaagagtgagacatacattatctaataaggtacttattcaacatactaaaatttcacagtacataattttgagaaataagggattaaacacactgagaaaaattttttccagttcctatatgatcaagcagaaacctttgattttttaaactataatcaagaaaataaagataaaatatttctaataatggataggcattgctaactaggttaacattatgttaactaagtaaatagttgggcaattctctaggcaaattaagcagagtttacttttcctcctattacatacacaattatataacacaagagttgttagcaggtcaaatgtttcaatatataaaagaaagcattctaattcctataaaaaccacatcaaatgtgctcactgaaaattcagaataaattatattcatgaaagacactaaagttacaaaagaatacattcatttatcagggaaaatgaagcaagagttgtaaacctccactgcagggtgttaggaagcagaaatttcattagttcttcagcccgaaatgtaacctttatagatgtcttcttcacaagaaacatctgcgggtattaaaaaggaagatatccagaagagtcctctccagaagaaattttaaaagacctatttttaaattgcccacatatagtaactataaaccatgaatgacatctaaaaacaaacaaacaacaataacaaaactagctaagggcatctgagatcatcaaaagtgggaagattctggaagggaagtgacacttgcaataaagataaaggaatagctctagtgaatttcctaatttttatgaatttgcaagctccacagataccaaaatctccaatagaaaacccattgtcttactggcttgaagaaccaaaggacagagtttaaggcaaccatagctattggaaatgaggttggcaataacagtgaatcccagcaaagagacagacctagagaagacgatgcataaattctgtgtataaactctgcccaaatctctggctgacatttaaaccagactaagactaaaacaaacgaagtatgatttcagttaccacccatgagtctgagtttgcagtttgagtcaccaaaattaattttttacccagggggggaaaaaaaaaacattgttggaacaaatgtaacagaatccaggaaaacaaaaacaaaacaaaacaaaaaaaaccacatgatccattttcagaagaaaatcaatgaagactgacccctgaccctgagtagacccagatgttgaaattagcagagaaggatcttcaaccagctgctataagtttcatcaaggttatacagaaaaatatgcccatgatgaatgaaaggaatatcatcagaaaaaaatctgttgtaaaaaagaatctaataaaaattctaaaactaaacaacatcatacggatataaaatcgacattgttaagcagcaaatgggtttagcagattggtgatgacagagtcagtaaagactttcctgtaaagatagagcgataaaaactactgaatctgaggaatagagagaaaatgtatcaaacaaaatgaagagatcttaagaacctgtgggacaatattataacattcttgtaattgggctcccagagaagaaaaaaaaagagagagagagagagaatgaggcagaagacatatatttccctaaaaggatataagtcataaatctacagattcataaaggtcagcaaatcccaaacaggataaatacaaagaaagccacacataggcatgtcagtcaaatgaccatcaacaatgaagaaaatcacctaatcgttggctggtccactatttactatatgacattcacagtcttcctacttactatcatgtctggccatgatgcttctggtatttgtacagtccagaatcttgccctaaggatgtcaaattactgtattctctttcttaaccaatttttcccttaacctcataggttagcatttagggctgagtggttaacggagaaaacactaaattggactccccttggtttatattccttgccacattacctaaaaaggactaactaactctgcggattaggcacagaactgtagattaaatatcaggatagtcagtatagcacagtggttattaggctggggtttagagtcaagtgtgtttaaatcttagttttgtgattttcttagctgcctcaaaatcatgccccaaaatacctactatgattcctgttatgaagattaaatgcttagcactgtccctggcacagagaaatgcccaatactcgcttgaaattaatactcatcattgtaatttttcagtttaaagaaaagaccaaagcattccactttatttttaataattaatacatctaattattagcatgtcataaatgaatgtaagacatcatcaatgtaagataagattttattttatgcaccacacagaaagaaagaatgttgccaactgaaccaaaacattctactgcttgtatgtcaccaaataagaaacatatgtctcctgattccagaggtaataacaagtacatcttattaaataagacacatataactccttcaattatcacaaattaagctctacaagatagatactattatccctaattttcaagtgaagaaattgaggtccacaaagttaagtaagtccctaaattacaaaggtggtaaacagtaaggcaggattcaaagacaggcaaactggtttcagagctcttgctattagccactgcacatgtaagtacctctgtttttcttgagttccatctttttattaactttgaatgttcaccaataccataagcctcaaatctgcacaagaataatgtcagactctgacagatgtaaaagagggccattccatgctgtgagatacaaaatgtgacatctattatttattacaaatttcaacacaagagaccatggttttcaaccctggctacccatcagaatcacttcaggtgcttaaaaaaaccgcagatgccaggaaataaccccagacttactaactcaaaatctccaggattagaatatagagatatgcacatactttaatgctccaaaagtcactctgccacatggctggacttgaggaccaatcaatcttaaccaaccaatcttgttttagaataattttttttccattggtatactctctgttactcttactaccattaatctgcaaccaggtaataaaaagttcactttacaccaaccaaaagtattctgatgttaatatgatcttaatttaacctcattatattttttaaaataaaaaaatgtattactggtatatttgagactgctgagaaagggaatttccatttctgtataaatacagcattactgcccatttaatatgaatacactgtgaaatgatcaaaatgtggcagttcctagcctgatgaggaaaatgaaacaaagtgcttttgaataaaacaatgtgtttgtcaaactaccacctcggtgacaaacactgaaagtgcctgcttggtaatgccttcccaggccaccagccttacttcctaaggacatcatccctctctcaaccacagcacatggcaaaatacagtgatgttcttctgtgtttatctcacccactgatactatcatgagaccctcccagggagaggtctcatgataatatcttctacatgtagttcagtgtcagaacagagtagaaactcaacaaataattactaaatgaatgaacaaattcttcctctaattcatacttgacacttacatcactgttttacatatatgtacacacatattttttaatagaacttaatttccccaacttcttctttttccaagtacatctctaggtgaaaacctcacactttaattgcctgtaatgttgaattactcatgtctttgttacccactcttgccaagaaattaacaattccaccaatatctattctcaaaatcatactcttccttcaaaacacaaattaaactgcatctcttccatttaaacttgcctgactccctcaaataaagtgtcactttaatcatctgctatagtaaaattgaagaaataaatgcagggaggtatggagaaataattcatggaattcttatttttcagagtactggggatcaatatcggactatagccacactgtccagcagaactttctgtggtaatagaaatattctgtatcaatgctgtccaatagccacatgtggctaatgagtacttaacatgtagctagtgaagtttaagggctaaatttttcatttcatttggctttaattaattaaaatataaatcaaaatagtgcacatgacaaccaccttgggcagcacgggtctagaggcacttcggggtacaccacagagaaacatctccagcctcaacccactcaatctttatattagcattaatacctcacatcaagtgtttcaatgataaaaagctgaaaaggggctaggcacagtggctcatgcctataatcccagcactttggaaggccaaggcaggcggatcacttgaggtcagggtccgagaccattctggccaacatgatgaaaccctgtctccactaaaaatacaaaaatcagccaggcgtggtggcatgtacctgtaattccagctactgaggagaatcacttgaacctgggaggcagaggttgcagtgagccaagatggcaccactgcactccagcctatgtgacagagtaagactcaaaaaaaaaaaaaaaagctgaaaagagaagttaatgcattagaaggaggaaaaatgtccctaaaaaagatactggtgccaagataccagtacgagcggtatctagcacatttaataaaaatgagtaaaaagagactaaaacaccaaacccccaaaacaagccaaaaccctcatgagagtgtagagctatccgaaggtagaaaagaatatcttgagaggtagagagttccatataacccaagatgttcaagaatctctccaactaccatattcaggattcctgggaagggatgtggagcctgggagcaatgtgtggaatagcaaccatcaaagtctaagcgtggaagtccagcagagatcaacggagtcaagacagaagaatctgcttttctaaatattgtcatgtgagtcagagcgacggctgcgaaggagatccagaccttccgacctccgatccattctgcccactagactaggggcatccatcacacacttcaaagttgtttaaaaggtcctagatttcagctaaaattgctggtagtgacgtccattaaacatgtcatcaggccgggtggcacctgtaatcccaacaatttggggggccaaggtgagcagattgcctgagttcaggagttcaacaccagcctggccaacacggtgaaaccccatctctactaaaaacacaaaaattagctgggtgtggtggcgggtgcctgtaatcccagctacttggaaggctaagccaggagaatctcttgaacctgggaggtggaggttatagtgagccgagatcacgcctctgcactccagcctgggcgacagagtgatcctctgtctcaaaaaaaaaaaaaaaaaaaaaaaaaaaaaagtcatcatgtccagtgtttctttatgaacccaaaagaggtgtatatttgaaaatatgtaatttatttgaactattgtttttttaatttgaggcatattaaaaatctgattagaatattagaaaatatttcacagttttgcctacagagctcattatcatccgcttaagtgatgttttagaaaattattcacttatttagcaagacttaaaaatgcactactggccgggcgcggtggctcacgcctgtaatcccagcactttgggaggccgaggcgggtggatcacgaggtcaggagatcgagaccatcctggctaacacggtgaaaccccgtctctactaaaaatacaaaaaattagccgggcgtggtagcgggcgcctgtagtcccagctactcgggaggctgaggcaggagaatggcgtgaacccgggaggcggagcttgcagtgagccgagatcgcaccactgcactccagcctgggcgacagagcgagactccgtctcaaaaaaaaaaaaaaaaaaaatgcactactgttcaactcctaaagaaaaaaaaatgtatttaatccttaaatactttttaaacttaccaaccccaaatatataataaataattctgacagggcgaagctcagagacactggcccccaaaaatttgcatagtaataaatatagtcttctaaatgaaagtaggactgccccattctcaacattggtattagaatctaccttttgaatttctttacatttatgaaataagctttattaacgaaatgacaacaaataatataaccacattttcaaaattaaaaaaaatacataagcaaataataaacctccctcattttttcactaagctacgttttcctttcttcaaaactgttctctgtagtcattaaaccacagaagggacatcagtgacacaaacacccatgtttgataggtgaaaaactgactgggatcacttgtccagcctcccaagcaaggcgaccctggcgtactgttcccgggtccctgcattctctgcccctctgctccacactgctcatcacgactgccttgctgctttgactccagaagaggcctccatgatgctcgtttttcgtttttttgttttcttttttccttaaatacacaacaggaagcacagcttgaatattcatattttattttaaagttcttgaaaacagcaaaacaaaatgaagctagctttgaagtgctgtgattacacagaaaatctccttccattcattcaaatcatgatgactgggcacctacgatgggccaccaccatttgagacaccattctagcttatccattctaggaggtgctacacagataaaaatctctgccttaatggacctcttatactttagtgtgggaagaataaacaacagataagtgaaatatgtagagtacgttagatagtgataaatgctatggagaaatgtaaaagcagagaaaaggatgaggtatgagcagactgcatgtcaaacaaggtgagggaacacgtcactgagaggtgaccaaaaagaaagaagggggccgggcgcggtgactcacacctgtaatcccagcactttgggaggccgaggtgggtggatcacgagatcaagaacatcctggccaacatggtgaaaccctgtctctaccaaaaatacaaaaattagccgggcgtagtggcaggcgcctttaatcccagctacctgggaggctgaggcaggagaatcgcttgaacctgggacatggaggttgcggtgagccaagatcgcgccactccagcctggcaacagagcaagactccatctaaaaaaacaaaaaaaaaaaagaaagggaaagggaaagaaaagaaaagaagcaagttgtgaaggcgtctgggagcagaaggccgtgaggcaggagcacggttgctgtgtcctgggtctgcaagaaggccagtgtggctgacaccctgcacccgaggtcatagaggaaaaggacgggaaacgaaggtggaaccagaccctggaaacccttgcaaacagaccagctgcttgttcaccgcctttaccacccaccatcctcactcacaccctgtctccctgaacctcacacatctgagatgagatgaaatcaagtaagaagtcattatggtattttgaaaaaaagaggaaagcatttttccatgaattggcagtttccccaaatctatcctcaggtgtatgaaaatcagtattaaagatctgaggtgggccaggcatggtggctcatgcccgtaatcccaacactttgggaggttgaggcggtcggatcacttgaggccaggacttggagaccaacttggccaacatggcaaaaccctatctctactaaaaatacaaaaaaactagccgggcatggtggtgcacgcttgtaaccccaactactcaggagacagaggcacaagaaatgcttgaacctcggagacggaggttgcagtgagccgagattgtgtcactgcactccagcctgggtgacagtgcaagactctgtctcaaaaaaaaaaaaaaaaaaaaaaaaatctgaagtggttaccaaccctcattatttgaaactacctcagttggaatgatcattacagatgcttattacagccccaaataaaacaataggagactagagggtagaggaagaaatatgtgtgttgacataaattttatctcattagtcattatttatctttacaatacattaaaaggattcaaatgtttttacagctttgaattttgactttaaaacctgaaatcctaagccacagcaaggtagttggcctggattatatcctagtgctacaagttcggcagctgaataaaattgagaactatatgttaatcattcactcaatattttcttgaccacaattatgcctagatcagcacaagaaaccaaagaaagcctgccagcaatattccctgcagcaggtcctgaggcaattttcccatctgtggtcacaggaggggaagcttcttagtggcccaagagaagcatctacctgaggcgctggatgggcacctgagagtcctgcatggttgcatgcagcagtcgctcttctggggcattgtctcccttcaataaatagatctatctactgcaaaatctcacagaacgctacaagtaggtccaactcaaaaacaaaattcagactgcataagggatcgttctgcattgctgacctgaaacatctgtgccttgtgacaaaaactaggaagagggatcccatacacttaagatcactgggactgacgtggatatttgtgaagatgccaagaagaaccgtgacagatatattgtcactctgcaataaaattagaaaaaaaaatcctcatgccataatgtatatatacataaactgtatccaaaaatatgtggctggtaaaattttaaggccaatcattcttccttcattcattcaaaaaaacaaaagtcaagatacaaaaatagccattttctttgttgatccaaaccaccaagttttaaatgtcaatgccttgattttatcttaaaaagaagttaatagcattagtctaaaacctgtattcagagataaatcataatagaaaggaacaactggcaacaaaaagactggagttttaaaattctcatgactacctgtgatttgggacaaattaattaatgtttctgagcctcagttcatttacctataaaatgaagctagtaacagctctttctcacttgtaagggttggcaatatcatacacaaagcatctagctctcagtgaacagtagctacagcattactgctaccaatctgtgttagaatttgcttttggtgagatcctatagacagggcatttgctatgatgagccagagatacaaattgtggcacacaagcccaggacaaggtttctgtttgtctgcttcattgctacctcccccatgcatggcacagtgcctgaaactttaaaggtatcaaataaagatatttttattgaaaagtaagaaaaaaagataaatcactacccctgtggagtattataataaatctcaaatttgggattggcctatcacttcctgttgtaatagtatactctggtacttctggtactgaagatatctaatcagcaaaagttttaatttcttaaggaattcatttacctgaaacggtaagatctgttgtattttttcaatttgtaagtaaatacatgtcaagacattctgtgtgtgtccaaaaggccaagaaatcacaaagcacaaatattcacagccataaacacagtggctgtattcctcataatgggaaactatgtaaaaacaaaccaaaccaaaccataataaatggtaagtataatattaacaccaaaatgaaactataataaatgttaatatgtaaaatgtttaagaaactgctaacactacagttaaaacctttatgaggctagctctcacaggcatgttccaaactcaataaaagaggtgaatgccacaatggctgtcagaaacatgcaagtcaaaacacaatctagagggaacaaagcattcgtggagcccaaggtctcggcagccctaaataatatcccacctgtcattatgtcaaacaatttggcccacttccataacaagacaaaagtcacttttgttgcatgtcaaatgtggagtgagaacgagccagaaaaagctgtttgaaggttagaagtactatgagcagtttaaaagaacagcaataaataaaacttgttaatgcccctaacactgctagtcaaaaatagtcatgaattaacagatgttactagtataactacatgcccaagtgtcgggcaaattgagttatctaaataggtgatctacaaataaagataggaagaatgaataattaataacagaccatgtggaaaagagatctcacacatttaaaacaccaacaaaaggcacccaataaaacggctttcagaatacaaagagtagatctcatattttcatcacctgaaaagtagaccctgcataagttatgttttcattgatccaagtgatactaaaagtttagagaagtacttcagaatttttaaaaattaaactttgttaataatcacaaattatacatgtaattactatatttttcagtttatcaaatttagtaaaattattttggaaatcagaataagaaataaggccaatagaaggtttacaaaaaaccgaagtgtgggaggaggaagagcagagggagagaaaaagtatattctgaccaatcatgcttacatacttgatgcaaaatccttcttgactgaatactttcccattgtttttgtccctggggcttgctgacagagacattgtgtccatgtgaagggaaaacctgttttttcccccacctaggatcccaaaggacctcctccccgattccctacaatttcttctatattacccatgccccttcatcccactctggccaagtcacccaggctcttgcagccctgttgctgacagttacacttcccgacacaaggcctgatgttgaggtgagggcagcctggtcagttaatgaagctggcatggggagaagaaaggaagcccttttcagaaaacctaggctgatttcgtatgagctgattctttggggatgccacaatagaccacttacagagtgcttttggggagggagatgtcattctaagcatttcacttatattcctataaagttcacaataacccaatagtactgttatggataaggaagctgggaacaaaaaagttaagcagcttgctcaaggtcacaaaaatcagcatgtggcacagaaagggctcaaaaagacagcagtaacctctgcagacttaaatgttactgtctgacagctttgaagagagcagtggttctcccagcatgcagctggagatctgaggacaggcagactgcctcctcaagtggatccctgacccctgacccctgagcagcctaactgggaggcaccccccagcaggggcagactgacacctcacacagcctggtactccaacagacctgcagctgagggtcctgtctgttagagggaaaactaacaaactgaaaggacatccacaccaaaaacccatctgtacatcaccatcatcaaagaccaaaagtagataaaaccacaaagacggggaaaaaacacagcagaaaaactggaaactctaaaaagcagagcgcctctcctcctccaaaggaacacagttcctcaccagcaatggaacaaagctggatggagaatgactttgacgagctgagagaaggcttcagacgatcaaattactccgagttacaagaggacattcaaaccaaaggcaaagaagttgaaaactttgaaaaaaatttagaagaatgtataactagaataaaccaatacagagaagtgcttaaaggagctgatggagctgaaaaccaaggctcgagaactacgtgaagaatgcagaagcctcaggagctgatgcgatcaactggaagaaagggtatcagcaatggaagatgaaatgaatgaaatgaagcgagaagggaagtttagagaaaaaagaataaaaagaaacgagcaaagcctccaagaaatatgggactatgtgaaaagaccaaatctacgtctgattggtgtacctgaaagtcacggggagaatggaaccaagttggaaaacactctgcaggatattatccagaagaacttccccaatctagcaaggcaggccaacattcaggttcaggaaatacagagaatgccacaaagatactgctcaagaagagcaactccaagacacataattgtcagattcaccaaagttgaaatgaaggaaaaaatgttaaggacagtcagagagaaaggtcaggttaccctcaaagggaagcccatcagactaagcggatctctcggcagaaactctaccagccagaagagagtgggggccaatattcaacattcttaaagaaaagaattttcaacccagaatttcatatccagccaaactaagcttcataagtgaaggagaaataaaatactttacagacaagcaaatgctgagattttgtcaccaccaggcctgccctaaaagagctcctgaagaaagcgctaaacatggaaaggaacaaccggtaccagccactgcaaaatcatgccaaaatgtaaagaccattgagactaggaagaaactgcatcaactaatgagcaaaataaccagctaacatcataatgacaggatcaaattcacacataacaatattaactttaaatgtaaatggactaaatgctccaattaaaagacacagactggcaaattggataaagagtcaagacccatcagtgtgctgtattcaggaaacccatctcatgtgcagagacacacataggctcaaaataaaaggatgaagatctaccaagcaaatggaaaacaaaaaaaggcaggggttgcaatcctagtctctgataaaacagactttaaaccaacaaagatcaaaagagacaaagaatgccattacttaatggtaaagggatcaattcaacaagaagagctaactatcctaaatatatatgcgcccaatacaggagcacccagattcataaagcaagtcctgagtgaactacaaagagacttagactcccacacattaataatgggagactttaacaccccactgtcaacattagacagatcaacgagacagaaagtcaacaaggatacccaggaattgaactcagctctgcaccaagcggacctaatacacatctacagaaccctccaccccaaatcaacagaatatacatttttttcagcaccacaccacacctattccaaaattgaccacatagttggaagtaaagctctcctcagcaaatgtaaaagaacagaaattataacaaactatctctcagaccacagtgcaatcaaattagaactcaggattaagaatctcactcaaaaccgctcaactacatggaaactgaacaacctgctcctgaatgactactgggtacataacgaaatgaaggcagaaataaagatgttctttgaaaccaatgagaacaaagacacaacataccagaatctctgggacgcatgcaaagcagtatgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaattaatgaatccaggagctgcttttttgaaaggatcaacaaaattgataaaccgctagcaagactaataaagaaaaaaagagagaagaatcaaatagacacaataaaaaatgataaaggggatatcaccaccgatcccacagaaatacaaactaccatcagagaatactataaacacctctacgcaaataaactagaaaatctagaagaaacagataaattcctcgacacatacactctcccaagactaaaccaggaagaagttgaatctctgaatagaccaataacaggatccgaaattgtggcaataatcaatagcttaccaaccaaaaagtgtccaggaccagatggattcacagccgaattctaccagaggtacgaggaggaactgctaccattccttctgaaactatttcaatcaatagaaaaagagggaatcctccctaactcattttatgaggccagcatcatcctgataccaaagccgggcagagacacaacaaaaaaagagaattttagaccaatatccttgatgaacattgatgcaaaaatcctcaataaaatactggcaaaacgaatccagcagcacatcaaaaagcttatccaccatgatcaagtgggcttcatccctgggatgcaaggctggttcaatatacacaaatcaataaatgtaatccagcatataaacagaaccaaagacaaaaaccacatgattatctcaatagatgcagaaaaggcctttgacaaaactcaacaacgcttcatgctaaaaactcccaataaattaggtattgatgggacgtatttcaaaataataagagctatctatgacaaacccacagccaatatcatactgaatgggcaaaaactggaagcattccctttgaaaactggcacaagacagggatgccctctctcaccactcctattcaacatagtgttggaagttctgaccagggcaattaggcaggagaaggaaataaagggtattcaattaggaaaagaggaagtcaaattggccctgtttgcagatgacatgattgtatacctagaaaaccccattgtctcagcccaaaatctccttaagctgataagcaacttcagcaaagtctcaggatacaaaatcaatgtgcaaaaatcacaagcattcttatacaccaacaacagacaaacagagagccaaatcatgggtgaactcccattcacaattgcttcaaagagaataaaatacctaggaatccaacttacaagggatgtgaaggacctcttcaaggaaaactacaagccactgctcaaggaaataaaagaggatacaaacaaatggaagaacattccatgctcatgggtaggaagaatcaatatcgtgaaaatggccatactgcccaaggtaatttacagattcaatgccatccccatcaagctaccaatgactctcttcacagaaatggaaaaaactgctttaaagttcatatggaaccaaaaaacagcctgcatcgccaagtcaagcctaagtcaaaagaacaaagctggaggcatcacactacctgacttcaaactatactataaggctacagtaaccaaaacagcatggtactggtaccaaaacagagatatagatcaatggaacagaacagagccctcaggaataacgtcgcgtatctaaaactatctgatctttgacaaacctgagaaaaacaagcaatggggaaaggattccctatttaataaatggtgctgggaaaactggctagccctatgtagaaagctgaaactggatcccttccttacaccttatacaaaaatcaattcaagatggattaaagacttaaacgttagatctaaaacgataaaaaccctagaagaaaacctaggctttaccattcaggacataggcatgggcaaggacttcatgtctaaaacaccaaaagcaatggcaacaaaagccaaaattgacaaatgggatctcattaaactaaagagcttctgcacagcaaaagaaactaccatcagagtgaacaggcaacctacagaatgggagaaaattttcgcaacctactcatctgacaaagggctaatatccagaatctacaatgaactcaaacaaatttacaagaaaaaaacaaacaatcccatcaaaaagtgggcgaaggacatgaacagacacttctcaaaagaagacatttatgcagccaaaaaacacatgaagaaatgctcaccatcactggccatcagagaaatgcaaatcaaaaccacaatgagataccatctcacaccagttagaatggcaatcattaaaaagtcaagaaacaacaggtgctggagaggatgtggagaaataggaacacttttacactgctggtgggactgtaaactagttcaaccattgtggaagtcagtgtggcgatccctcaggtatctagaattagaaataccatttgacccagccatcccattactgggtatatacccaaagaattataaatcatgctgctataaagacacatgcacacgtatgtttattgcagcattattcacaatagcaaagacttggaaccaacccaaatgtccaacaatgatagactggattaagaaaatgtggcacatatacaccatggaatactatgcagccataataaatgatgagttcatgtcctttgtagggacatggatgaaattggaaatcatcattctcagtaaactatcgcaagaacaaaaaacaaaacaccacatattctcactcataggtggcaattgaacaatgagaacacatggacacaagaaggggaacatcacactctggggcctgttgtggggtggggggaggggggagggatagcattgggagatatacctaatgctagatgacgagttagtgggtgcagtgcaccagcatggcacatgtatacatatgtaactaacctgcacattgtgcacatgtaccgtaaaacctaaagtataataataataaaaaaaagaaaaaccattatcaaaatattctgaaaagcaaatttatgatatagtaatacatatcctttaagatctagcaatctgatggatgaggtcacaagagctggggctggaaatgtcataaaatatatgaactgaaaacacttctttatatatgttatatatgtttaaaggcattatcaatactaagaccaccatatagcaaaagtcagatgtctcaaaagatggctctaaatactcctgatccagaagctttcttcagtcccagtgcacttgacctcactgaaactccagggtcccaggacgtcctcacccatggctcctaagaacccacgcttacctgcaactcctacttttccatttctgttccttctgcagttcttccaattcctgaacacagatatgtccaaaggattcccatcagagtgtatatcataaaaccagtatcctgtggaacactgcttagtaaattcctgactggctctcctggtctttatctgccactaccacacaccacatttactcttagtgatatttcctcactcttgtctacccacagaagacatgcccttgctccagaaatgacacccagaaaccctaaacaacagaagagattcccaccaagcagagggaaagtgctctttttccaatggcttgctctgtctcttgtccacatacacatctgttctgaagaacatgagttgccaccaagcattccctactgaacccacatcccagatgttaactggatcaaaaccagaataataaacgtcaaatcctaaattccctgttaaattacctacgaaacccaaatcagaaatttttaagataaagtgcacagggcatttcagctgtctttatttttctttctacataccttttctacttcttatcctgatgaattggtctcaactaagaaatcacaaatgttccttttatcccattagcataaggggtgacaagagtttgtcctgtgtgagacactcctttattcctttccatgagcccatgtgacgtactagataataaatttcttgagaacaaagacaatgctgtacacatttgtatatcccacatggctacctcttaattaacaggagctcaataaatgctacaggtgtacaagaacaacaaagtaaagacactaaaaatgtacccaaaggcagcatctctagcaaagaaaaagcattgcatcttcctcaacatttaacaactgaaaaagctatgaaaaacaatgacatacgggatacttcacatttaaaaaaaaaaaaaaagaacaaaaattctaaaccctcaaaccccaaacctccattcacggacctgtagtgccatagttgaagtgtctaagatagcaaaaaggcaaatgattgcgaagactgaataccaattccaagacggtccaagctcgagctgcttatgccaatgtttcttactttgaatgtgatcttgggaagttcacagcacatacctatacctcactttctttatgtctaaaatggaaacactttgattaaagcaacgaaggggggaaaaaagagtaaaagtgatgaaaaagccttctttgcattcgtagaacaattctttattagcgaagaaacccacatgtgagtaagagggttcttgccaggcaggggcgtgtgtgcatgtgtgtgtgtattgcatgtctgtgtgttgcttgtctgtgtttgtctgtgtaggtgtttggccatggatacaatttacatgcttaacttttcctttacacagtaggaaatgtatgccttagaacaaagccactattaatttacatttaaaaacttttgtttctacaattgagatccagtaaaatgttcaaaattctaaaagaaaggggagcaaatctcctttaccttcaataccataattcatgaaggttccaacagttactcctcgtgaatatttgaagaaaagtaagatatctacaaaggcttaggatgtctgaaggcagcctgcctatccttttcattttaaataaaactgatcaaacatggattattgctccaaaatatgctggaatttccaattctctcaaagctattaggagcatgaactctaagttttagtttcataggagtagggagtggattctgggagttacagttttgtttttgggtgaccaatttctgcaaactgaagttaaggaaagatactggctgtcatccaaaaccaatcttcttacaatttcatcattttaggacaagcagtagatccttcacactgcatggaacaaaatcaatagaagccaagaacaacaggcattgctctttcaagaccatttcatcagcatttagcagaagcaaacacaatgaggtatctataagctgcaagaataacaacattttcactttgttattcactgtgctctaacctgaaccccatcttcttgttccaaatgccatttcaatacttgaaattgctataactggtaaaatcacaaacacatttgtgaatttctatttgcttaaataagctgagtgtgtgacctttctctgtctcaggttcagataatcttcattaatagactattttctttttgcaaatattgttttaacccatctgaggctcaatgtcccttccctagaaataccaactaatggttctgtttccaccatgggatgtttaggttagacagtcagtgcacagggaaaattaacacagcctccacctgatgcagaccatgttaatttctgcccgcaccgctttgtgccgaatgcaccagtgcgccttggcaacagctctgggccccggagaggcaccttttctaaatgtatctggttactcttcatcatcgtggcatcctggaaaggcagagcatcagtctgcagaataaaaagaagccacttaccagatgcataaaaaaggaatatctttagtattcagaaaatgacactctgtttataggctgctttaaaaacaaacaaaaacttttgttgatacatattttacatattttcagagcacatgtgatattttgctacatgtatagaatgtgtaatgatcaagttagggtgtttggggtattcatcaccttgggtatttatcatttctatgtgttgggaacatttcaagtcctctcttctagctgctctgaaatatacaacacattgtcactaactacagtcaccctaccctgctaccaaatattagaacttacatcttctaactgtatgtttgtactcattgaccaaactctctttatctgttcccctccaacccctgccacccacacatccttcccactctctggcatctatcgttctactctttactgccacaagggtaagttttttagctcacacatatcagtgacaacatgtggaatttatctttctgtgcctgggttatataatgacctccagttccatacatgtggctgcaaataatatgatttcattctttcattatgttttacggccaaataatattccatcatgtatatataccacattttctttatacatttgtccaccgatgaacagttaggttgattccataattcactttcctattgtgaatactgctgcaataaacatgcaagtgcaggtatgcctttgaaatactaatttcctttcctttggatagatgcccaatagtagaattgatggacagtatgacagttctatttttagttttctaagaaatatccatactgttttccataagtggttgtattaattcaccttcccacaaccagtgtacaagagttccctttcctctatatccttgccaacatctgctattttttgcctttttaatgataaccattctaactggggtaagatgatatatcatccttgtattgatttacatttccctgacacttagtgatcttgagcatcttttcaaatacctgttggccacttgcatggctttggagaattgtccatttatgggctttgcctacttttcaatgggattttttttattgttgagctatttgagtaccctgcacattttggatatcagtccattgttggatgaatagtttgcaaatatttttttccgctcaataggttgtttcttcattcttttgactgtttcctttgctgtgcagatgctttttagtttaatatagtgccatttgtctatttttgttttagttctctgtgctttgagatcttaaccataaaatctttgtctagaacaacatccttaagtgttttccctatgttttattctagtagttttacagctttgggtcttacgtttaagtcttttaaaaaattaattatttatttttaacaaaggtagggtctcactatgttgccaaggtgggtcttgaactcctggcctcaagaaattctcctgattcagcctctcaaagtgctgggattacaagcatgagccaccatgcctgaccacatttaagtcttcctatactgggagaaagtcaggtccagtttcattcttctgcatgtggatatccaattttccccagaaccatttattgaagagggtgtactttccctaacgtatgctcttggtgtctttgtcaaaaatcagttgttataagtatgtagatttatttctgggttctctattctgttccactgttctatataactttttatagctatatgatgatattttgattactatagtcttgaaatatattttgaggtcagagagtgtgatgcttccagctttattccttttgctcaggatttctttggctgttctctttggttccataacaacattagaattattttttctatttctgtgagaaatgacattgctattttgatagggactgcactgatatagtagatgcctttgagcagtattgtcatgttaatgctataaattttttttttttacaggaaagtggattttttaaattatactttaagttttagggtacatgtgcacaatgtgcaggtttgttacatatgtatacatgtgccatgttggtgtgctgcacccgttaactcgtcatttaacattaggcatacctcctaatgctatccctccccacaacaggccctggtgtgtgatgttcctcttcctgtgtccaagtgttctcattgttcaattcccacctatgagtgagaacacgcgatgtttggtttttgtccttgcgaaagtttgctgagaatgatggtttccatcttcatccatgttcctacaaaggacatgaactcatcattttttatggctacatagttttccatggtgtatatgtgccacattttcttaatccagtctatcattgttggacatttgggttggttccaagtctttgctattgtgaatagtgctgcaataaacatacgtgtgcatgtgtctttatagcagcatgatttataattctttgggtatatacccagtaatgggatggctgggtcaaatggtatttctaattctagatccctgagggatcgccacactgacttccacaatggttgaactagttcacagtcccaccaacagtgtaaaagtgttcctatttctccacatcctctccagcacctgttgtttcctgactttttaatgattgccattctaactggtgtgagatggtatctcactgtggttttgatttgcatttctctgatggccagtgatgatgagcattttttcatgtgtcttttggctgcataaatgtcttcttttgagaagtgtctgttcatatccttcgcccacttgttgatggggttgttttttcttctaaatttgtctgagttctttgtagattctggatattagccctttgtcagatgcgtagattgcaaaaattttctcccattctgtaggttgcctgttcactctgatggtagtttcttttgctgtgcagaagctctttagattaattagatcccatacaaatggaagaactttccatgctcatgggtaggaagaatcaatatcgtgaaaatggccatactgcccaaggtaatttatagattcaatgccatccccatcaagctaccaatgactttcttcacagaattggaaaaaaactactttaaagttcatatggaaccaaaagagagcccacattgccaagccaatcctaagccaaaagaataatgctggaggcatcacgctacctgacttcaaactgtactacaaggctacagtaaccaaaacagcatggtactggtaccaaaacagagatatagaccaatggaacagaacagagccctcagaaataatgccacatatctacaactatctgatctttgacaaacctgacaaaaataagcaatggggaaaggattccctatttaataaatggtgctgggaaaactggctagctgtatgtagaaagctgaaactggatcccttccttacaccttatacaaaaattaattcaagatggattaaagacttaaatgttagacctaaagccataaaaaccctagaagaaaacctaggcaataccattcaggacatacgcatgggcaaggacttcatgtctaaaacaccaaaagcaatggcaacaaaagccaaaattgacaaatgctataaattcttttgattcatgagcatgggatatcttttcatttgtttgtcttctatttcgttcatccatcttttgtagtttgctttgtcgaaatctttacctccttggttaaatttattcctatgtttttttaatagctagtgtaaatagaattgccttcttgatatctttggtggctatttcattatacttgtataggaacactactgatttttacatgttcattttgtattctgcaacttggctgaatttgtttatcagttctaagagttttttgtggtagtcttgtttttttctaataagatcacgtcatctcaaaggtaaacagtctgacttcctttctaccaatttaaatgcattttattttttaatcttgtgtgatttgctaggatttccagtgccatgtagaataggagtggtgaaaatgggcatcctggtattgtttctgttcctaaagcaaagactttcaacttttccccattcagtatgatgttagctgtgagtttgccatatatgtcctttatgattttgaggtatgtttcttctatgccatatttgctgagagttttttatcatgaagggatgctgaattttatcaaatgctttttctacaactattgagatgatcgtatgttttttatcattcattctgcttacgtgatgtatcacatttgttaatttgcatatgttgaaccatccttgtagccctggtataaagcccacttgattgtggtgtattatcttttcaatgtgcagtaggaatcagtttgccagtattctgtcgaggatttttgaatccatattcatcaagaataatgacctgtacttttctttttttgtgtgtccttgtctggttttggtataagggtgatgctgccctcatagaatgagttagggagaattcctttctcttcaattttttggaatagtttcaagaggattagtatcagttcttctttatacatatggtagaattcggccaagaatcaatctgctcctagccctttctttgctgagagactttttattactgatatgactttgttactggttattggtttgttcaggctttctgttttttccagattcaagcttggtagatggtaggtgtccaggaaattatccatttcctctagattttccagtctgttagtgtgtagctgttcatgatagtctctgatgaacctttgtatttctgtggtatcagatgtaatttcttttttatttctgatttatgtgggtcatctctccttttcttggttagtcaagctagtgatttatcaattttgtgtcttttcaaagaatcaacttttcgtttaactgatcctttgaactgttactttagtctctattttgcttatctctgccctgatctacattatttctttctttctcctaatcttggatttgttttgttcttgcttttctagtttcttgaggtgcatcattagattgtttatttaaactctactgttttgatgtgggcatttattgctataaacttcatgttagtactgcttttgctgtatcccacaggttttggtatgttgtgtttccactttcattcgtttcaagaaattttttaacttccttcttaatttcttaattgatctaatcgtcattcaggaacatgttgtttaattccatacatccgtatagtttccaaagatcctcttgatatttctagttttattccattgtgttctgaggacatagttgatatgatcttgcgttttaaaaaattgttgttacctattttgtggcctaacagtctattctggagaatattccatgtgctgatgagaagactttatattctgtagtttttggataaaatgttctgtaaatatctgttgagtccaggtagtctaaaatccagtttaaataaaagtttataaatgtttgttaactttctgtctaaatgatttgtctcatgctgagaatggggttggagttccccactattattgtattgtagtctctctccttaaatctagtaatatttatcctatgaatcttgttgctccagtgttggacacatatatatttagagccataatattctgttgctgaattgattcctttgtcattgcataatgaccttgtcttttttttttttttttttttttttttactgtgtttgacttaaagtctgttttatctgacataagtatagctactcctactcacttttggtttctgttcgtgtggagtaattttttccattcctttatttttagtctacatgtgccattataggtaaagtgtgtttcttgcaggtaatatatagctggatcttaatttttaatccattctgccaggctgtagcttctaagtggaaaattcaatccttccacattcaagattattattaacatgtgaggttttgttcctattatattgttattgttttctggttttatatactcttcattcctttctttttcacttattttttctaattttggtttggtggttttccgtacaggtaccatttaattactttcccttattcctttgtgtgattgctttattagcaggttttacacattcataagttttcatgatggtaaatgtagtcattttgctcccaggattaggactcccttaagcaatttctggggaagactttatttctccttcagttacaaagaatatttttgctagatatagtatcccttggatagcatttttttcattcagtactttgaatgtatcattctttcctggcttgtaaggtttctgctgagaaattcactattagcctgataaggttttctttacaactgactaggcacttttctcttgcctttttcagaattctgtctttgactttagatagtttgactataatgtgccaaggagaagactttcttgcattgtatatgtttgcggatcttggagcctcctgtttctggatatctaaatcatttgatagatttgggaagttttcatctattatttaataacaaaaaaatagatgagttttccaatccttttgttctctgtcttctgggacccaaatgattcaaatatgtggtggctttatagtatcccatatgtctcgaaggcttcaattattcttttttattcttttaacattatttctgtctgattaggttattttgaaagacctgtcttctgtctttgagttgtcagattccttcttctgcttaatctagactattgttgaatctaacattttttatttcattcaatgaattcttcagtttcaggatttctgtatggttcttttttatgataactatctctttggcaaatttttcattcatatcctgcactgtttttctgatttctatgtattatttttcataattccctggtatctcactgagcttcttcacaatcaagaatgtgaattatttgttcaggatttcgtgaatttctttttgatcggaatcattgctgaagaattattgtgttcccctggagatgtcatatttccttgctttttgatgtttcctgcatccttatgttgctacttgggcatctggtgtcagtcactgccttcaattttttgaatttactttaacaggggagggcattgttttgaacatgtatctatggtgttggttgggtagggcactttagctatgattctagatgtatgcagtagtgtagtctctgtaagatttcttcagctgtacacagcaccagttatctgtgatttcctcagtagcttatggtgcagttattagtggaggctgtggtaacgttttgctagggcctggggtggcaggtaagtcagtcttcaggccccatgatagcagcagtgggttgagcatgcatttccttgggccccaaggcagtgtacactggcactggtgttacaggtccaagcaggccaattcttggaaagtataaaaatgcgaagattaattctggtgtcatcagagctgaattacaataccattcctgtcacttcctgggtatttcatctcaggtaagttattaggttgaacaacctaatactgctgatattcaactactgtatttgggtgctacaagatcgcaatttcatatggcccaactgaataattatagtagcctcaattttctgtaaaactgagaaaatatcccccaacttaacaaggccattgtatgggctcatacaatagtctcacaaaaactctttaaatatttttatcaaaggtttgttttaaaatgtgttagtaaacgtaaaatgtcagattcttagtgagaaacccatgttctatattttaaacttttgaaagatgaaaaagatatggtaaaatcagcacttctgtggtggaaaaaaaaacaaaacaaaacaatcaggacagaaaaatatgccctaggaactccggatggttttctctggctacacacaaagagtctgcacactgctaatggctcagtcccagagggctgctctatgccctctctgtgcagctcagtaggatggctcggccttctttccctgaacacccaacagccttatgaaggaccacacaaagtctttcatcaggacttcccctccggattcctccagacaaccttctgcttgtctgtccacatccctctgctctggaatgtccttgtcctagagcccttccatcacctcatcatttgaacttacattacccagttctgcagcttgctcccctgacctaggctgactttgagggggaaaaaaaaagccaatgtttgcattttagcaataagattaaccacaaccctgaaagtcacaggccacaagccacactctatgctaccacagtgtaccgatttgcttttgtaggcctccttacagtatgggtttgatctggagcccttctctctgttttagagaatattcacaatgaaaaattcagcgtaggtgaatgacccatcatttctgttctaatgaggtctttggaattccagaatagatatgtttattgctgagatctcccctctccctctctcaagcaaaaagatatcaacgaaggtggcctctcaattaccacccacttcaaaactgtctgacttccaggagcgtgtaagcaagcagaatgtggtgtaacaaacccaatgcccagctcaatctcaccactgccaaaaagttcaggcgatttagccacaataggaaataccctcattgttcttacatgatggaacactatttctacgttcatcccagctatacaaacaattatatgcatagtaataacattcaagatgaagaaagtaatgagataaaagacacatgatacgtgttccctactttacacacacgtgtgcgcacacacacacaaacacacactcaaacaaaatccatggacttttcaagaacccatcagctgatgacatttaccacagggctcactggtcattccctcgatgcacttcaagtattttcttttagtaatcaggaaagtaaggcagcacaaagaatgaggtactgcgacagggagacagtcaacagaaggagacaaaaagagaagagtgtcactgctgctggccaggccagcggcccagggccccacatatcccacagcagtctatctggcaggtcccctcataaaattgcaggcatgggctcctatcatgtcccctccatgttacaatgaggattacagctcaacattgctaaaaactcaaagtgcatttctttgatcaaaaataacaaaattaaatcctaaatctcacttataaatcctaacactgaaagagctgtctgagagcatctaaaacagtgtttttcaaactgaaagtaatggttatgggtcacaaaatcaatttagttaatgacacttttaaaaaataaagaaatattgcacactgtaagaacatatactggtttgtaaaatttctgttttcaacatgtgtctgtgctataatgttttataaaacatatttcttactgtgggttgcactcatttaaacaaaagccttcaaaatatttatctaattcaatatcctcactggatgacaaaaccgaaccccaaagtgggtaaaggtggttaaagtaagttacacaccttggtactgacaaggattcaaacctattcattcttcatcacaagatgtctttttaagaaaaaccacaatcccatttctacaattcttaaaagtcccactaaacatcatcatttataaaacacagaagcaggtatctgcaaatttttcagagaattgagtataaacaacttaaacaatttctccaagtcacttggcaaatgtaggttctcagggtaaaatcagacagtgggattagaaacacggcactgtggcttttaatcaatacaagattagatacctttaacactttagcacgatgtcgagcacttagtaaacgctagtatcttccttaatcatacttcctgcactttcacatccatacagcttgagcctggatggagcccagaccatccaacaacagcaaatcttccatctaatccagctacccaaccatagtattaccattattaagtaatctgcaactcgtcaagtatctaaggcagccccaagaaaacacaaaaaccataaatacatcctgacttactctaatgggttgtaaaattaaatgaagtggacagaaaaacaagattcaaaacaaccacttaagaaggaaaaatcaaatcattcaaatgaaaatgccacactgaatacagaatacagacacctcttctgatattttggttaattctaactactttgaaagattgacccaaacatcttctagataatcaagagttgaaggttatgcctataccctcagaaagctaattttgccttcattttacaatcaagtctctgatttctcacaaaccttcatgcaatttgagtcttaatataactacagcttattgggtaagtccatcatcaactaatctgcaaattatggtatatttatcatttgctattgatatcctatatcctgacagatatactcaagtggaggtttatttctaacaaaatattccagttaattggggggtattacaatggcccacattaacagaaattattcaacttgaataagaagaaacagctaaagctaaaatatataatatttaagttataataaatcataaatcagtcaaattatatgtctcaaggacagttctgggcagagaaaaccaaattaacaaatacttaatcaaatgccctctatatgcaaaataccgtgctacactttatattttaggtaaatgcaagtaacttactttcctggctaaagtcttgggtcagattataaaaattacaattgattacataaaacttaattaaccttttccttcctcctcatagatactcttcatatcaatttatgtatttccaagtactatacctataatgtagaggcatctgcgtttgagaggtttgagggagaaaagagattttaaaaatcatataaactttaaaaacaaatgaacaagtggccaccccataaacataccctttttcatcaagtggttggactcacatttgacaagctgcttatttgttcaagtagcagatgatgatcaaactttccaatctctaaaatagctcccagattctagattactcaattacccttcatttcacagcaagcagctctaataaaataatctaaataaaactctttttttttcttttttttgagacggagtcttgctctgtcacccaggctggagtgcagtggcgcgatcttgactcactgcaagctccgcctcccgggttcacaccattctcctgcctcagcctcccgtgtagctgggactacaggcgcccgccaccacgcccggctaattttttgtatttttaaatagagatggggtttcaccgtgttagccaggatggtctcgatctcctgaccttgtgatccgcccgcctcagcttcccaaagtgctgggattacaggtgtgagccaccatgcccggcctaaataaaactctttaattcaacttctcaaaagtaaaagagtgggtttacatataatttgagcaaaccagagaggactatccccttcatcagaaactttctgacactattaaagtgaaagaaccagtcttgcaattagttacataaaaccacaaccaaattcagaagtcagtaccaaatttagcaaccctatcatttttcaaggttgtaccagtttttactagacaaagcaaatgaagcctaggaaaatacctgaacatgttcacatttagaaaagtctactcttctacagtcctatttaaccaatgtcatgagatccttaagtttatgaaagtattttctcttccatgaaagaagcaaaaaaaaaaattatttttcttagcttagaaatctttaaggcaaacccaggtccactctcgtgaccttatcttttttattcctttctttctccctaggtatctgtaacatggttattttcattattttctcacttatttttttcttgtgaatcacctgtggctttttagtatagcaaatatgttaggctaaataaaaaaatcgggtttcttttctcactaagtaaataactctgattataatatttcatcttgaattaacattattcttaattgtctgtgcaccttaccttacacatttagcagtcatatgcacttccttccagtttctctgacttttttgcacatcagtctcctcggaagagaaaaatctaactatttttttttaaacagggtctcactctgtcatccaggctggagtgcagtgtcactatctcagctcactgtagcctcaacattttgggctcaagtgatcctctcacttcagcctccaagtaactgggactacaggcgctcaccaccacaccggctaatttttgtattttttgtagaaacagggtctcactatgtttcccaggctggtctcaaactcctgagcttaagcaatccacctgcctcggcttcccaaagtgctggattacaggcgtgagtcaccacacctggccaaccatgaaatgtagacattactaaagtcaggcatacctgaactctctagtcattcattaatccaggctctcctgtcattcattaattctgtggccttaagatataaaaattctctgagcttattttctgaataaaatgagggatacaatacagattacatcaaattattaaataaactaaagtgtggacacaactcttcacagagagtgtggcacaggtgaggaaacaatggtcatgctggggttgctctcactcactggttttgattgtttgctccacatgaaaacacactgtctcaaaaacacacctgattttcttccagacatgacatgtagaacacccccactagccatgactctaaatcaatctctgtggtaccattcacccagcaattgtgcctcctgaggcagtaactatctatgtgcactgacctagaggctggcagtttcaatgaaaccctgcctcccctttcttcttttcatccctctactagaagcaacacttttgtgctaacacacaagtcaaagacattgatcttacacaatagaaaattgtggctcacacacctagaattcccatcattctaatacgatacagagagctactctgttaaaatccagacctttcaaggcacactggccaggcagcatctccacttaaatcagaagggaacagccaaccatgagtaaccagcatgctgctgctcctccccaaagctgccgttctgcagctgactcggggacttcgaaacaacttcagtagtgacaaaggctgctcccagcttttacatacttttcaattcatataatagacatttcacagaaagttgctgatagattttcttctgcctgtgcacatcagttaaatgtgttttatttcccttctgggctacgtgctggcagagaataacacaatgaagaggtgatagtatgcctttccaggccctttatggccaagattatgaaagaagggctttgacgaagaatgttcaggccgactataatagttttccttttagtgtattattgttgccatgtgtttgctgctgtctggagcaataaaaaagctctgaaatatttgtctgtgtcctccatagacccaagagtttccataagagaaatcacttggaaaatcacaatattgctccaaataaaatattaacataaaaaacttgttgaaatgttgagctaaaatactaaagaattatgaccacagctgtaatttatgaggatatgagtgccttcacctcctaagggcctttccactcccaccacaggcacatgtttggtattgttctcacacaacatagatgccaccaaccagaacgaattgctttggggatcctcagaagttctgacaggatagattagatggacaaggaaagctgtcatgattcatttcttgattagatggacacttagtaaaccaatagtcagttcttacaattttatttgaagaaatgatgattacttcttttgtatatgaaaatactttttctttcttcctgtcatcctaaatgtagatttatttacttaagttgaaaaatttggcctcaaaatgtaacaaattaattagtgataataatctatcagaaaggaagtgagcccaacatcagtaacatcaataatctttgagtattcatgaattctctctgaactcaatcttaacagaaatattctcattaagaaaatctctaacagaagagacaatttgcactcaggcccacaatttcatcttcactattcaaatttaaggacagatttctgtgtttattctcagtacccagaaaaagtaggcactcaatgactgctgtggtaagtaaacttcatgttttagcacttagccacacgcaattttagtattgcttgaatgttgttcacttgcttatgaacctgaaaaataagtcttggacgtttagttatcccaagacctaacacagtgtgcctatttgctctcaaatattatcaacatcaaagaagtttttagtttgccagaatgttagattgagtgaagtccctataatcaaggtagattatctgcattgcccaagttttgtgtcctcagatttttatagacattattgcgcatcttctgttgacattttgtttatgccaagtaggatctttgtttttcctaacctaaaagggctgaaagagaagcttttgacttaacaattaattcagcatttacttattttatttgtctacaaagtaatatgctcatatgctggagtggaggaaagaaaggtggctagaaaggttaaaatgagatgtagaaagtaaaaaaaaaaaatgctgtgatatagagtacagattttacaaacaagaatgttatggaagaaaacagtcagtgttttgctgagattacaaagcttaattagtgatagcggagatcagaaaaaaaatgcaatcaagagcagagtgtgggggatatgggaggtattcagctaatgcttccagaaatgatctaagtgattcgtttgcaaaaagaaaggctagctagacattaacttgtctgtaaaatggtaataataggaatctgctttgcctgtatcataggattggtataaagacaaaaagagataatacgtggaaagacctgcaaactataatgaaccaccagtgaatgcaggttcctcctatcaacctcatcttgcctgataactcacacattcttccagtctcgaaattccttaagtctttgggttgtacaaaataaatagtttcctgatctctcttttttattgagatagaaattttctatgcatactttacttaaaatgaatgacattgttactggctctgtaaattagagaacactggttctttctgatcacaatcttgatcctagagatgaaatactccacctggcaagagaggaaaatccaggcctcatgtcatgccctaagcatggtttatgttggcaccactctttccctatatcccaccaccaagagagctgaagctcagataagatgcataactcaatgggtattggggatacactgagaaactgagagcacaaaggacaatccacagtgtgacaacaagcatgtcagagctggtccttgtccctttatccttgatagaggcaacatgtgccaagggaggcaggtgactgaacagttttatctgttctctctttagtcattaattcatccagtgaacatttattgggcagctattatgtgtaaatcactacacgaaaagccaatggtaatactaaaacaaaacaaaaaaaactaatttctcaaacagcgtatagattcatttaaaatactgttatccagtatggaaatgaatgtcatgaataaatggtgctcaatcattcccccagcttccaatactttttagttcttttatctggggccagattacaaggaaatcaaaagtcatgctcaggaattttcacagagaaactactgaaggattgtgagaagagacttaattagcctgaacctgatttactattgaatttaggaagaaaaaataaaattaaagtcaactaaaaggttctaacaatagactatttgtgagatgacaaggaaggacttaaccagagcaacagaaccgagaacaaaataaaataaatgcttcaagaggccacaaagtagaggatgattttcaatgcaaataaaacagctacaaaagttgaagaagggagaatagataataagaaagaaaagagaagcagaaggaaaaagagaagcagcacccaaagtaaaagagaaaaggagatgtaagaggagaggtctcatcagactttttccttgagtgcctggttattttttactatgtgttgttcactgcttttgaaaacttattcttgggtcttatttgtggtaacttcctccagagagaaattctgttggcttgtgtcaggaacctaggacttacacaagttcccaaactcctaaaactaaatcctgagtttaaaatgttctggactacccaagcagtacgtctttggattacagtatgcttgagggtctacttgtggttacaccttcttaggaatccccctccactcctgctctgcgtagcacaaaagtacttttcctgtggaacacgctggggccatgtggagagagggtttaggcataattcaccataaatctaagaatgtgaccctttgatttctgtgcctttgatcacataggactgtcaaaatgaagttccagtttgccaaatgggcaaatgtcctcaagatcaaaacagcctaaatttgtagcttacctcctctactttcccacaagtatcagcctgataatggcttaccatgtagttagttcttcaattattttaaggagattttaaagaattttatattctgcattttagttgttttcaatagaagatttgatccaaataatctagcctaccaaattcctggatgtgaaacaaaacaataaattcaaatctctacacaaaaagtgttgtggtcagccatggaaatacctggtcccaaatccgatggtaaagagtaggaaacatgtataagaaattcctatacttcggaaagaaatcagtatctgaaaaactgaggttaacaagtttatctgacgatagttataaacacatttatacaccactaaaaactgttattaggccatcaaccaacagtacatagaaaatactcacaatgatgtatattctaagtatcaacaaatctcttacattttcaaagcaaaattcaacctgaataaacagaaatagattttttaaactcttaagcttataaaacgacctgtttaaaattgctttctaggattccaatcataagctagaacaacaacgacaaatccttgtttctcaatcttaattacagtggaataaaaaccaaaagtttttggaatggtgctatgttttatactgatactcttactgtgtctatagtggcattaaataatttgaacgactcttctgcaactgaagtggaatatatgctttagagtattgaagaaggatttagctgaagtttcgagtctcatcacttattagttcaaactatcagcataacagaactaaaaagaaaaatgacactatattcattatgtgatttaagcataaaacactgccatgataaatatttggaaattccaagcttttataaaagcacactttatgtactgtatcagcattcatccctttagggtgtacactgtggactgcctcgtggggggagtttatctcatttcattttcattctacattccacttttgagttgccaactaaattgcttcttggtttatagtatggaagacttcataatgtttagttggaattgcttacttttaaagtacgctgatagaaaacccagtgtggtttgaaatatcctcaccagatgtttggatagatgtgaaaccaacacatatcaaaaggagatccaaactaccattagctgtataatacataggctcatacatttaacaacttcaatggatcaaaacacattaaaactcttcaggggaaatgaacttagttcttccattttccattactaggaactcaaattctatccatcctctttggactatcaggatctcaataaatgttaagtgataatgagctacaaggacagtgtaagtaatttaatgtgactggacaatggaacagtttgatacggtcaccaatacagactcatacttttagtctgaaaaacataagtttagtcactagaacaaagaaaatgacagtcttatttctttccaaaccagtcaggccacacctagtataagatgcttaattctgagcattataccttaagaaggataaagacaagtgggatgtgcttggcagataagaatcaggaggctggcacaacagctcacgcctataagggagggcaaggtgggaggataactggagcccaaggaattcacaaccagcctggacatctctgcaaagaaaaaaattttttttttaattagccaggtatagtgatgcacagctgtggtcccagctactcgggagactgaggtgggaggatcctttgagcctgagaagctgagtgagctgttatggcaccactgcactccaacctgggcgacagagcaagaccctatctcagaaaaaggaaaaaaaaaatcaggagagttacagaccatgaatctacataacaaaaagagcaactacaaggatagggctatatgacctggtttgggccaggactcagggaagagtggattcatgggaacaaccctttctaaatattaaaaatagaaatatacaaaaacaatgaattttacatggattcccaaggaaagaaattagaaataatatgtgtaaaataagctatggagagagactttcaactagagttgtttgtggatggaatgaactgctacgaccggttagtagtagtgaactaaactactccttcagggtatacttgttaatccacactaagtatccatgcaccatcacacaatcttgcctaagctgtgctgttccctgaaccagtccccttctgtgactacctggcaaaatataacttcaatcattctactcacacattgccctttctacaattttccctgacatcactctttcccctaaaccttcccatccttagaattaatcatcacctcatcccagcttatgcagcactttttgtgttttctattacagtatatacctacactaaagtataacaaaacatatagactattgtaattatattcttggtaaatgtgttgtgtctggcataattttagcgcatttattgtacgtaacagatttgtttggaaatgtagataatatacaaataatagatgcagagtcaacctagatgactttaagacactgagattctatggtactagaaaatgtagagacacgtttaaggacttttagcagtgaacacagaagattctctaacaccgacatgcctaaaaaagtgctacacatgtacccttaaacagaactagaaagactcagaatccagtacatttcttccaacagtaaaaacaaaaaattcatgcaaaaactccataggtataagttggacattttagatatccaaaaaacaacctttaattgaatagcaatataaatgatattctaaataaaacagaatgatagatacagaaagataataggaggttgtcaagaaatatgaaggagtatgtgtattcagccagtagttaccagattacaaatccataaaacaaaaattattcattatcctctttttctgggctctattttgaacttactcattgacatatgccaaaactataaaagtaagacaaagcaggaaacctatagtctcaccaccaagtcaaatatttccattgtgaccagtctttccacgtccaactacacggactgtgaattaagtccaaacatatttaccttaagccattcttattgagttttgagaaatctctacttttaaagaaaaacaggtctacaagaccatgaaacattatttctcatatttaaaagaagcagcgaaaacacttgaaaaaacacaaataagtacaaataagccaaaaacctttgttttttgcattatgcattctgtttctcgtaaaagatgaatgatgagaaaacaaaaatataaatttgactttaaaagaaacattcagggtgtttcaaatgatcagcaaagattcaacttaatcccctaaaaaactagtaatagttgttaatgactgcaatagtaccaattatagataaccagggagaggatccaaacaaatgagaaaaatgcataagatagcattttaattataatgctcaatataaatatgaggttaaaaatcattattctgcattattcttcaaggtgaaagactcatacaattacacagccaatgaaatgttgcttattgcaaaaagaagatgatcttataaaaattaaattctaaaaaagatacaaattaaatgcatatcatgactgtgtgtatgtcagaaatatctgataacagactagaaagaaaagcagcaaaaaaaaaaagaaaaaaacataggtctggtgttaagattttaggtaactttttttggttttccaaatttgtgctaatattatgtcacttttgtattattaaaatttcatttgaaatttgttaggaagacctggaaaacagtgcttatggtgggagacagatttctcaagaaacaatcctgtgataatttcccaacaatcttgaagcctcaatgaagttcttcatgacatccagttattcatgactggataatgaaatgtgggcctttgtgcggaaacagggagattctcaactggctaaatgaccactcccaagggagctgaagaccaatgtcgataagattctactggacacaagagctctcttcacaagactgtcctgtgcactacatgtgacagtgaggcagacacacactgagaaacatgttgcacacgttagaaagtactagaaatgattacaattagacactgtataacagactaagattttttgtttaatttgtatagactagaaaaatttgagctagatctacaagattgcaacttaacaaagataaatctaaagtcctctactaggtccaaatattaactgtataagtggggcacaaggaaatatagctaagagaccaaatatctgaggaaaacacaggcattttaattgtcactcaacagcatggcatgactgccaataaagcaaatacaattctagactgctgaaaagagaagacggtcgtgccatgtaccgtgttcagtaccacattctataaggacagtcatgacctaagtacttggaaaaaacggagcagatttaagaataacattcacattttaaaggagaacttacctaagaagtgggtaggcatatttggtgcagtttaggggttgaggggagttagaatcaatggtacagagactggaaagaagcagatttgggttcaatataaggaagacttttctcaccagaaagcagcccaaatacagatcaggctcctagcaaaggcagtcatacggaagcacacattaactcttacatgtggtcagggaagctacagaaaagacccctgcactatataaaagataagcatagacacctgcaaaatctcttccagctgctacatttcttgatgtgttaaaccaacggaggcacagtatgggaagcacaactataccaacactgaaaatgaaatgattctctatgaaattttctcactaagaatcaaatgaatggttattttctctagaaactgtggagcagatgccacactcccccaaaacactaaacacgtgcacccaggtttacaatatagcacagaatgccgtacatattctcatattctattatccccaaaatcaggtggtaccttacaatcgcagtcggccaggttgcagtggtgtagttgtccttgcctgatcacgtgcacacctgatcatcactgttaatgccagttacttgagttaaatagtgcatgcttcaggtattacacatcttaagcttaatgacactatagttcagtaataaaaagttaaacatagaaagtaactaaaatactcagtggggcacaaactcgtattaacttaagaacatctgccacttgacggatgtctacaattctgtattttcctgcaaagtaatcaattcattttgctatttgttttagacatatacacaagagtaaaatgatacaaatccatgtctcaataaatctaaataagcttatcaataagtataaaatattaagaatctcagtggtgagaaagagttgagtcatagtttaatcagaagagcttgtgctttcctaatggtacataaaataatgatgcatctgaaaatcggtgttgcagaatcagtgaaatacagagtgtttcttgcaaatgtgatgtagatttcatagacagagcactttatttttaatctctctttaatatacgggaatcttagaattgcagagttggatgaaaccttggaagtcatttgaacataaactcaatctagcatataaaccctttcaatgatatatctaatgtgctggatgacaacttttaaagaagctgaaagacatccaccaattgtggaaagtatgctatccaaaagaagaattctcaagtcccctcaaaaaagggggagagaggtttgacctcaatgaaatttaagatttacgttctgtgaaggacatcacagatagagcaagcatagaagtgacaactggaagaatatatctgcaacatatatacctgataaaaagttaataggaattcctacaaattagcaataaaaactgaatggacaaaggataggaagaggcatttgacagaaagaaacgccagaatttctaaatctataaagtgagttcaaccccattattaattagaggtacagctatgacattatataactctcctccagtttgcagagtaaaagggtagatcttaattttaatgatgtgaaacagaaagtttattaaaaagaggcgtgaaatgaaagaagtaaatatccatgtgatttgttgttatacatccagtgtcttaaagcagggacctgtacagagaaataaactatattttatgatttccaagtaaaaacatatatatttaatttgtttttattactagaatttgtttttgtttcagaaaacaacatatttacaaacttgaacactgtttaagcacaacctagtcagggaaacattcaccgtgtctatttcagaaataagacactttatgttaactaatgtagtggaaaggactacattaatgatttgccattttaaggagcatgacaagctaagtaacagctgtcagtaggtcaaacacaattcaatcggcatagttagttccaaaaaacatttaaataggttctttagctgggaagtccacatattactcagtaattctaggactaatcaaaagcaaatagaaaaaaacaattctcactagcttggggtcagtgaaaacctatttgacctatgccaaaaagggaggttctccattcaaacagatggataaaagctccaagtacagttatctcactaaaattccaaacaagtcacaatgaacacatgactttatattttagttgtgtgtacgtatattacatgtatgtgtacacagacacatctagagactaattaagttagtgactgtaaattttatatataaaaatgcccatatatttaagagtcaaagaatagttgtcttttttatatagtcactaaagacagatatataatatgtatatatactaacagacaatgtgaattcaacaggtatcattttaatgatatcatgctgtacaaaaatataaagaaaatatatttgaaaagaaaaaaaaagtttgcaaattccaggtaataaatgaaaaaatgaattacaagaacacccagaaacccaatggaagctgttacagatcactgaatttttggaatctaaaaactctgtagttttatattttattattgtagataattgtatacacaagcccccacagaataatgccttgtctgttgttcttgagagagagtagaacagatggctctagtcaaagcccctcggcgactgagcattatcacctatctagggaaggagatggtggtgcgggggtggctaaaaggaggatgaaggcttctgggaagagaaagagggtgcagcttaagtagaaaatggacagctaaaacgacgaggggtgaaactgaatgtaaattatgcctggctttaaatataagagttttaatattttattagtaataaatccactgttttccccccttaaactgctgtcacacacatgctagtggcccttgacaaatgcctgaaatctttgccatcattattacacaggaaaggctttgaaagaattccaagcaatccatccatgtcatactttgacaaagcaagggagaggccacgggaagaagagctttagctcccagtgaagagttaagaaagtgagcctttactctaggctccagttccgccctaaaacctagctgtttgactgtagaaaagactaggatcttctcgtagcaaggcaattaccagtctacatggttaggatagtgacaaacaaaagaaacatgtcaaataaataaatggttaccattaaatagaatttatttgcaggtactttctaaatttagtacgactataaaaacaaacaaaacaaaacaactttcaaactaccaaagcatgtgaaaacaaactataaagctgtttcaatgctcccttatgttttaagaaaaaaaaaaaaactaaactgggacaataagaaaattacacataatattattattattatttttttgagacgaaatctctttatcgcccaggctggtgtgcagtggcacgatctcggctcgctcactgcaacctccgtctcccaggttcaggtgattctcctgcctcagcctccctgtagctgggattacaggtgcccaccaccacacccggctaatttttatattttagtagagatggtgtttcgccatgttggccaggcaggtctcaaactcctgacctcagtcgatccacctgcctcagcttcccaaagtgctgggattacaggcgtaagccaccgcgcccagccacataaattatttttataattactcttcaaataaggaaaatttagtaataaagaaagtaatctacttgaaatatttttagctatcatagattaacaaggataaacaccaatctaagaatttgtacgtagtttataactttatttagaaacaaaatcttaaatccttatggtaatttcataaaaggtagaaaaagtctaatttttatacgcttagttgagaaacacttaaagcaaaccctgcactgaactgaaaatttccacaagacatataaataaacttataaaagctcggagtaaacctcttaggaatgtcttgattggggttaaactatggctgataataagcttaaaaaaactaacttaggaacaagtttgccaccttgacagtatgaaatgccactaaattgaaaatggaatctggatggctttaaaataattgaatctatgctagctataaatcctggaatcttttacttgggaatccaaggtttaaatacaatgacagttaagatgaaaagttttattattatataagtatttttctttgacttttagaaactctacaaatcaacagaaatcccttattcaagtaaaaaattaacaaaaaaggacgctttgaaaattaaaacttttaactattttttttctgctataggtggaatttgtgctgtgcttgggatactacaatactgtcgcttataaagacacatttttaaaacatttactttttgttctctaagtcatctacgtttaaccactatttttacattataaactctcatttagcatacatttactacagtggccaataatggtctattattatacaaatcaaatatgtgttttaaacttaactacttctccaaacagctacttccccttccccacaaaaaagcatcaattcgttaaatagaaatttctgcaaagttgtacttgagtgaaagtacagtattaagaagcttagttttcataatcacatcctatacagtcaatatagttacggcatgaaataggtttgtttgtatttttccctggtgagcaattttggggcacaacaggttctactgtaattgtctgtaaattataataaataccaaagctaaatgtggaaaattaacactggcacctaaatttatttacatgcctcagaatcatttcatggaagttcatgtatatttatttacctgtaagaaaacaaatcaacttcttcattcagatttctattttatagaaaatattcacatactaattttctctagataagatatccccatattaacagtatgaccaaaagcttatacagcatttaactttaatttatactttctgacaaaatagaatataatgccttttccatcccagaatttccactattctgcattaagtttttaaaaaggtgcaagataactttatataaagttttaaatatttcttgagaaaaaccattatatgctaatatctgacaattgtttctcccaaaaagtatgatttttaaaagaaactgaacttttcatccttaggttttattaacactgatgttttcattagacaggacatgtaatttatattgataagcacaataccacttcaaaaacaaattggacaatcatgaaattttggggttgtaggagatcttggagaacatacagcataactcttacctgtttcccaaagcctcacatcctattttacagatgggaaaactgaggcccagagagactatgtgtcttcctcacaggtttgttttacatgattataaaaattctgacaagattaattcccttaatttcacatgacaaagaaaaagtaccctgtgctagttagaatttagaaggttttatatttcaatataccaatcaaaaatataaatcaatgaggcttaaatcacagaattacaattaaaattgggttaaagaaatgtaaataaattgccaatatagtgaaatcgtcattccatgtgttaaccctatagttatcttttggatttattacaaattcctatgagataaataacttctaagttttcaaaaggtggccacatctgtgttcttctaatgtcctaaacattacaacaattaatatttttatcattacactgatgtttcaataagatacctctatatgcaaccaactattttattttataaagctgtactagaaaggtctaacgtcacaatacaatgtaaataaactacagattattccgtaaaatattttgtatgtggcaacaaacatatgcctttaagtttgactaatacaaatggaagactattaataaaaactaaatgacagcaacaaaatctatatcactgacgagtcaagatagtatacatagcatcagatcatagagctaatgttaaaaaaactcaaacatgtgataggggcactacacaaaatgtcatgtgctaacatctggaattaagattacttacagtggaaaaaataaaacgtccccgaaaagtgaaggcacgcattaaatcttggcactctttttatagttgttttacatatagaaatgtaattcttacaaagaactaatttcactaaaggttacaattgtactagtattttctgtaagaatgcaagaaaatgagtaagattagtcaaaactctgttaacttctatgttattatgaaagatattgcaatttttgtattaaacatttcatgtgcctatgacctgacattactgagattttttttttaaaaagtgagcatttaagtgtcaaaattttactgaaaagtttttactgaaagtactaatttagtatgtaatttatgttacattataaaaaacagttttttactggctaggaactaaaaatctctgaccagataagggtttaaccgggatgtttctgttgtagttaaaacacatcttttcccaagtgatagaacttgggaaagttcttaggaaattctttcataagtagcatggtaaaaaaacactaaaaaaacaaaaaacaaaaaaaagagagaaaataaaaaatgaaatttcagtaaagcttttcagaagaaaaaacacaagaaaaagggacaaactaatatttcacacattggaaatccagtaactgctttatggattagtctctggatcctgtgccaacaaagttgcaccaccaagaatcatcatcatgtaagatggttcaacctgataagtggaatccccagttagaaactgagagaaagagaaaagaatctcccacgaaatgagagaaagtatatcaaatctatctgaaaccattcctcaagaaagacgaaatatgagcaatacatttatgaacttatgtgtttatctaaaataaagacacaaactgtgggggaaaaaaggcaattaaatttagcgccaaaattgaactttagggcatttatattacacaaatttttccactaaccattaacacttcattgaaaaacaatggccacatgagaaaacatacttcgtgattacatgcaatcatctatcaatttaaataattttcaaagtatctatatatgtttaaatattttacatcagataaaagaaaggacaatttggacataaaggaaaatctaagtatcataagcacaaaactttggtattttaacctcaaacaacagtgtgcgctctagtttattaatcaacaggaatgctacttaattaaccatgtgaaagttaaagtaagtaagaaagacaaacaaggcaagtattacttaagctattattatactacactggaaatttttcaaatatctaagattttgtaagatgtagtcacgtaaacaaatgtaaagccatcataaattaaaattggttataaaatgccaataaaacattgaagtcccctataattcatacaaaatctgtttttagactttaaaaagggcatcaaaaactataaagtgtatcatttttaaaagcccatttaaaaattataagcaaattgaaaaaaatgttattaattatccaacatttaattattcatgcaaaatatttataaaatattgtcaaggaaaataaatgttctagtgctaatatgaagaaaattaatatgctggtttttaaaaaaagttttaaaacaatattcttcagttagtaagcaacacaaatcacttagatttgcctgcttgagacacgattcttttgaaaccaagcaattgaaggaaatggtgttgcaatactgtccgtttaatgaaaaccgtggcagtgaaaaggtcacataaataatctgcacgatgttattgcattaagaaagtcacagtctaaatctaatgcctgccaaagaggggctaaaagtgtaaaagaaaaagtacgcagtcacctgcaaaacatattatattctgattaaaagctgtttttaaacaaccttttaatctaaaacccatttgctatctcaaaaatgacctataaagaaatgtttatgtaattgtgactaattcaattatcttacaccctggttttaagaaatatatgataatgaaagttcaacttataaaattccatttaattaaattaaaaattcacaaaattgcaagattatgtgtttagacatcagaattttctttgtccttgttttcaaaccgcctacactactaaaaatattagggtaacacagataatatctgtgcatacaaactgaagttaacacagtagactgcttaaaacagaaaaactacatacatatcttctttttctactgatatgacagagtataaccaattaatcattaataagtaacaagcaacagccagaatatgtttaatgcttcattaaaacaacattgaggcccattacagtacacagcgtacgatgctggaaaccaccttataccctcgcaaaccgcattcccttctaacctcatttgggggaagcagctagaggatgaatggcaatatgctctcaagtaagcttttattaagtatgagaaataaattatattaagtgttattttttgaactcagaaatgagggaaggggttgttaagatatcaaatttactaagaaaataattatgtcagaaataacgttgctgtcacaagagagacttgccagatactgcttttaagcacgttgttatacacacctttagaataaattttgtgacccagagattagtctgtggtactaaaattcctgagagtagaccagaaaaaaaatagagggtaggagaaatgttttcctaaacaatgttagcattactctagtggcattaagaagcccttatttcgtttataattagtaagatactgaggtgatgggattgttaaggacatgttacaaattgcttttctacaactcacttccgaatctcagtttctactaaatatgattctacttcattagatcctcatgactgtgatctcaccaaatgcaattctaaaacttgaaaattaccttggaaatttgtgagaagccacagaaaggtcctcggaagcacacacatattaaatattaattataatgatgactgtcatcttttatagtgattatgtcattatttaggaatgttaattaagacataaaatgacttgttaatagcaaatgcattcttaagcaatatatttgtgcttgtgcacttaacagcaaacccagtatggggactgaaccataatagactacagttctattttctaaaatgctgacatttgagcaaacgttcccagggaatgtttgcctgattcgtggactgacatttcctctttgtaacttgcttaactaaagaggagacatgcaggccaaactccacagtgcccgcaggcagcaggctattgcttgccgctgcaacttgtgcgtggtttctcttttacttccctctggccctactgcccctcagcccttcactgtctctttattttgacatgcatattatcttagctgatttcaatcatcttacaggagtggatgacataccttaaaagattaagcttccccacctgggatttgtccagaaattcagtgtattacagcttctcagagccttcttcgttctcctatattcttgtgttatcaatagtagctttctttcttattttatgtttaagtatgagacacaggcagctatgctgatggagtcagtttgtactgtcactcatctttcactacaactgcaaggttcacttcctttgtctaattctttgctgccatctatgtgtataaaagagcacaacattcttaaacacaccagaaacttcctcagtttcaaaaacaatcatgtctctaatctagagggatgaagaaggaagctttagggataatttgcttccctacacaaacgtaaagcttattggaaatttccatttctttctctgtgaagcaaatttataaaactgaaaaatgactgaagttacattatttaacataatattattgaacataaccaatagattttttccattattgctgctgataaattttaatttggcaaatttgatgaacttatgcttgaaaaacaaaagttgaaattttaagtcacttaagtaaataattccaataagataaattaatttttgctaaattgcaatctaaatatcttgccaaatgatagagtgaaatgatcactaaacctaaccgggtgcggtggctcacgcctataatcccagcactttgggaggctgaggcgggcagatcacaaagtcaggagatcgagaccatcctggctaacatggtgaaaccccgtctctaccaaaaacacaaaaaattagccaggtgtggtggcaggcacctgtagtcccagcgactcgggaggctgaggctggagaatggcgtgaacccgggaggcggagcttgcagtgagcggagatcacgccactgcactccagcctgggtgacagagcgagactccgtctcaaaaaaaaaaaaaaaaaaaaaaagaaatgatcactaaaccaaaacactttcctaatatttaatataaagcaaatgcaaagcaaacagatgaaaaaattatttacacacattatgtaaacaaccaataactcaaatattgtgacataataatcgactaacttctgtcaaatattcaaacacttcttctctagggaagatggagaaatgtatcagaccacactaaagagcctctcagcctcccctttaggactgaccatactggctctgaattgtcctaagataagttagtgtcaaacaaacaaatagaaaggcactctagtgtgagccatatgggaatgttacaacaaacaaaaaaaccctgtcccctacaccatgtaacaattaatccatgcactcagggtaaagactggttatttaccatcagtactaataatgtgggttgacagtcttgaagaatgtcctaaaaggtttattttgtcaataccactaatttctaaaagactttactgttatatactaaaaaaataaaaacctggcaccaatgaaatatatggaatgggagtagaaaagaaactcaggaacaggtttttttaccctgatataccaaacagcataagaagtgcgaaactgctgcctcttctctatcagctcccatttagaataactgcataattgctatcaacacaatactcctcttctctggcaaacatttcactttaattatcaacactagaaccgtacacaagttgagctaacctttcagggtgcaacattttctaaagaatcagtctcttaacgataaactgttaacggagctgtaacatgccaaaccaaggcttgatgtgcggtttcttataaataaagcaaatctaaattcgctgtggattacactttaaattaacatttccaaactaggaacatactctgccatttttcaaagagtaaaagtgatacctactaatcactcatcttcgatcttagacatttttcaaaaaatagaaatctgatacattcaaaccattttcatatgatttatttcttgctggcactggtaaggtatccaattaatgatttacagtacaaagtagcagaaaaaattcttacgcattacattttttgaactagaaaagatttcattttattttaccgtactaactttaaggatccaactttaacaaggcaaattttataaactccgccatatgtaaggataaagtagaaatcatatttaatatcaagctttactatgtattttaaaagaggtattaagtctaatttttttaaatatacatacaaattttgggggcgggggagatacattatggtattaaacaaagtatcatttatgtcttcaccttaatttatgtaaattacatactgtaatctaatcaagaatcctggctgggcaaggtggctcatacctgtaatcctagcactttgggaggccaaggcaggtggatcacctgaggtcaggagatggagaccggcctggccaacatggtgaaaccctgtctctactaaaaatacaaaaattagctgagcgtggtggtgggcacctgtaatcacagctactcgggaggctgaggcaggagaattgcttcaactcaggagacagagattgcagtgagccaatatggtgccactgcactccagcctgggcgacagagcgagactctgtctcaaaaaaagaaaaaaaaaaggaaaagttttactcacagtgtatttactaacttactctttacccaccatttttataaatagcatctagaaattaatattgtggtaaatatgttcatttagctatttgtattaattttagcttaatatatataaaataatgttgcaatactaaaataatgctactctggattttatttagtaaacaagccactatttataaacacattaagggtgaaaaacccaacaagcatagctttgtgtggtccactaattaattatgagcaaaattccaaacattattagctgttatcaaaattacaataccacctagctctaataaaacataacaatctgtttgaacagggagaggagaactttcatagagtgttctctctcatataaattcttaatggactataaaggactttttaagtggttttagatttgaattcaattgctcaaatctacaacaggcttccaagaagaatctgagccagatgacacacaggcacccaccaacagcatacactcctgcctaccctgatgaatacaaagtcaaacatgctcaacttcttcctaagaaccatgggaataaactagtcatatttacaatcgtggtgtttattcattataaacctaaacatgaaattataaaatgaaaaaggtttcgtattgcaattttgcgctgtaacaaataaaagtggttacaaactgtattaagttatcacgggggctgtgtccacacaggtgaagggacaacaggactgatcagaaagaaatgggagcttgtagaacaaaaacaaacaaaaccgtaacattacttgaccgtagaggtttgttccatccacatcacctattcacagagattaaaagtatccagtctttgctccaagcacctactcactgtacctgtaagagagctaattcttctagacacaaaaggcactatagtatgcagggatattaggtctaaatgcaaacataccttattaatcctcaggctttcaaagtactcactgctctttaacaagtaaagcattctgctcataaggaatctttattatttgaacattcataatttgctaacaaactagagtgatttatgttgctctgagcacatctaaaaattacataagacaagaaaacaatgagttttaaaactcatataacatcataataaactatatcgattcataaatatactaagcaaaataagttatcttcagagacccaatatgaagttacagtttgtgtatactaatatatggacaaaaatgtattttcagtgctaaagcagaaatatttatttttagatcttagaaaataggttaattcacattatacttatataactgacttgacaatttcatttaaaaataattgtatgaataggaacaagctgctcattctaacaacgtcttcattaagaaattgtagcaaatattatttgcctcccatagcttttagggaagctaacttacaaaccaccatggtgtagatattcaaaattttaaattttatattgaattaaattgtactaccctaaccaaaaagatgattatcattcctgatgagttagtaccgtggatttctgttgtctgtatatattatatatattaattttatgttagtatcactgatgtgctaacattgcacctggcattgttgaatttggggatcttctagctattcaaatactctttcatatggtattaattaaaaccagttccctccagcaaggaaagaacaatgttttaaactcaaactcaaatgcaccaaaacttcatttcaccgtagtaaacagtgggaatgacaagaggtccgatataaagtatcagagtcctgcggtatcttcccctcacagttcaacgatactgcccacctcggtattctcagcttagtagtgtgacaggaagactgagtggcatcatatctgggctggagactaggtagcgtgtggctgcttatgaaccgcacgtccaggtgggcacctgtgaaataagtgcttgagctggctctgtgccaaaatctttgccactttagaattctagagcccatttattaaaaaacaaaggatccaaaacatcactttttcctttagaatacatcataacaagttaacattttggtggcaggaaatacagttatttgaatgaggaagacattcttgcaatcatttcgaacagcagctaaggcaaatgacaggcctcagtcccaggcagaaacagcaaagacggatatgttgactatgtaacctgagcccatccatttctctagataatttgcctcaagttagactgaactgtgagcaggcagcacactgggactgaagtgaaggaggacacacagcggccaatgcatatttcctttcccccatgcccactgcattcactgcttgcctccttcatcaggacttggggtggtgagggtccaatcccaggagagatattattggagacaggatggtcagggggcctcacggagaagctgatgcttaagttcgagtgtagttaagggaatgagacaagtagatatctagggaaaaagagttacagtcaagtccacatacataggcccacaggtagaatcacatcttaaggaaacacagcctaaggcaggtgcttgctgcatggatgagaaaaacagaagcataaaaaggctaagtgccctcttagggtcatgtagtgagcatgtgacgtgaccaggattttaagccacagaaaagtccaagacccagggtctggtgtggacctggatatgaagttttagagtgtgtcccaggaaccgtgatatgcacccctgatttgataaccttgcctggaccatagtttcttgtgagaacattcctctcttctgccccatggcagtcgtctgttccagtagtggacataatgtctccccgctgcatcctctgggcacagggcctgtaaagggccgatggctgtattcacacatgttaacttactgaatgctaacatgcaattgtatgggccacaggccaggccctcatccacatttcaggatgttctaacagcttctctttccttctaacagcaatagctacgctccctgcctgctccttactttcctgctctactcacacctccctgtcaggctccccagggtccaaaataaataaatgaatgagcaagaacacagaagaacagtccctctctgctgtttgctctgggtttttaataggctaccccctatccttactgtaattacacggtaaagggccacgctgttgcaattttgttttgttctataattgggttagccaggcactaaccagatgttcaactatagactcccacctttcaccaaccgcccttcccccccataatgcaattctcccaatgtatttgttcacccacccccctccctcaattagaacagccccaagaggttcaggcttcctggggacgaatatgggggtcagctattaaggtacggatttcaactctcagaaccaccaggaaaatgtcactggagatgacagttctttagcttaggtaattcagtttcttgggccctttcccaggggccacagatttaattcctatggctatttttattcccacctccattcctttaactagcttttctgtctcatccctcctagattctaacttcgtgccaggtcactaacgcactggccccttgactcacagtcaactctgcctcctgactggcatcccaagcttgaagtcccacgtggaggagtgttcagactcaaccccctggggcttccacagtcagaatctgctaacttgtcccgcacaactctgtgaggaaatctcagctcctgccacatggtcatgacccagtgtacctcccaggcactcatgcctcctagcagtcctgaaacaaaattaaacaaataacttacacagagacttgaaaaggaaagtaatacagatatttaaagggttagaaaaggagtagaaagtatgggttattcaatctgagtaagagaaagtgaaagaaagacacactcatggtttgtaacgctgagaaagaatttgaaaatccttttcaaaactaaaaaaaagactaagtgactttctgtctccactaaagacacattccacaatggaataactgttgtttctttgagaaaaatcaaggcaattccaacatggcattgtgaggcaaaggaaagaaatactgcactaggttcactgtagaaagatctcaccaacaccactactttgaaaatgacattaagattattaaagaagctccaagacatgggggacgaatcgaaaatccggacagcaattaaagttaaacaattaagcaacactattacttacacagcaaaaaatacacaaaccaaccaaccgcacaaccacaacaaaaaaagcagtttcctaaaacattttctccatcaaatgggcaggactacgcattggataatttgttcctacttggatgatgtcatcatgctaggtttaacttcttttaataactagtacatttcagtcatctctcactttctcccacataagatcaaaccagcctttcaatgacctacttcatgagtcataatttttctgtttatgattcagaaaaatgtcttcagtcagtatttcccagacttctgtgggtttattccaagaaccaatttcatcttcgctggtttcctacaggaaaccagagcaacttcctattattttattttccttacttttagcataccctagcccacatcaagttaactggaagtgagagcggtaggagactttattccatacaaacagaagccaacacaaacaacacccagtctagaagtcacgggtgcaaaattaaatgcaaatgtgtgctaatattaggaccttttttcaaaaggacaccaaaccaaataacaagaaatttaattaatcttatggcaaacattacactgtcagaagtaactttttttgtctaaatatatctatgaatacaataaattctacaaagctgattaatatagagaaattaactataagaaacaaaatatgtattttttcatcctaattccttccctaacaagctactagaaaacaaacaaacaattgcaacccaccatggagagccctggagaggtgagggaacacagcagcatgctgccagcaacctgacagatgagcagtctgtgatcacatggcgccatcatcccaggccccttccccacgcccgctctggccatgacgaagcctgtccacagatcacagcataaacagtggtatggaacagggatttcgaaggacattctaagaggagctgttcatactaagtacttgagaagtatttattatctcagactatgtacaattcagaaaaagaggtttctgaatatcaagaactttgatacaaacatatatcatattcgctttccattcttataactcctgactgcagacgtagttttgggctttaaaagctcattaagtcattaactagtaagtaataggattattttacatcaaactcaaaaacctatatattaaaggcaaaggtctaagaagaaagcatttaaggaacatattctatttggataaaccaagaaacctgaaacactagaacaagggttctcaaagtgcggttcccagaccagggacagcatcatctggacacaccctaaaaatgcaagttcgaagaccccaccctagacctaaagaatcaaggattctgaagagaggcctggcaacccacaaatgatgctacaagctttacccatcatattctctcttgtccctctacataaaaatttctggaaaaaaatgcattcaatttgcatttcccttataacctctcaacttctaaaccccttgcacgctggccaagttcttctgtcacatcactaaaatgtttctttaaaacgtcacaaatcctcgctggcctaactggcaaggccggtgacttttcctggtcctcattctcctagcctcatcccctcttgcttgcaatgacccaatttcttgactgccatggcacaatcccaccctctgcctcctccacttcagtcatcagccctacttgtcctcatcccaccctctcactatcaacctgtttccaagattcaatcttcagtcctctacccgtctttctccagttactacttggcatctttaagacctcaagagctgaatatacagctctgtaccctagatctctctcaaaactcacagcatatttgaagctaccttatagcctgcttcccttgaatgtccttcaagtaacgccagtaaaatgtttccaaaagggaacttatttctccaaccccactccaaaagttcctccttgaatgtcggtttctagtactggttctattgaccttctggtcccctgggcactggagccctgggtttccctcttctctagtgaccacatcagtgcatagagaaatcagccccacctggcatcctgtttcattcctcactcccacccccatttctagtgacaccatcctcatccagcaacttcctagctcttcttaagccctacctctagactcttacctctagaagtcatcactgaatatatcttcccccgttcaaaacatgggtagctgcccaggcacagcccagcttcctacctgaccttacctcacacttctcctcatactggttctgctcagctcatctcgaatgctcatgatgctgcaaacatgtaccaagttttcccacttctctttgcctcatattattacccccgtttcaactattagtttcccgctacgtctgtaactctgtaactgtcctctctatacctcaacaccagagccagtgtcggttccgcctcgcactatccatctacccccagacggaagttctctcttaccctcctctaaagagtcagacacttgtgccaatcacccctcctagagttgaaacccccacagcagaggtgtatctgacacagcttttcgtactgtaccatgcatgacaccttgcatgaggtatgcactcaacaaatatttgttggaagattaaatgaccttacaaaccaaaattctcactgaagagtgccatttccgcccattaactaaccattaagaaaagcagccaaaataccataaaaaaagataaacttcacatgtgtagcaatgtagagggaaccaactcaatagcctatgatttctattacttacagtacaaccacaccagaacgataacaaaacactatcatgatcactacaactaagaaaaccaactataacatatttctgaactataaatatgttttggggaaaggaaagaatcagcccatttaatactaaatgacaaggggaaggtcttctataaataaacctttataaaaattttctgcatctttcattacaattttcagctcctagaggtgataaactatctatgattacaaaggaaacttcttaatctaaaggaaactgaataacagaatgttcattccaaaacattctgttttgtctggaagatactctcatggctggtcaggaaggtcaagaagcagccagatgacttataatgtggaagatagactgactacctcaattagggaaaaataaagtcttcattcctggaatgataaaaagtcaccgcttctctataggaaagaagggatgtaatttctcaagcacacagtatgcataagagactttccaaaatgaaaaaacacatggagaatcatttagaaaaatagctaagctgtaacctaaagaccctgatacctttcacagactttggtgaaagtctggatatagaacagaatcatcacagattaagaaaagaaaaatgtttcttcatagacagcacaggcagatatgaggtatcatcattcatcgatatgtagccatccttcaaggttaacatttgaaagaaatacatataatgaagactggcaatcagttataagattgagtttattgctatgtttctctcaccatgttctccacttggtttcattttatctagttcatgatttcttccttaaacaagcagaggtatatagaataggcatttagcttccattctatgcaaacatggggatacagaaaaatagccaatcacctaagaaaaactttctgaaataagactcctgtacttgttcattaaatagcaaaacaaacaaacaaacaaacaaacaaaaaaaaacctcatacattttctggacttttgaggggcttttataacttaagagttacttgcttttatttctcaggtccactaaccatcctgtctgaacaagtatctaaatagaactcctatcattcatggcttcagatttcacttattcatgtgagcaggaggacacggcaacaaaaacttgaattaagcagaccactagaaccctaaggatgggcctgtgatgtttaccgtgattccttccagaatgcgaatagaggggaaaatccacactggctatatcacactgaggaggagggagactaaaaagctttcttccaatgatttttaccattcacaattaaaaagttaattcagctaattttaacatattattgggactcaaaaatattctctcagccagtaatttagccgctaccaaaaattgatattaacataaaggttttacttagttacatcttccaacattttaacaaaacatttaattcacaatctgttatttgaaatggcagaaaacacatccatgggcctcatggctacagggaacaacccaaaataaacaaatactgctattccaatattagtggtaaggttttattatattgtttaataacagacaagagacttttaaaaaatctatgagtacttcaattaggattaatacttaaactaacactgacaattcaacttgaagactaagaccagtgattatattactacactgagaagcagcagacacaagtaaaatacagaacgccacagaaacacggccagagaaatcccaatgaaaatgcttactttgacgtggctctgggctccaaggttgtagatctctgtgggctttacttcattaatgatcttcacaaggcaggtactgtcagtgagatcgccatagtgcaacttcatgtcttcaggatacaaaaacatcccattagatagagaaaagcaacataagctcaatttttaaaaacatcaaaattgaaatgcatatttggaaagtctgaaaaccagggtcaaaatggaaatgctgtactgatggttctggagtagcagaatataactgtcacctttacctaaataatagaaagatagctacataatgcctatgtctgtaaaagattttggtggtaaactcagaaaaatgttttttaaagcacagtatcacgaacatgttatacaataacatatcttagggctccaggtggttgtaagatgtgttctgcaagaatgagattcagaaaaagaaaaccttgtaataacatgtataccatctaaagcaatccataacactgatgatgatgaagacagctctcttttctttagatacttttatctagtaattttcaagtactttataaacatcaaccttaggccctgactgaatgcccgatgtggtgacataattgattgaaggacaactcctaaatctaaacagatccttacactgacttcattagcataagaatttgatacatgtggatgggtgatgtactaacttgatcttttcatcatttttacataatattgatctatatctacatccagtggcaggactgttctgaactttgcacaaaaacaataatgattttcaaagacaacacacttcatgacttaaagtggaaagccttttactgtggacaactgcatcatcttcctgatgctgtcactacctatacaagtagcccaaaccttcaaatatgcaggggtcaggggtgaatacaaaaccacatatggtttacaagctgactgtatcgtccttgctggctggaaaaactggccacataatgcaggctgaacttggagttaaaatccctgtgtcctggtgacagctctgccttcttcacagtgcgcaacctcagaaaactcataacctctctgtctccatttcctcaactataatgtgctctctgggtctccctatccacctcaggagttaccataagctcaaacaagaaaacagtctgcttgtgctatataaactgtacagctgcatacagacaaattaataaaagcagcaaaacaactgcaaatgctgacaatgatcagtcatttagaacagttttgattgccatttatttgggcctatcttcacaaattatttttaaaaataattaaatgtacaaagattgtttaaattgattaaattggactgaatataaaaagcgggtcggtgcactgccagtgtggaactgctcttacttgaggggataaggacacctgcagagcggtgatcaaaggcatgccctttcttggtctctccaagccatctacttcatagccttctaacagccaaaccatcatgacactacggcctagggcagtgagcagggaaggttttcaaggcatgtaaatcgtattcagtgcagtaattcatgggtaagtaattgtgacttgttgggctttgacaaaaatgacatttgaaaacaccttatctgaacataggaacatctgaaaacaccttatagaaagagattctagaaaaagaaaatgacttacttccttcaatgtgagcctggggattcttatacagatgctcaattcgacccgtattaaatgaactggaccgccgtacaattccatggacctgagtttttacagtgtggaaagataaatgtgcaatgaggactaataaacaacttctttagctaatgtttagctttatgaaaaaaatgatttgtaagcattattttaaattattagaaatagtcccactgcttactttctccccaaccactgtccaccagctacgaacatcctacctctgtctttccccagcgattttactgccaatctcaacaaacgtaatcaggtaattatgtgacttcatgcttagttgtagatactcaaatgtctccttttccaaacacacacacttacagcctaactgctgacaaaaatatcttttccatttgaaactgaagacagaccattcgaggccgtgtcggtaaaacagcctttgtggcctgctcaccacagagcaccaggccatcacagcttctcagtggcctcagagcttgcactttgcatctactgtatgtatttctggagccacagacatcatcagagagcagatgttactatgcagctaagtagaaaagtcggaaagctaaagagcatgggtaagagacagcacttatgtactactcgatttaagacctaaagaaaactcaaacgaagagaggattcttaaaattgttttatcttgacttaaccataggtggggggtggggggacagttgataaaacaggaatgtaatgcatacttgcctgatattgaagaaaagactatttgtgtctgacacacaggagaaattgttccagacctggtcccacttccttctcatgtcagattgctccctttgtgctgccaatgctaacaccagcttgtcaccagctgcccaagttccagttctactggtggcagttttaatccttgacttattttagaagtgttccttcttatgctgaaaagttcatttgcagctgaatatacttctatattttaactcaatcatttctatttcaaaccaaaattaatccttggtatgactcaaatattccaaatacggaggtaaattataagaatataagactttctttcaaacagaaagaaatgtcatcattttaaatggcatacatgagaaattgacttctgcgaaggatacaacacacccacagttaatatttctgttggttagttgctttggaagaaaagcactcatcaacattattttccaaaagaacgaaacccaagaaaagttggtaaacacgaaaatattttaggaaaggaacttcgcaaacttggtttcacattttaggaggcaaacattcaaccctaggaagcattaaattgagatttggctatacatatccacttcttaatttaaacgtggagaaaacactaattttaagcttatctgttctacttcatgatctccaatttttcaggttgctacttaattgtaaagttgaactgctctataaacttaattttaacaaaaagtatatatttcacatatatacttatacatagcaaaacttgtgtttactatcaaagttacttatgaaatagatttctcagatgtaaattctctgttttattaaataaaaaaagtctatatactaaaaagagtaatttaagtttgacaatgaaaagaataacaatagtgttatttcggctatcttctctagattgctggattctggggaagtcacatattccaacagcccaaaatatagagacatgccatttattaatatatattcattacatataaacataaaaagctttgacaaaaatattaaatgattttgatgcattccatctaaaatgcagacaactatacaaagtcaagccaatcataaccaagactttactgtcacattaaaaatcaaaagcattaagcactggttgctttttttttaaatcaagtgttttaatttcctctaactcccaacatttggtatgtgtacacagggaaagaaagacctgccaaatgcttaatccatgacagcaggtattattctaagaactaatgaaagctgggtctgtctgcttctgagacaggtgaaatacaaacttcaagacaagccaaaatgtgtgcaaactgcacaatctagttaagaatttgagattagcggctttctctttacagaagggatgtaggtagagctttttgtttgtttttataaggattttgggagaaaaagatatgaggtgttaggaaccaaactgaaaagataaaagagctgaatttggctttatataaacttaatcaaaatcattacaaagttatagtagttcaaaaacaaaatataattctgaaacactgaggtcttacaataaatgaaaatgagttttttgacaaatttcatgtcccacttaacaaggtgataaaatggaaaatttcaagttctttccatttaaaacaaagttgatttaacttcaaaatccacagtcagatcaggtaacataacagaaatgctttattatttattaattatgatcaagaaaatggaaaattattatcactgaatttcaaattcttagtgtctagatttctcttggaggcaaggacgactcccagggatggttaatgtcactcaccttttgaaaagtatagattatttaagtaatatcaatagctaacacttacacagcaatgatcatgtactggacaccgttctctgtatgtatcaaatcacttaatcatcacaacacccttactataatattactggtcccattccatgaatgaggatgttgcctgagataacacagctagtaagtggcaacgttaaaggacatagacttggtcagccctgccaacactcagtatagtttcaacatgaaatccataaaagcttagccttttttttaatcaaagtataaaggcttctgggataacaacccagaagaaaaccagttcaaggattctcacagattaagaaagaaagtatctccatgttctaacaaaaaatctcccagagataacaatgggactaaccttatatccatttcttttctatgctgatacttcatgtcacaatttacctattctttattttaaattctgatacattgtgttgtagctgttaccaagttatttaatatattttcatatagtcccagattttagcttttaaagggttcaacattgtctttacttctctggttttcctctgtacttagtgcaaaatgggtacaaaagtgtgttggtttatctgctaacagtggtgctggaaacacacttagaactagaatgcgctttcataaaaagcttcatttctgtcaatcctccgttttcccttatgacaggaagaaatgcaaacagctccagcttcctaggcaacagaacatgcctgctactcaggaatactcattaatgaatccaactaaagagcctattaaagatctgtgtccactggcttgtccacattagaccccatgtcactctgccacctccagatcaataagcccatgagtcccacagagctccattgggctaagtattttccatatactgtcttatctaaccttcacaaccaccttgggagataggtgtgcttatcatccccatttacagaaaaggcaactaagtctcagaggggttgagtgacttgcccagggtcacggagcctgaaagtggcagaggaagagtgagacacaggtgtccagtgcccagcctgaggctcctttgccacagcgagctaaccactttgtccacccctctggctctgtactggtcaacagggataaaggagaatgatcctctgcacttcagcaatgtgtagaattaagtgtatagcataatcaaagagcgattgtccataaaacccaagaattcttaggtttcctcattatgagatgacccctgtaggtaataaagaatgaaagagtgttacatccattctcctcatgctctccttaacatttaatcctgagcaaaattcaagaaacaaacaacattaaaaactgtccctttaaacttttaaattgagtcacttctcagtgagaagtaacccttcactttttcatttcaaacggttcattcagagcatgatcagatgtgtggatttcagtggccacatttgatggcaaggccccacggcttcaggagtctaaatgtgcgtgaggtgacacaaagtgattaaccacaactaatcaatctgttagtacacgctattgcttttcaagtcatctgcaaatgcctatttttgctttaaggctagctaagttatttatactttcattttgcttttctgatgggagaaaaagtaaaggagtgcgtctaactgtgctacatgaattccatacacagggtttgtttttgcctacaccacccaccatcactaccccaccaacctggccctgctctcctgcatgctcccctccaggtgactgtggcctctccacactgcccatgcttcccagtttcaaaatgcacagctggccttaccactgctaaccaaccagtgtgcctttcttttctagaaagaacaactcagcctcagcatcaagctcttcttcacagtgtttatctgttcctggtttgtcctctgctatccctaagtaggttgtttccagctgttcctgaccttagtagtatacctcatacaaaggctagattcaaaataatatggcaacccagagaagcaaggcctcacggatttaaaatgtcttagggtaccgtgttcaacttcatcatatgattcaatcaatcacctgatctcatctaaacctttagttgtggtggtttctctatctgtagtacccaggcaagcaatgtcacactgactggggtcgtgttagaaagaacaattcccagatccctgaaccagccttctgtgtcttaacagggcctgagtgattctgatgcacactaaaggctgagagtctgaagtctgtaagcatccaaaattgctgatgttgaccaccaccactgccccccaccccgagttcacacgtaataaaatacgtccctctctcatcctacttcatgcaatctactaatcctattcttttactcatggccttcaataatcagggactgcagctgataatttgggaaattttccaatgcagccaatttgaaaaattactctaacatttactttgacctaagcataaaaacataaggcctgtgccaccatcagattcctcctaatggtttattctcgaattatacgaatctcttaaaattgaggacagcagcctattaaagttgaatacagtaaggataaacacacttacagtcccacaatatgcagagagctcacatttcccctggactaggaagagaactaatttctgattatgctttgtggctgtgtactttcccgctatagtgtcaaccatgtttccttctatcagttcacggatctctctcctaaacctgttttctctctcaaacattgtttcaatgataaattcctcccattaactatgatttgccaagtgggccttctattgtctttttgtgtcataataaaatctgctcttacaatttcaaataccacaaaaacatctgcagcttatctggcagtcctaggttcttgttgcatcgatttgcaaatctctcatccttcttgtcttctgaagtctgctagttccttaacaagggacacctaaatggagatctgcttctctgccttttccagtaacactaacagtaccaggtgcttgagaatggttgccatctacacatccaaactcgccctgtcactgtcactgggtccaccatcactgcagcgcatagccgtgctccctcctcctctggactagacacagatgctgcctgttaacaccaccctcacctccagtctcagcccaccttgtccccctaagagtggatcgcaacacttgcgtggttttgagcatcacttctgacatgcctgacacgccacctcactcttcacaagtgcagcgatttctgctcagctagctcattttctaggttcactcgatacacaacaacatcactaattcctctctagccaccaaacatctctcagctcatcccaaatatctgaaacacagtatgggcatctctctgccaagctattccttttaacagatattaaggcgttaggttaatctagcctgaataaatataggtctttctctaaaaccaacactttgtactatacataacctactctaaaactctctgctccgtagaatatgcatttctttctcgattattacagcagcttatgcatatggacatacgtatacatatgtactttcataattccatttattttcatataattacaaaatgtagcattagctcttggataagggtacagaaggtgctaaacatatctactgttacttcttcaagtctaaaagtcaaggctctcagattatgagttaaaagaaaattaactttttttcttcaaataatgttggcatttagatgccaaattctttcctgttgtgtttccatttgccccaattacacatttttaaaacaacgtaccaacaattagaataaacagataatcctaaagtattaatgtaaacattcataaaacagatcagagcatacgggccactgtaaaggtttttttttttttctgtatagcatgaatttatatacatgtatatatctgaaaaacgttctttaaaaaattaagttgtacatacttagcacatcaaaattaatatataaaactattgtttcttttaaggaaaggagaaatggtgaagacaacgacaaaagcagcaaacctaaaagtttcagctccataaaatatatggttgcctattagaaaggaaaacctccaggtataaatttttcattcaagtttgccaacaatcagcttggtttttattgttctctgtaatttctgaattaagtgacttcatggtgagtaggactttcttatgaaacacattacatcataaattaacccgaatcatgttacagcttcgcttgcacaggctgctgcgttatcggagaatgtgggaagtgtgcaccacagctgaacactgtgagtgcaggggagccaccagtgctcaccagcagataaacagcacaatgggttggcaggctcacaagcccaaagacacattcttccccggattctgatttgttatctgcgtttcagtggaaaacacactcaggaggacggcagcagaggaagcatgtggccgctgcatgcgagcaaccccaccagcctgcgcccgcttcccattgagtcacccacctcatagcctttctccagcaggaactcagccaggtaggaaccatcctggggagaaagaaaaaattgcaaaacgtcagtctcatagtggtatagaaaggtggtctagatgaagagttttgagaaaagcatttaaaaggctacctaacttaaggacaatggcaacctaaaataaaaataacaccaataatgtcaataaataccacatggtgttccactatacacaaagcattttcacaaacagtattcatttgagctccacagaagacagaggatgaaaatgaaatccaggaaagtgatatgcatcaacagacagcatgaagttccagaatcagatggatttgggtttaggttttgccacttaccagttgtgtgaaacatgcagaatatgggggcagaatgccttggtgtcatagcaacataaagcagaaatcttagtaattctggggggtcattaaacaagatcactgggggtcaggcacagttgctcacacctataatcctggtactttgggaggtcaaggcaggaggattacttgcatccaagagttggagaatagcctgagcaacacagtgagaccttagcactgttaaaacaaaacaaaacaaaacaaaacaaaaaattggtggagatggggtctcactatgttgcccaggctggtgtcaaactcctggacacaagtgatcttcccaccgtggcctcccaaactgttgtattacaggtgtgagccaccatgcccagcccaaaacatctttaaaaattagccagtcttggtggctcgtgcctatggtaccagctacttgggaagctgaggtgggaggatcacttgaacctgggagttcgaggctggagtaagccatgattgcaaaactgcactccagcctgggtggcagagggagacattgtctccagagggaaagaaaaaaaaaatcactggggaaggggataagatgggaactaggtgggttggggatatagaagggctagtgtggagaggaaaagactccatggtagaataaagaaggccagggggatgtggaggaaggtgagtacctttggagggctggcctttccaggcaatggccacagctggctgctaaccctaaaggttctggaaaatcactgaaggcttgaaaaggttttaaggtggcagggagcagggatggggatcagatttgtattattatgcacacatacaaatgaacttttaaaaaaagaagatattctctttttttataaaatcgtatttcctttgtattaatcttaaatcatatagctaattcctgccttaaaatgaaggtgtctgacaaaatacagagattctcaactggttcttaataattatttttaaaatttctgggtaggggtcttcatttgacctaaaatatttcatgtgccacttttagagggaaagtatgagagacatataattaaactatttaataggtcaaaagttcaaaaatcaccattctgtaggtgctataaaaagtcaccagcctctctcagaaaataaattggttagacattttgcagtcgatcccataactgctcctctgctttctgcccaactagagggtccccatccatctcattcagacgaaaagataaaaatgggaagctccaaccactggaaattcgtgtcctcagaagtggttggggacgtttgggttttcttcggtttcttcaatttgaacaggctttaaatatcccttagagcttcaaaagctcctaccagatattccagggggaaaaaaaaacaaaaaacctttttcttattacttgaccaaaagctggaattggaaacaccctatgggtcctgaaaatgaaaggactgccaagtgtgtgtttactacattaatgcagaagtcatgcataaattcaggcagaatgacaaggcaaagcatacaagggacacattctgtggttcattaaaacctagagcagattttcttcttcttcttcttttttaagatggagtctcgctctttcacccaggccggagtgcagtgctgttatcgtggctcactgcaacctctgcctccgggttcaagcgattctcgtgcctcagcctcccaaatagctgggattacaggtgcgtgccaccacccctagctaatattcatatttttagtagagacgggttttcaccatgttggccaggctgatctggaactctagacctcacgtgatctgcctgcctgggcctcccaaaggctgagattcaggcgttagccaccatgccagggctaaaatctccagcagattttcttctgacttcttgaggtaaatattctagtttatagattcatgtgcagaagagaaaatgtttggcatattcttttttaatcccattcttacaattcttaccgtttttacatatctaaaatatatgtcagataatgacactgaccattatctaagttagataatgacactgaccaattcagaccatgacaagccaagtcgggctacacaaccactgaaaatgttattataggataatcaatatccctataaatcaatcaatgagaaaacagcttaatagaaaaatatttgcaataagactaataatttggcagtaggttggaaagccctgtaaagtatgaagtttggactttgttttgctattattgttttgaagcaggcaacactatacttctaatcattctcttggaataaaaagtttgaatgctttgtgttctaccatagctacattaaatgtttaaaaaaaaaaaagccagaggtaaacgtgctagagatccctgaggtggcaagagctgtgattatttagagagctgatgtgaaacagacctgaccaggactgaaccctgtcaataaggtcttgttcttctcacccaggctgcttctcagactttccaaccacactggaacattctgaaccagtagtggcaccggcttcctcctcacttccttgccaggcctctcgagtgatagggcctgggccgcacaatgagtgggaaacgagccgagcgagggctcctggtccccagcccagggggcccagctggccgccccctcgtcctttccccaggcccctgggggactccaggagagacgtggtatctgagcaggcagacgtccgccaagccaacaggatggtggtttccgcctcctcttgaagcacagagctgataaagaatgctccaatcagactaatgactgaaatgtcacagcaaatgagaacctacaaccaccattaagttctgacgcttgactcctctgaaacaaggaacaaacagactaaatctgtaactcattcagtatgaacacaattattctggtataaagtcctgcctaggttcaatccttgttacagaaaactctttagttgtaaagataatgtcccaatatgacccttttaagtttaattttacacgtgggctattaagggtatctattttatattaaatgccatactattttgagcaatcaccatggctttaacattttcaagacacagaaatattttcctttttttttttttttgagacagaatttcactcttgttgcccaggctggagtgcgatagtgcaatctcggctcactgcaacctccatctcacaggttccagtgattctcctgcctgagcctcctgagtaactcagattacaggtgcccaccaccacacccagctaattttttgtatttttagtagagacaggtttcaccatgttggccaggctgttctcaaacccctgacctcaggtgatccacctgcctcagcctctcaaagtgctgggattataggtgtgagccacccatcctactctcgcaagaactaagctaggaaggtgggcagatatttggcatctcgggtaactgaggcacaggggggttagccaacttttctaatatcacactagttacagacaaagccaggactagaatcctagccacccactgttttgaagtagaaaataatctccttcctcccactcctctacctggcaccaaaacatgtcaaaacccaacaaaataataagagaccataaaagatacattttcaaaccaagttgatgtagtcattttccattacagggtattttatggatgaaacagtgcttccagttctaatcaagtgacccaaatgcagagaagtcatgtaattttagaacactccagagctcagaggagggagaaaggatacagcacctgagattttcccggtctgggtttttgggggactggcactgcccatgcagttgttcagtgttgtttggaggtggatttagattgctggtggttgtaggtccagctttggggccaaagggcagggcaccagggtcccatggggccaggtttcagtgttcctgacgcctatcctgttcttccgaggggatggaccctcacttttcatgaagtactcagaaatgttccagacagagttatgtaaaaattaaagaccaattccagaaattcacagaatcatgttttgactacagtatgacaactacctaaaattccacaactatgaaaagctgaaagaaacacagaaagtttctgtgtttctcaatgaccacagatggctaaaaaaaagactgatctcacatccacacatcccccacacacaccccatcccaacacctatgtacgagggcaagccatcctcccgcaacacaggaagactagcatttttctcctctcttccaatacagatgaataagtagcccagacagacaaacgaaaagggaactttcttacatgcaatgtgagaacctggcccctctgaactgcatgctaaatcatactgtatgtttctacttaagcaccctgtggcggcttctttgaacaggatacggtcatggtactgggctaaagaaaccacaccactaataaaacgaatctctttgtttagatcatctcaggcatcaggaaatagaataaccccttctgcaagaagagaaagcactcgtttgcactgcctttttatgttctttaactccatgttgtctaattactcctaaggcatcttcccagctaatcggaattacaatatcaaggtaatctgtgcctccaataagcaaaacacaaacacttcaatgattaacaaatgatgctgttttgaatgagaatgaaaacttccaatgatttaaccactgctgtgaagaatacggagacagaatataatagaaaggtgtttatacctaggtcatgtttgtaacacaaatcattggacaaaatctctgtcagactcacaaaattcaaaagaccatggggattaattaatccaaccctctcattttacagatcaggaaatggagattcaaagcaggtaaatgtttattgtacagtcacagttaggaagtagcagaacctgcaaccaaaaaataaaaatgaaaaccaggtctctggactcccagacctcagaattttgcactaaaaaataccggggaaatatctaaaatgaagaggctggactaatgactacaattgagaacccggtaaaacagacaaatggaattaccaaagtgaagaacaaaaatagagccaataattatcaatagagcaataattaactaattagtagaaaggaaatgaggataccatcaatatttaaaacacagaaataactcccatctcctatagtcttcaaaggtgaaaaatatttccccataaaagctgctgtcaccaaagaaccaactttcccttcctttgatttacctcctgatacagagaagcactgcaatccagcaacatgatcaataacctctgaataatgaagaatcgtttatgtccagcagctaagatactctttacatagccaccccttccctcctttcaagggcaatagcctcgcaaacaggtgctcagtggttgcacatacacctcaaacctatcaagaaaagagagccgctctgtggccagacacaataccttctagtattgggtgatgagtgtaaggctaaccaagtatcagcatttcagaaagaggccagaggctttcaatcatccttgatattggtctaccatggcacagaattctctcccccaaaacacactcagtttcagtacattgcaatgttatgttatgtccatgattagtttgataagaaaaaaaagatttacatataaaaaatatcaaacagggaagaaatgccctaaaagattaatttaaaaaaaaatactttccccaatgtgataggtttttaaaaaatggtacagacgtgttttttcattttttgactggtagtaacactacagagtttttggtgtttgtggccttaatttttttttcagggaattatatatacactttacctatttttctagtaggctgtgttttaccaattggtttgttcttggaagtatcaagaacatgtacaaaattgactaattttcacctccaataaaagccactcaaaaactgatattttgaagcaggctagcaaatcttcagtctcttttatattgcaaatgattattgtaaacccttagtataatattagagcaaggaagaacgcaaatacaatgtgaactcaggaattcacatctttgcacaacccaacatgtgtaataatactactttcaacatactaaaataattttctataatttaggcaaactctataagaaaaatgagactaaagggtttaaaacaagcaggtacaaaggaagcaactgttggtaaggtatagaaagattaatttttaattaaatgattaggagaaaaacagcacacacacacacagatactccaataaatacagtcccagaaatgctggagaagcctcaaagggacaaccagtccccaacttacgatggatccacctacaattcttcaactctatgatggtatgaaaacggtacacattcagtacactcctcaacttacaatggagtccaagataaacccataatacattgaagatactgtaaatcaaaaatgtacttttgatattttcaacatacgaaggatttatagggacagacccccactgtaagttaaagaacatctgtaaatccaaaggcatctattaacagcctacgtgtgtgctaggtggtacataatatatagatacagcaagggtgagtccacctgctcatcactacgtgaatacaagcatgcccaaggcatacagtatctcactggttttccttttttttttttttcttaacgtaagctccttttatttgaacctctattttcctctccctccctccatcccattcttgccactcatactgaagttttcatccatcagagaaaaaaaaatcttcatatggcctactatcactacaaatgatgacagcagtactaagaaggatagtgagcacttgtacagcacttggtatatgcccagtatgcactaagtgctctgcattcagtatctttttaactcttcataataaccccatgtcattggtactgttttcatctcgattttacagatgaggaatctgaggtgaattgagaggtaatagctcagggtctaatagttagtaggtagaacaaggatttaaactatgtctacttgtaatacattatttatatggcaatttgcttcactaataggatcgatccctctataatggatcctattagaatggaaaatgatgggcctagagatattttcacataaaatatggcttctatagaatgtattaataatgactatcaaacacccatttggaccataggtgttatgggatggaggaggacaggaaggaaataagaaatttagtccctgccctattgctctgagaagtatctgggaagccaggcatttcctggtctagataggattatgtttcaacattggctaggacctccagatttcacacacatccacccacatgtggacagcatgagaataataaccaggtaacctgtacagctaatcaaaatgttcttgctatcagagaacaccagtagatgcatgagtcatggacagaaggtggcaaggctttgtggatgaaagaaaagctatgaaatactaccacactgacctcttctatactggatggcacagtgccctggaaaaataaatcaccacacgagcatgaaatcaggattgggaaaatacacaggaaatacaagaagaatatccctatcagatccttttaaagatctgcctaaccggacagttcagtgctgatgtgagtaactcctttcaagtttacaatatactagctgaaagtttttagaaccagggttccaaatacattaataaagatttgtacaggtgtgtagggaagttaataataaattaacagtgaacttcacactgaaataataacttctttgcagtaaatagctacacatattaaaaaattaaaactgatgaaaaataaaattagagttcctctctcctccctttctcactatctctcaaagtgacaggccatacaattaaaggctgtttctttgcaaagtccatgctttgcagttctaatcactcgagtgatttatagaggaaatgatgttttgcaggtactctaaaacagagctgcactttgtccagtgtgcaaggccatgcttaatgaaaaactttaaatttggaaggaaaaaaactgcagtaaaaagagaagaattatgaaattttagtatttacttgatttattaatgtttccttgtgcatttctttttataatttgtgtcctggctaaggcaggaaggcaaaacaaatgtccttttgtttatggctttaaaaaggtcataagaataacaaaaggatacataaatactgatgactatatctttccctatttcactgtacattaatttaacagtctgctactgaaatactgctgttggttaagcacagagttaactatttaaaaatattcttgtctttttaacccaatttctttcaaggatataattaatccagttaagaccgttcttaaaatatgtgcaggtcatgatagaaatgtcacttgtcaactctctgatgcatttcagatctgctctgccactatagagttccagacagacaggaaacattgtaaatcactgaagaaacatacaagttaagaactgtgattttgttacttaaaattactgaaaaatagacaaaattcaagcatatatcaggagcgtaaatgtagaaatctgtaagcatttacccagaaaggtgcagatcattaaactaataaagctaactcatattcagtgcccaaggatatatcaaattttgtaaaaacaactttaagtcaccggaggcaaggagagctccaagttagcacaaagaatgttgatttcaccggggtgtggtgactggggataggcacacctggcaaaactccattctgtgggctactaaatctctgtatttgttaggttgtgctatattgtgtatttcggttctgccacccaaagaaggtatccaaaataacttgtggtgggcgtggaggaatcacatattaaaagtcccaaagtctgtgcctccttcatgcttgtgcagctgtcttccagtgtcactgccttgtagactgcacaatcatggtgtgattctagatagctcagctccaccacagaaataaaggggataaaatgaacagttggcgagatactgagactgcagtttgaacctctataggactaatgcttttaggttgttctttattttgttgctttgctttcttttgccaacagcagcgggggcttagctcttattcaaccatatactttttaaaatctctactcagtggtactgatagaaaacattttcaagattccactgaaaaagaccagagctttgtaagggtagtggagttctctaggtggaaaaataacttcctcgcctaatagggattggacaccaccacccacatcttggtctcaatagcaccaaactttaaattgccaatctagccaggcccttatgctaaggccgaagtgagtcttaccttcagtgtagaagctgaaaagcaggtaggtgtctctgattcagtctagcctgaccacatgcactttttggtctaatcttaaaatacttaaatgtctaacaactacttctgtttcccagctattctctcctaatatttatgatatatcttggctatttgacagtagatttgagtcatatagttaagtcatatagttaagtcaactatttgagtcatatagttaagctatcaactttctatagacatagtttgccttatactataacatacattcttcaaccttacactatacagcaaagtatttattattgtttctatcaaaataatatcttacattcctgtaatttcttatagttgctaagtactctttagatgttttttcccatttatatctcacaacatcctggtgaggtagctgatattatcctcatttttccggatcagaaaattgaagaaagcataaatcccttgttcaaggtcatagagctagttagagaacttggcagaatatgaaaccaatttgtttaattctaattacagtgttatgtccacaatacctctccctcaatcaaaataaaaacgtttcaaccaaaataagatgccacagcagttttttaaagaaattaataaatttatataaaaacccatatacagtttagcacaaaataatatttcaaatttaagtatcttcaattatccttgcaataatccactatcaaaagccattgcttaaactaatcccccctttaagtatactaaacaacgtgctactgtgtgtatttgtgtatccgtgagtgagtgtgtgcatgcttgcctgagctcatttaaagggatacctttatcctgaggtttaaaaacagtgaggtctgaattttcattgttaaaagcagatcatggagcaatcaatcagctaataaccatctattaatatctgatgtactatgcaacatgacagagtaaatgaaaataagaataagatgcatttcctacatttgagtttctataatctagcgagaggacaaggaaacaacacatctaccacatcatcatcatcatcatcatcatcatcatcatattagcaatgacattaatgccgacattcattcactacatacttctcacattttaggccagcactggccaacagaaatataatgtgagccacatatgtaatttttaattttccagtagccaaattaaaaaaggtaaaaagaaacagataaagatgaattttatttaacacatatatctagaatgttttatgcacatgttaataaaaaattatccagatattttacatactttttcatattaaagtctccaaaatccaacgcagtcaatgaattacataacaacggggaaacattctgagaaatgtaccattgcatgaacattacagtatacttgcacaaacctaggtagtagagccaactacatacctaggatatatgatatagtcttatggtgcctaggttgcaacctgtacagcatgttactgtactgaatactgtaggcaactgtcgcactattgtaagtatttgtgtatctacacagaaaaggtacagtgaaaatatggtatcttatgggactaccattgtgtatggtcccttgctgacccacatgtcattatgcagcacatgactatattttacacttatggcatatcacaattcaaatgtaaattttcatcagaaatacttgatctgttttagatttcataaaactgatcattgaaaaagtaaattcatgtacccaacctgtaccaaatatacttaaaagttttctcataacgaaattgagtatccaaaaaatcattttcctttaattttcacaagtacattgacaaaactggttcacttttgtttaaaagaactgatttgggccaggcgtggtggctccttcctataattccagcactttgggaagccaaaccaaagccaaagtatggcttgaggccaagagctcaaggcctccctgggcaacatagtgagaccccatctctacaaaagatttttaaaataatatttttttaattagctgggtgtgtcccagctgctcaggaggctgacacaggaagattgcttgtagtccagaaggtcaaggctgcagtgtgccatgatcacaccactgcactcaacctgggtgacagaatgagaccatgtaccaaaaaaaacaaagaaaatgtttgttattttaaagtaaactgggcatggtgaggcaggcctgtagtcctagctacttggaaagctgggacaggagaattgcctgagcccaagagttcaagactgcagtgaactatgaccaggccactacattctagcctgggtgacagagtgagacttcatttcaaacaaaaaaaaaaaaaaaaaagaaagaaaaactgatttgactttgaagtataagcatatcagtttcaaatccatatcggttcaagttaagtaagctaattaactcttgtgtcaagtcagtattaacactggattcaaaggaatatttgcataaattggaaaacaactctaaatttatcagtatcaacaaagagctcttcaaattctagtttttgtagccaatatatataatggtatttataattaaaatcttctgcacattaatcattactattgacttatattatgaaaaccttcaatttcaacatgaattctaatatctgcctagctagttgacaaattaccttgtcctttcctgagactttcaaattagttcattcaaaagtagtgtgatctgagtcagaaaacataaaccatactgctatattcccttttttttttttttttttggatggagttttgctcttgttgcccaggctggagtgcaatggcacgatcttggctcactgcaacctctgcctccccggttcaagtgattctcctgcctcagcctcccgagtagctgggattacaggcatgcgtcaccatacccggctaattttgtattttttagtagagacagggtttctccatgttggtcaggctggtctcaaactcccgacctcaggtgatccacccactttggcttcccaaagtgctgggattgcaggtgtgagccaccgcgcccggcccatattccctttttaagtactgaatacttgggcaagtgcccctttttgtttcaacaaaagatcatctttggttggagtaaatattatgctatagaaatctgtgtaaaactcgtccaggactccaccaacaagtgctgctaaagatcacaaggtcactgccttcactgtcttccatttctttctgcaggtccataaaccagcaatgatctatgaatttacacttatagactggataattttaactactagtatgtgtcacactttttgccaagttaactactgtattgtactctgtccagcttcagaatacagtcgaatgaagcaataagagaaataccagcctcttgaaaaattccaataaatacagaattcggtctaagagagctgggtcaactgtaatagaaattaattttttcatatccatctgaaattctttgaaacagtcaaatgtttgaattgaatgttcttaaaacattcaaaaatatctctgccacaaatctgttatttttggcaaaaaaaattacaacatttatttataaatcttaaagtctgtattaatcggacaatggatcatcatactgtataacttacacaaagctaaaggaaagtaattgaaatgtttcaaatttcaaatgggtcatgtagtctataggcaactgtttagtgaaaaatatctttaagtttttgtgaaatatatttttgtctcttctcataattttctaataaaattttggtacctgcaataattccttctgccatctctccatcttaaactggcttcctctatagtgcatgaatccaagacactgtataggtggccaaagttacaggctcatactctgttaaaatttttaaacttaatgaacatttgatatagtttagatttctgtccctccaaatctcatgttgaaatgtgatcctcaatgttgaaggtgcggtctagtgggaggtgtttgagacagggggacagatccctcatgaatgagtgttactgccatgctaacatctgcagaactgagagccaaataagcctcttttctttataagttacacggtctcaggtattcctttacagtaatgcaaaacggactaataaaacactaaattctgctttcaggcaattacttccatcaattcttcattgacctttgagaaaaaacttctcatcaaatctaccacagatttcttgaaaatgtcttaatattgcccatttcattttctttacattttttatacaattgcaaatgagattcatcatgaagtccctagtctctttgtgttcccactgctttgatcatactactaatttctgtatctgtactcactccgcaacagtagtatgccttcacttcaaatttaaaaactgtccatatttatttactaacaagtgatgtagttaccttaattttatatatcacttaaacatttctgggggatgagggataaaaatctacatgtcaggtaccatgtacactacttgggtgacaggtacactgaaatctcagattttaccaccatacaattcacccacgtaaccaagaacttcttgtaccccaaaagctattgaaataaaaaatttaaaacaaacatttcaatttaattactaatgataatgtacttgcatcactataagctgcactgtctgcacaaaatatttaataaatactataaagtgagaacacagaaaaagtatatactgaataaattatttgacaccagcaagattggtagtgtgtttatgtatgctaatgtagtcttaccaaaacaagaaaactgtgtttaacagaaatatatcgtgcactgcttccatcttaaaaatccagttcctcgggtacgctagtcacactgaactgctcgacagacacatgtggcttatagctattgttcctgatcatacgatgagaggctgtgttcatggcagtctgtatttattaattgtggtaattctcacaaggaagagaagtctttactctaattatccccacattacagacaatggaatttaggcaaaagtaattaagtgacttacccaaagtcacaaagctattaactggggaactgggatttcaacccagacagtctgactccagagactcttatccactattccacaccgccagaagttcaacaacagcacagggtttcatgagagatgaggcaagagatgcagagtgtgttaaaaatatatatataaaccaaactactttgcaatgaaaagaaggaagccagaactcacaggaagacgtcgtgaaagagggagaaagacttgagctgcgtagtccaagataaatgctgcagataaacagcccaggcagctgagcgcaggaggagtaggtgtgcgaagcgcgagcaaagtgtgtttagccatgaacaggtaaagtgagtcagctgtggagttaatgcagcaggctaaaaaatggcccccaaaagacacagccacatcctcaccactgaaatctgtgactgatacctcatattagaaaatcatctttgcagatgtgatgaagttaaggaccttgcgttggggagactggagattatcgtggattatctgggtgaactctgagcataatcgcgagagtccttataagaaacaggcagtgggagatttcacccagtcagaagacgaggccacgagaccacagaagcagagattagggccatgtgccccaagtcaagggattccagcagccactagaagttagaagaagaaagcaaggaattctcctcttgaagcctccaaagggaacatggcctttctgacatacaccttgattttggacatccagaactgtgagaagacagctgtgttgtttaggccactcagtctgtttcaaaagccataggaaactaatacagcttagaacctctcaaaacctgcaacatgcaaagcgaccttgtgaatcagcaagaggtcaatctagcaagcagtcgttcccagtctatttaatgagagaatacccatttcccagaaagagagagctggtggtgaaagcatgcaccttttagcatctggcatacctaacattcctctaacaaagtttgggaattcctaacccaagtcacattctggaaggcaatttaatcaagtaagtctgaactttattcaaacaatgcaaaaacgatcgaaggtttttaagaaatgttgcaagaagtcaaccatttggggtgaggaaatccaggaccctgtgaccctggattcagggtagcttcaaagtagcagaatgcattgctttggaagataaaacatgtcagcagctgagccagccctcccagctgacagcagtgaactctgccctgatggaaccacctcctctgggaagtgctcctgtcatgagggatgctgacaaactaaagtggcttcacagtgtgacgagtgagaaatgacataaaagaatgaaagaagtgttgtgctagagagcaatattcaaatgggaaacaaaatagcagtaccttcaagtaaacgaaaggctaaaatatattgttaataacaaaaaatgagctacaaacggttcaataaaagtcaaaggtgaaaccatcaaggggagtgggatcaggtcaacaggaagctgcccatgggcatctgcagtaagaagcacctggccagtatggatcttcctgtggagacaagttatcaggctgccacaggagaagaaaacccacactgcataggaagctggacctcaaaactgaccagcttccacaagtctaagatttcatgacctaaactggacacaggcctgtttatcatacgcacatgtagagctggaataaaaactgaatttcaaaaatattgtgtgaaactaggggtgaaattcaaaatattgaataacctgcgtagcacaggcactgacccaccagaacgtatcccagcttatgtgcctacaggtaggtgcccacctcctgaatttcagccttcataaaaccgtgaacgctgacggagagttggaaacagattctgaacaggcagggatgaagaggggaggggaagaaactactgccgtttaaaaacttcacttgaactgacagcaggtcccccattttgggaagccacaggatgtcaaggaaaggtgaccaggtaggctggaagccacattctaaatacagcatctctgaccacaaacggccggcagccacacactgtggccctgccatctccaaggccactgactcagcacggctgcgacctaacgacacactgggaagtctgggtttggttttggttgtgcgtgctctctctctctctctctctctctcttctctttcttctcccccacaacactcctcctcccacctacactcccccttctctccgaccccgctcctatagcatacattttggttccactggttgccggcttatccatttggcggtaactgtctggtaggttaatgcccaacaataggcacttgtattttcttatacgggggaggtaaattatggcacttgaacaaagaccttactatttaagttttactgcacgtttactacaagccagtttcaattttacgtttttgtccctaggccataagagaaaaaagagcaggttcctgttcatattcgaaggagctgtttaaataacaataacaacaatacctggcaaaagcgggatctgttataggtcgaattctgtccccctgaaaatgtatatgctgaagccctaacctccaggacctgggaatgggatgttagttggagatacggttggtgcagatgtaattagttaagattaggtcatactaaagtaggtggcccctaatccaatatgagtggtgtccttatttaaaaaaaaagaaagaaaagaaaatctggacacaggcaacacccagcaagaatgtcacaggatgatgaagtggaatggtgtttctacaagccaaggaacaccaaatattgccagaaaaccaccagcggcaaggtaaggggcctggaacagatccttccctcacagccctcagaaggaaccaaccctgacaacaccttgatcatggacttccagcctccagagctatgagacaataagtttcagttgcttgaaccacccagtctgtggtactttgttatggcagccctagtggactaacacaagaccaaaagaatcaggagagtggcaactgaaaggtcaggcaaggtggccgggcaagtttggaggaaagagtttccactctttgcacctctagttaactgtcaggaagcccccagactcgcctgcctgtcacactggctttctctggggtccatcatccatcgctcctgagcttggcataagctgctggtccttcctcaactcttccagctgcccctgtccctcacacactcattcagtggaactcacaattctaaatgccgattcaaccaccactttctcagaaatgcatcctgatccctccagcctgcatcagaccccactgtttcccactggtctgtagggtctacaaggacaggaccatgactgcattgctcaacatgatgttgctggttggctggaatacatatttgctccataaattaaaattcattgtccttgggttactaatctcacaggtcctatggctccagcagacacgccaatgccctgatgatgtctacaacttttatagcaaacctgtatcaccagcttggcctctttgtcttaaaacatgagatacccctgggctctggtctcccacattgtcaattgaggggcactactgaccctttctctgcagagccacacgggctctcctttcccctacagaacttctcagacttaaccactgccatccactcccatccccatcatctgggcagtgtccatggtcttcctgccccagcatccaggtgggagcacccacacaccaggataaactgactgtgctactctttacttaaaaatcagcttgatttccattgcctattctaaagtaattttttttaaaagcagaaatcaaatctatgcaagggattaccacagaactgtctggtttctgggtggggaagctgtgaatggctgtgggagaggcaaggcgcctcccaagcagtggcctcccactaccctttgtgtcacactcccaccccacctcttagcaaatcttgaggcattccaggtaactcagggctcctcacaacagtgtagaaatcacaggtccctctggttaaatccagcctttttagtaaaggaatcaaggctcttcatttaactatcacctccattgtcaaaagcataaccaaataaaaacaaacatcttcacgtgaacattccatatcttggctccaattcttccctcccatattcattcattcattcattcatcagaaatctgctgttttaggaagtggtccaaggttacagagatgccttgccttcaaaaaacagcaatgcagtaaataagacagttgtgtccattgacatatgtaaaaacagtaataataaaaataacaggcaatatttaccacaggcagcactggaagtattctatgtgcattagccttctgaacaaccctttagggagggtcccataattatcccaattttaaggatgaggaaataaagagtcttgaggaggtcaggtcaggtcaccagctagaaagagggcaaaggaagattacaaaccatacgttctatgctattttaggtgatcccagtcaggtgtggtcacaagaggccacacagtagaggctcaggaatcagctgattgtcctcagtgatcctagagacaggaggcccgccatgcaggccacactggaacgcctcaggctggtgagaggcagagtgggcaggaggaggagagaactaggccacagtctttaatggacttccaggaaaaacaaggcggggcagggtgaacaggttaggagtggctaagttgaataatttcagcaggctttgggctacagaggtggtctctagttgcctggcacctagccttgaatgatgtaagcaagggaatactgcttcctgaagtgtaagggccagatagaggaggtctgggtatggactagttggtttgtatctcaaaggcatgctcctggctaggccctggctccctctcagaactggctagacctgcaagggcagcctcttcccaaccacaatggtttctaagatgtcaaaacatcataatatatagaaaataaaaaccgtaaataatacaccagactacctgacttcaagccttcagcaactgtgcctgctacatccccagcatagtgactgcacaaagtaaggccaggtaggagacacaatgaaggcctctggaaggtgagaaaaagatccacaaaggcagcactcaaagcacatcaacaataaaggaaacatagaagcttccacgaggataagaataaaagaaggactttccaagcaaagggactgggcaataaaaaggcaacctggccagtccagttggctgctgtgccttgatgtctctggggccagggtcctgggacagcactaaagatgaggatggagacgcaggcctgggcaagaatccctaattttcaattaggtgtatgataacaggtagtatgaatagatttcaagggtttattaagcactaagtatagtgtaagctcacatataacagaaacatttagtacccaaaacaccaaacgtatctaagaagccttaaatatcaaatttttagaccgggcacggtggctcatgcctgtaatcccagcactttgggaggctgaggcaggtggattacctgaggtcaggagttcgagaccatcctggccaacagggtgaaaccccatctctactaaaaaaaatataaaaattagccgggcgtggtggtggatgcctgtaatcccagctactcgggaagctgaggcaggagaattgcttgaacccaggagatggaggttgcagtgagctggcacggtgccactatactccaacctgggcgacagagtgagactctgtctcaaaataaataaataaataaataaataaataaaataaagagacaacccaatggaaacacagatggcccgctgcatccacggattaaaccaacgtcagatggaaaatattcagaaaacaaacaataaaaaaacagcaatgccacatttaaaaatatagtataacaactatttatacagtgtttacactgtattatataagtaatctagagatgatttaaagtatacggaggactgcagtcccagctacttaggaggctgagacaagaggatgccttgggcccagagttcaggaccagcctggctacatagcgacatctatctcaaaaataaagtatacaggaggatgtacgtaagttatatgcaaataccacaccatctcatatacgggactaagcacccatgagggttcctggaaccaatcgctcatgcatactgagagacaactatgctggcaagtgcatgggcaggtatgtcatagaagacaaaacataagtcaccagtaatcacatgaaagatcctgagttttcattagcaatcatggaaatgcaagttaaaaccacagcgaaataacgtttcacacctagcagattagccaaagtttgataaactaccaaaatcaattattaatgaagatatgttaggaagacatgttcttgtgcactgttggtaggactgtaaattggtaaaaccactttacaagatcaacagtcatttattttccaatgttgaagttgctcataccgcaagatgtaggatataccttgaagacatatgaaggtggttaagttcctaaataagggtagtgatatgaacacataaaggatgggcaaagtcaacagttacagggcaagaggaaggaagacagtcgagttaactgaagaatggtaaaaatgggtgggctggtttggtgggaaaagattatacttcgttttgggcattttgagtctccggcattaacaaaatactcacagacaggaattatgttatattacatgatctctaatgactcttgtagccctaaagctttgtgatcttatgatactatcagaaagggccaaattccacggctcactcaagtattttgctataattaacttcttttgtactctgtattcttgcacactcaaacaagctttttaacaacacgcccctctcaaaatgtctttatagtagggatgtttgatttttttcttggttcttcagctagacaatcagttcctgaaggggtatgaaagtgttgatcttctttcctcagagtgccttctactacaatacacaaagtaatttttccccctaaatggaacaaaggaagagttaactgttaagtacaatctaacagcaaagtcttcctaaagataaattttcagccagccttttggagatggaaaggaacttacttagcagagaagaggaaagtgatattattcttggtagaaagaacggtgcatcccaagggtatgaagactggaaagaggatattgctgatagatctggtacaccattaactggcactgcaggaccaaaggtgaaggaaaataggagtcctatttgacttatacttacccagttgattcttaaactcaagatgtttattttcttttactattgtagagtcaaaggcagtatactgggatgaagagaaaaacagtactattcagaaagctgtttggttttgatgaaaccttaaaaaagttaccggttggccaaaatgcaagagcgatggtctgaaacaaatcatgaagataatcaaaatggtaaccatttaaacctctgacacagcagactctgccaagagtagaaaaccaatactagcttgcccccactcacatacacgtttagcgtccctaatttcagcagtacgtgacattggttgctagcccagaagagatgcataagactctgaacctaaagtttccagtgatttggtccaaaaggatattttgataaaattccaaatggggaaggaaagacctagacatcggactcctataattttgaaaccttagcattaattatctccagtctggcgttaagacattggaaacctctgcatcattcccagatcatcactctagagtcccctacatttatcaatttatccctcccctctccacatacatgccaccaccatccatcaagtgagaagagcaacaagcttgtatttctcacagggattcatttcttaatgagatgcttacaaagcagatcatgctacaaaacacagacctttttctttaagagactcaaaaaaatgtaaagatgtatccaagcctagtacatgctttaaatttagagcaagtcccctgagcatactagataattccacaacgtagaaactaaaagtagttgcattttatgcataatgacacagatgtgttgctgacaagttgtcttaacaaaatatttatatattgactcacatttgaaatacgttaggagtagaatcttgggtaaaagcctctaaaaaggttgttgtatattagacattctcaaagtgcggcacccataccatagaattaaactccctgtttcagtcctgtgttttgaaacacatttttactattcctggaaacactttcacatttttgtcagacgttgagtgagcaacagggtaaataacttttcaaaagcatttttagagtagtaaaaccttaagttccttgctagaagggctgatccaaaataaattaaatgctggtatgactaagccaagtgtggcaaattctgatttgcagtgtggacacctccagttaatagatctattcagtgattcaacatgcacctccaagtcgtaagccgggcagcaaagtataaatatgagacttacaagcattctctgatctctgagtttgtattcacatctatcaagtttttgtttgtttgtttgtttttgttttttttgagatggagtttacctcttgtcgcccaggctggagtgcaatggtgtgatctctgctcactgaaaccttcacgtcctgggttcaagctattctcctgcctcagcctctcaagtagctgggattacaggcatgcaccaccacgcctggctaattttgtattattagtagagcaggtgtttcaccatgttggccaggctggtctccaactcctgacctcaggtgatccgcccgccttggcctcccaaagtgctgggattacaggcatgaaccaccacgtccggcctgaagttagtcttgatggaaggttctcaaagacctattattacatcctgtgtattatatcagctttgtcaaagaggtgaagtttaggaagctgtgtttcataaaaaccccaaatctgagtaagtctatgggagcaccattcacggacatgcagcaatacggtagaacacgtgagaaactgctcatctggactgcactgtaacacaagcaccctaccctagaggtacaacatgcaggtaccgctgatacagcaggcttccacagcatggttacgaatcatcacatcagacatggagagcacctgagggatcacctaatataactgcttcaccaatgaggaaagcaagaccttgatgacataaaatacggaaaagaataaaaatagacgcacataacatttcttctgcttgctcaaagttatccccgacaatttaagatgattaagggctttatcttggaatgcttagctcacagaaaaaaaaggtaggcaactatatattcttattaattggaaaaatcattgaacagccagtggtttgatttgaagagagcatcagttttgttgatttcattaaaatgaatgtaaagagaacaaggtgtattgactttttatttttttagccacaccaccagcaaatactgcatcacttacatgtgtgtttccttctgtctggaaatcctgggtggacaatttaactgccacagaactcccatgaacaggcacacacaataaacacgcacataaggattatgtgaggcgtctaccacagaatggctttttcagccacctgaacctaggtccattaaaagaaactaggcagcgtggagcagagcagctgtcccaacacaggcagtaatggagctgacaatattcccacgccagttctgaatccagtctattttatgctcttgcgtggattcaaggaaacagaactactatttaaaagtgcatttacaaagagggctttaaaaagcgttagaataaattactttgaagtgtatttctacaacacgcctccagctttcccttcttttcctatttgctcgtccccagaacccaacggtgactatatttaactgactttacaagctgtggggagactgagtacacacagcagattccagccaggattgtgtgcattaactaagtcccaaggttttttgcttgggagctttctctttctttttttcatcttcttcacatgtcttaaaattaccttatatcctggaaataacagaaaaattttaaaagaccctctattttggtttgctgtataggttgagtcctgatatttttaatcatattaacaatatgctcaaggcaaacactgccacgacccagtattcttacagtttgtaagtattttattatttccttgaaaaaacactcattccatctagtacgtattgtgagagaagatcaagtacttgtaaaataattttcatttaggaacaggtatatacagattaacggtatttggaactgactagaatgacaatgaaatcaccaacttctgatcaaggtgaaataaattaatgatttcactaaggccagatgcagtggttcatgactctaatcctggcattttgggaggctgaggtgggaccatttgagcccaggagttcaagaaaagcctgggctacacagtgagactcctttctattttaaaaaaataaaaatttttaaacataaaaataaaatttcactaagtggaatgcctctggctataaagtctacctctcccactaacacgaaactatctccatggaattctagggatgtggattccagtatcagattagctttaccatttataacaatgtcctgtgggaaaaccactaacttcttttggcttcagttttctcatctataaaattagggcttcacaccctaaagtaatctctaaaattatttccacctataagaagcaattatttcagattaagaatccacaacaatcttaaactaaagaatatttaaaagatggggtgtttctgcaaactttgaagattttggccataaactgagttctaattactcagtaaatttaaaagtgcttaggctgactaccacttctgttatcaacacttctatctttaattatatgatacctaatacaagctatctctattccacaaaaatttatacagaccacagtcaaagttcacagcttctagctaatttgaatatttggaaattatgaatgaaatatgattagactgcttttacactggcaaatttcccttagaaatgcctgaactattagcgatatccctagatttaacgagacaaactactttcatgtatttgtctataaggtaatattagcttaaaatatttaattttatgggtacaaaaaatagttagaaagaataagacctagtatttgctagcacaacagggagacaatcatcaaaaataatataattatacattttaaaattaaagagtataattgggttgtttgtaacacaaaggataaatgtttgagatgatggacattccatttaccctgatgtgattattacacattgcatacctgtatcaaaatatctcatgtaacccataaatcacttaatatgtacccacaaaaattaaaaatcaaaaacttaaaacaatttttttattttattttcattgaagatccccaaaagcaaatataacttgtaaaaataattatctcatgtaaatatgaattggagtgaattctgagtaaataaaatttacaatacatgagcaatatagccatttgctagctatgtaatctggtacaagtaagctatatgtctttgtgactgtaatgccaggaaggtaaattcttgtaatcagtttctgagataatgtataaaagctcttagtgtaacctattactcataatcatcttcagtattatcaccagtactgttatttactaagccttgctattaacaaaatatgcaaaaaacctactctttatctctgaaaatttatgcaccttaatattaatctaaaactgggttttctatatttcaatcaatttctcatactctttaagaatttaagacatctgtgtactgtaaatttttctttaaatccattcatcttaatcttgttctaactaaatgtcaaccattaacacacaggtaagaaatgggtatatgattttttcttatgacaaattaaaattagatataactattatttttaaatgtaccccttaaaatatttcatgttaccttaccaatagttttaagaaacactggcctaaactggcatttgctaatctgtaccaggttttcaaattaaagatgacatgttctgttagaaagtccatcatagttgaaggccacacacaagtcgacaggtcaatgtcataaacacagatagttctctaatctgaaaatatcaatatagtaaacaaatacctaagtccacattttttagttccttatactttgactttatttaagaatgatgtttaaagtcctttattaaatacaaaactaaactcaagactacctttctgaaaggctctttaaaatcaaattgaattcattcaaggcactttataggccaatttaatagtatttaaaaaacgtagaatttgttactgctactagccaatgcaattaaataaaagaaagaaaaagaagactaaaattatcatttgattgatgatataactgtatacctaaaacacaagaatttattaactggctacaaaattattattcaaaatcaggagtttccaaatttaaaaatgataacattcaagaaaattatgctgggaggaaatatcctatttatactagcaacaaatttgaacacttaaaatggagttaacaagatattaataggaacaatataaagaaaactttaagctcttctaagatgtataaacagaaaatatttttaaatattggaagaaaattcttgctcctggattagaagattcaacatcatgaagaaatccactgtactctaattaactttaagtttaattaaacaacaagttacaaaaatttggacaggtgacaaaattatatgttggagtcatataaatatgcaaggataacctagatcttaaaaaatattaaaaggatagaatcattttaatcataaaaattatgtattatgaaaatataactatatcagagataccaatgatataatcaaaatctagatacagtcccaaatacatacaggaatgtagtataagataaaggtagcaattagccaggcgtggtggtgggcgcctgtaatcccagctacttgggaagctgaggcaggggcatcgcttgaacccagtaggcggaagtcgctgcactccagcctgggcaagaaagcaagactcctcctcaaaataaataaataaataaaaaagacaaaagtagcatcttttaatcaatggactattcaataaattatgcttggaaacaacattttaggaagcaagtaaagctacagccctacttcattctttatgccaaaagacctttcagatacaacaaaggttaaaaaggaaattttatgataaaatactagaaaaaggctggataaacgcatttacaaccctagaccagggaatattttaagaaggacacaaaatccagagatcataaaggaaaaagactgataatctgactggctataggaaaactaaaaacttctgtagggccaaaaaataccaaataattaaaaagcaaatgacaaactggagggaaaaaatttatgaatataacaaaaagaactaatgtccaaataaacaaagaatgtgtccaatatgaaaagtaaacataacaacagtccagtagggaaaatggcagttgatgaacaggcaattaagagaaatgagttcatatataaatgaactcataaacagatttacaggcaaagatactgatccctactcaaaatgaaataaatataaatcaaaatgaaatactatattgttcacctattgaactgacaaaaaaaagttatctaaaccccactgtgataaggtgttttcatatgctattggtagagatacttttagagaagaaaaattaccctctgacccagcaattccaaagctaagaattttagactaagaatatactcaaaaatgtacgacaagttatatacatgtgcaagaacaagaatgtctattccagcaaaaggcagaactgtatgcagaatataacgtttacagaaatttgtagaggttagacactagtattgctagaaaacataccaaaaattatactctgaagggaagatatagcactagggataaatgtgaccagagagactttatatacagtttgatttttgccttgtccatacaatactttcattaaaaagaaaagtaagaaaggatgcatgaaggttgctttttatgtttctatattcaagcattcaactaattattcttcccaacacgcacaattccaagtcacaatcatgtttattgaaaatttaaattaaaagatttttatatttcagggtagattttagacacaaaaatggaaaaaccatgaagtatatttagtctttcttcttcagctgttggcccagtccacatttttctgacttaaaagaaaaatggtttgtgaatacatacaacaaccctatttgggaacgcatttacttctatttcagaaattctatccaacagcaaaataacatttaaaataaattttcttttctattcagattgctgttaataatttacattaactaacatacaaaaagtaatgttcaaaaagtactcatattcaaaattaaattaagatactgggaagtggttaaaatctgtaatttggattttggcatataaaataggaaagaaaggcagtgaccacaagtatgcaccaattcttttccaactcaaattcagaaaaaggtttttccacctaaacttaggccactcgactccagacattcattgtctggtgccacccaaacgttgttctcttgactaattctagggtttatagtattaataataattacttcaataaacatatgcccagatatgcaattatatgaccgatcagagaaaagctggatttttcaaagtttttatcactaacgacctgaacttttggccagacccaaccctgtgctgaatttcatttggctaaagacgagttcaacaaaagcctcttattgaagagatgcaaaaaaaaaaaaaaaaaaaaaaagacaaaaaccaatctattccaagaataatataaaaagttgaacaatataaaattccagtattcaacactctacagatttttacctacttcatatggttaaggctaatattcaacctttaaagaggctgataactctttcacaacattatcttttttcaacccataagacatgtatcatacttcattttttatatacatttcccatactggcacaaatacttgataaatgtcgaccacttcaaaaaagcaaacaaattaacatctttaaatgaggctttatatgcccaatctgatataatgcaaagatatcaaatcataaggatatttgtccttaacactcagaagactatctacaaccaagtttatctttactatttcctagtaattatattttaacagacaaaacacaaaagctgagaagctgcaaaaaagactatgatttttccccaataattaattttaaaacaaacagaaaattggacagtttccagaaatgaagtggattcacggcatgacataaaaggtaattaccatttgggtggatgtcttttgtggctgaaccttgtgaccaaaggcccaaaatttattttggacctctctcacagttcctccatttaaaaggaagcattttacttccttaccaccaatatatgacagatcaacatttcaacctaattgcatctgactgacaggagaagattagtgtgtaccaagcagcagataagaatataattgttttaaatttttcaaattcaggcaccacgttcacaggagttgcgtattaatggagcactctgggataccatatccttaagaaaaatgatgtgtaagaagaatagccatgataccagtttcctcttaagcagcagctccatcaagctgtttgctctttcttgaaatgaaggataagaatcagtatctctgctgaaaagtatttttaaattaggtcgtgaagatttcccaaatgcgaattctaaattacgtaaatgaaaccagatacaacagccatgatttgaaaagatattttaaactaacctacttataaaatcaaactcaggtataaagaaataaacccacaacaaaagaaaatttaaatcgctcattgttttttacatttattagacttgactattagggttactttttttaatgattccaggaaggaagaataattgttagctttcctaaatgtcaagaaaaatctaaatagatggataatatagtgttttcttgctttaaatattttcaattgataccactttctgattcggggcttagaaaattataaatatattatagagcgtcttgaaaagctggttctcccatatttgtttgtatgttgcatgtcataatttcaaggtaaaggtgtgaaaggaaaactagcaacagactaattgtcactcaaaaaaacaccttcctatggtaatgcaattatctctacgtcactatcacggtgaatttttttagatgtttttactgaaaaaggatattgattttttaagaaaatcaaaggcaagcctgcctgccttgcacagtatcagcccacagcacatgctcgacaaatggtgagattaataagaaaacaaaagagaatcaggcaaacaagcaaataatgactttcacaacaaatttaagtcactgtttttttacaaatatagtcttagaacatttctttgataactattaaaatattaagtgtagtgatactttgttttaagaaataaaaaaaacttaaatttcaaaatatgaccaacaaagcaaattactttctttttttcctaaagtaaggtaagaactgagattatgattcaaaacatcactatttttaaaagatgaatatgtctcggggtagatattatgtttatctctgtgcatgagaacttttaaacttcctttctgaatatacatctattttctttacatatgccatatataaacccatactttcttcaatgttctgttaaaatgagaagaaaggaaaaaggtctcaggattttaagaaagccaaatgccacagttttctctgtacatattgctaaattcattgaacataaaactatcaacaaattattttaaaaatcacagaaaaactagttcagattttttttctacctgtgtatataataaacttttattccttcatattccagaggaatttaccttttgtaaaaagtactgcagtgactgacagactcactaaaaactccatttataactgtagcacagcacagatcgtcttcatagacttatgttctagagcagagcttctcaaactttacttgtgcatccaaattacttgacatcttattaacatgaaagttctaatttcagtatgattgggcaggggccagagactctgcatgtcttacaggctctcagaggacagtttatctgtaaaccctactttgggcaataagtttctagagacctccactaagatagtcaagtgcattcaaattctttgtcttctttctgactgtgggcaatatgattgctaatttctgcggtagaatgcaagctattgtctttgattcattttaagtgagccaggaaacaagtaagtggtaagaaatctatgtctcagcccactgaccaaggacaactaatctgctgacctgagtagaaaagatgacccatccctatggctaatctcagcatccagatgttgccttaaccagaccagagatgccagtgctcatcttgtcttgtgagtaattttcactaccaaaacgaaatctataggggagagatttgccaaagaaattagggcttcagtaattaggaaaccacaaggcactaggcatcttgcatcagccagagatgaatgggaacacttgcaaaagtatttcaccattagcctgttttgtgaaagagagccacaggaaaaaacaggaattttaaaattcctttattactcaatacaattatatgtttcagcctaaactaatgctggcactgttcaacagaattccttcattcctcaagggtaaaatgagaagcagaacaaatacagatggtctatgtgactctttccctgagtatctaagagagacatctctgtttggaaatgggcattaaaatctgcctgcctgatacagttctgattcactattgtctctaagatggtagctgaaacaaaaacaaacctcagcccccaaaaccacatcaatacctccttcctcatgaaagcaccattctttcatgttcaactcccacagtggccttttcatcaccttgctggttccagcttttattttcccttcatagtttctagtaatgctatatatataatagtttaaaaacaatagcaaaatagtttctagtaatgctatatacatatatacatacatatataatagtttaaaaacaatagcaaaataaaacatatgtacgcataagggaaacagaattcaaaggctatctcaatttgacattcatgtaactgctctgggagggattccttaatttataattgaaaaaagtacttcctacagtttggtaaaaatacaacacaaaagtaaagcataaatatgtgacaactggtttttctgaaaaatgaaaaagaattgtaaagcaaaatttccaatcaacctcaaataaataatctagatgctaaaataaaatggcattccccatcagttaaatggaagtgataatgtttcagaagacatcaaaataggaacttccaacctcagtaagaatcacaaatcaaaactgctcactccttagtaaaaacctctttggctatctgctggccactttttgtttatcaagatatttggtctgacttcccttcagtattggggcaagaaagtggggaaagttaggatggggacttagcgaatcgcttcttaccgccccctagcgctcactcaaagcagtggcaacatggatgcgctgactatggcctttcctttgccaaccggcatcaatgatgcttcctccccacagtgtccacggtggttaattccttacgctgccagaggcggtgaggtgagccaagttcttagctgtttttgacaagtatacctacttacatcaaaaagcatcaagcttaactctcacaagaaaagaaatcactgaacattaggttggggtttagaaggaagataagtaattatgtgctctggataaacacaggtactgaatatgtactgaatttttcctcaattttttagaattgcgacacttcatgaaagtcaacacttccagtgtttctatcacatgttaagttaaactaagtccaactttggggatacatattaaatttaggccaaaaaagttatttttaaaaattccttctacgtatagttgacccttgaacaatgtgagggggaggagacagaggggtaccgacctcctgtgcagtcagaaatcctcagataacttctgatcccaaaaatttaactgctaattgcctactcttgggctcacatgatccgcccacctcagcctcccaaagtgctgggattataggcatgagccaccacatccagccaattttaacgttttatgatagatttgtgtatattttatgagagtaaatgacaaaacagactaatatctacatacattttatgcattcatggcatacctttttcttaattttttcaatatttctttttttcttttttttttttttttttttttgagacagagtcttgctctgccggccaggctggagtgcagtggcatgatctcggctcactgtaacctccatctcccaggctcaagcaatgctcctgcctcagcctcccaagtaactgggattgcagacgtatgccaccacgcccaactaattttggtatttttactagagatggggtttcaccatgttggccaagctggtttcgaacctgacctcaggtgatctgcctgccttggcctcccaaagtgctgggactacaggtgtgagccacagcacccggccaattttttcaatatttctaggctacacagttcatctatgtgttttttcaaattgtcacaaatctccaaaacatcttccaatatatttattgaaaaaaagttcaaacccgtgttaagggtcaactgtaatatataaaatatgcaattttatagtcatattatatagcaccatgcacaggagcataaattaacaacgaaacctacaaaaaatcttgggctgaaaaaatcattcaatcttttagagttaatagaaagcaactatgaacaatttaagcctaaatattaacatatttcaaagaaaaacataaacttctcccccattaaagaaaagtagtactatattttccaacagatttttactacatgcgatagtttttatctttctaaattgcaagttcagccaaaatatcatatctgaactctgagaagagtgaagttcggataacaatttctcatcagaagagtgacagtggctgacattaacagagagtgtccaggccttgcactaaatatgtaacacagcttctaacatttaatcttcactaagatataatggataagcactactatgatcccattttataggtggaacacttttcagctagaaagaactaggaatcaacctaggtctgacaccaaactccaactttattaactcttttttaaaatagattctttttaaagacaaattttcaagttgtagaaaaatgtcattcaattgtcatggttgttatataagtctatgaagattttgagacaggtgttgcccaggctgcagtgtagtggtgccatcatggctcgctacagcctcaaccaccaggtagttccagctacctcagcctcctgggtagctggaactagaggtgcacaccaccacacctggctaattttttgtagagatggaatttcaccatgttgcctaggctggtctccaactcctgagcctaagctatccacccacctcggcctcccaaagtgctggattacaggcatgagccacgaccacacctgaccaaagactctgatgtattgttgttcaaactcaatttactgaatgagcacagactgcaaatattccaataaataccacttctctaaatatattttctttattctttcaagctgaataatcaatgaccataccctgaagctctttgaaagaattatttttaataaactttgtcaaaaggattatatgttaactttttttttttgagacggagtctctctctgttgccctagctggagtgcaatggtgtgatctcggctcactgcaacctctgcctcccaggttcaagcaattctcatgcctcagcctcccaagtagctgggactacgggcacaccatcacgcccagctaattttttgtatttttagtagagacgggatttcaccatgttcaccaggatggtctcgatctcctgaccttgtgatccgcctgcctcggcctcccaaagtgctgggattacaagcgtgagccaccacacccggcctatatgctaagataattttaaagtataaaatctttagttctgtgtatatgttagttttgctcactgactgaaacaagctgttaaatagtaacaaatgacacgactgaccacaggtgctttcagtgcacctactgtatctaccatctgacatcttatgagtactgggacaagatttaggaattatcagaggattgacagcttccctcaggaagcttcacagtgtttcttggaggttttctgtttcaatttgggtgtacttgaggatttgaaaattcattttccacatcttaataaaactgtgctataaagtgctgacccagaggtggtgggggaacccccaattccccactgtgaccttcaaaccaatcagtctaggacagaacaaggacctacgtggggctggtgaaaaagataagggacccaacagagaaaccaaaggacccctttaagggacatttcccaaactgtccctgaaacacaaaaaagggctaagggtttggtttcaaaggacttcctggctgtgactcagactgctaaaaagtcaaaataaaaggagagaaagccaagacctcattcaagcaagtcactaatgacaggagtcactgtcaataaactcaaaagcaagatcttgccacagataagctacaatacagctaattcactcagaaaaaaacagagctggttctctatgcatgttttataccacaatatattcaccaagaaaaataatattctgccaaggaacatcttaatgacacaggaaattgtctatgcttgataaggtcactgcattcatagacaaaaatctcttgagactaaactggccccagagccacaccaagatatacattccaatgcctattttaaaaataaaggaagtccattttccaaggagcagaaagaatacctgtgggtgcctaggttctaatcatgcttctgccccaagctacatgacctgggaattgtgagtaagccacagcgtagggaggccagtttttgcaatggtgacaaggaactgactagacaagtttggtggttctcaaaatctcctcccatggaacaccagggttccactaattaagactgtggctttctgtggctcaaatcaaataatagacatctgtttccaaagttctttcccataattttttccttatacctctggggcttgaaagtacttgtctgctaaaaggaagcagaaaaaaggagtagaccttattgttttttctagtctcatgtattcagggttagaattttaaacttcatacttaaaacagtcttacttattgctagcaaaattattcctggttcaaataatagaataaaaatatcaggttttcataacattccaacacacacacacacacacacacacacacacacacacacacacacacacacaaaactttcctggtgcttccctacattaccagatttgagtgagacccatgagataagtaacgtctaagaagtggccctgggttgagaggagacagcagcagtgatgcatacttcccacccacactgcttccacaggaaaccgagttccctcctgctctccaagctctggggccactgcaatttcagttcattcctgccatcctttgttccttgtggccatccctctcactcactctatcggctctgggactacatcaaaaaataaaaaattagaggagcaacagcccactgatctagacagctctctcattttctcattgatccttgcacactgtagtgtagctgatgtaaactgtcgtaaggaaagtctggacaagttcttgatatattcaatcacgaccgatgacatgtgcctaggaggctacttttataatgctgaataataggcccaggtgacaataataaactgtcctaacagtgaacagggactataaaaattgcctacaagcaagggaagtgtcagaaatcctgtcatctgccttgattctcaggtggaaagagaatcaccaaggaaaagtcagatttccaagcccactcacatcatgtgggattcttgagcaggtccacagggtccaggagaggcaaacactaaatagctgtgttagtcagggttctccaggaaaactggaccaacaacatgtgtgtgtctatgtgtgtgtgtgtgtgtgagagagagagagagatttactacaacaaactggctcgtgtgattatagaggctgagaagtcccaagatctgcagtcaataagctgtagacccaggagagccaatggtgtaagttccagcatgaaagctgacaggttcaagaaccaaaaggagataacattttaatttgagtccaaagggaggaaaagaccatgtcccagctcaagacagtcaggcaggaagagttcttacttgttaagagggtcaacctttgttctattcaggacttcaaatacctggtgatacctacccacattagacacacaggatgaactagccaacaccacaggctgagcgctgccacttggcccctgggatccaattgctcctgctgcattaggtttcccaattcagtgactacagctcccactgtaaggcctaacagacgaaagcaaccacagagctcttccaggatgctggggctcccgtcacaaatgcatttctcaccattgtgaaagccatgtcttctggaccctcccgtggtgggcaagtaggtctttaacgacaaatctactctaacatttcattcttcctaataagcctttgaatccttttctctacattaaaatgagccaagtctagcatttctaattcaatcaccgtaggccaccttttggtccatggttcagccaacccaacgtactattagagcactttctgactcactaaactgcaacattaaatgcagaatctttgcttagtgagtatatgtcaacaaattcagcccgatacaacttcacgtttcttccaccattattccacagtcttaatatacatgcccacatttgttccccaggtttctgtctgtataggttagaaaactcaagtagttattttggagtgtagtgtaccttctcaggggtcatgtcttgaaccttcacctttaggagcctgctggagttactggtctaaaaacagagccgtggtaaaggtgggtcctgagtagactcagcattatcttacaaagcaactgcctcaaggaagccactacagtttccttagacaatgcagggttaatgccctcaaacaggggtggagaggctactcccattgggggtggagaggccacatccactggcaaagaggactcatcagaatttagggttcgatatccccagcttcatcaggatcttcccacacatccccatcccaactttcggcacccccttccttcccaatcaatgcctttaacagtattcaccctatgagactgggagttcaatttgcatcataatacagccagtcacaggataagattctgggttttttagccatttcagccctgcaactaatacaacttaaggttctccttcagggcacacatacaagccttcagggcatttatgtggtgtttgagctggaaaataaaatgcttgagctcatccttttctttccccactttgtccagtgacaaccagccaatctcaccgtatttgttagtttaccaaaaatgttcaaaaatatcatatacacagtacccagatccttgattgctttaagtggttggttaggagtatccaatggtgatatcttgtatatctctattgccagatcatgccatggcctatcagtgctctccttactactggaaagagttatcagcatattttagtcttatcagattagagagccacttctagaaaccccagaatcacattcagaaaacccatcctggaaactctgctcctctagaaccactcccagtaccaaaatctgtactagtcaggattctccagaaataggaccaataaagtgtgtggagagacatagaaacagtatgagagagaaactggcaatcccaagatctgcagtccacacgctgaagagccaggagagccttggtatagttcctgtctgaaagccagcagctttgagacctgagaacagctggtatttcactttgagtccaaagggaggagaagacccatgtcccagctcatggatatcaggcaggagaaattccctcttactcatgggagagtcagcctttttgttccattcagcctttcaactcattggatggggcccacccacattagggagggccatctgttatactcaagtttaccaacacaaatgttagcctcatccaaaaacaccctcacagatacacccagaatgtctgaccaaatgtcagttggcacacaaaataaccatcacatagcatagtatgtttatctcataatctgcatcctgtggaagacaactcatgttaaaagctaaataaaataatgtcagctcatatagcatatattagacaacagaatattctccacaggactttaaaatatatagagttgagacataaaggaaggaatcaaattcataatgcaacaagagaacactttgaaataaaaatgggcagttctgaaaaagaaacacagacattccacgtaggaaaatacatagttattaaaatgaactcaaggatgggttgaacagtagacttgacaaaggtaaaaaaataaagataaaaaaaagaatcaaggcaaatattagaagaaatcatctgaagttactcagagataaaaagccagtaaatatgaaagacaagtatggaaacagactaaatggatgacagactgggcgacccaacaagcaaagcattcaacaggaaaaacaaaaaagaagcaagaaaacagagaacgtgagcattcacgttaacactcgcagaacactagccagaactgaagacggtccccatgcagaaaaaacatatggagtatcaggcagaacaaatttgggaaaattcactcctatactgaatatcttcagtttatcttactgaaactccataaagtaactgacacaaattctgagggaaagaaaagcccaactgttcccaaagattcccagtaaaaataacaacataataaatggctgtcagtttctgtgctgttactctttgccagtccctatactaagaaaatattacaattatctcttgtagttttaggcttcaaaacagcatgtaagaatattttcattgtacagatgaagaaacaagctcagagttcaagtaaattacacaaggacatctgaaattcaaattcggatctgactctgaaccctagaaccttattcatactactcctcacaatcacccacaaatagctgctcttagattcttcatctggaatggcagagtaagaagatttatgtgaagaaagattttaaaataatgttcccaggtcacagagttaataagtatcaagtcaggcgctatcttactccaaaagcatgctccttctgctgtgataaatcactcatcagcaggcctcagtttcttcacctgcaaaaaatgtggccaatgctaattgttctcccagttcctccaagagtctgacaccttgccagcctgtcacacctagtgagcaaaaccccaactctgccatcccactccttcctcatcagccaagatcttgtttacattctctgttcctaatcccaggcagctgaaataggccaaggaaaatcccagggaagaccgttgcctctacaaatagatgattcaattgcaattgcatagtcagaactgcccagcaaacctatgacaccttcaaggccactgtttctcccaagcaattttaaactgtgactgaatcattacactttcccatttcagtaaattcaccaatgacttcctagatacctaattcagtggacattttttcagaccttgtcttccttaaacttttcgtagcatttcacttggttaaccaggaagatatgggtgctaatactcacccagtcacttaaggcaaaatgggaaagtcatcctagatgtctcctctatacccaccaattagtcaatacattctatctattctgtcttcttgatacttaccacacccattttctttgttttatctatactgcctcatctagctcctcatcatccctaatctcaactagtatactagtttccttactggtcatcacacctgcagtttcatttccctctccaattcattgtctaccagaacatcatctaccagaatgatctaaaagctagcagaatgatctttcaaaattcaaatctcatcagagtcaaaacctcttcaactttacaggtcccccataaaccttaattctaccagaagacatacgatgcccttatgattccacctaatctcttgccatgcatcttcccccaccctcacacgtaatatgccctttcctgtctttacatgcagcttcttcctaaaatgcctgcccccagctagcctgcctgaaaaaaacccagcccaagccaatcctcctctgataattcctctggctgctcttacctccttgctcccatcacaagttacacagacttccatttcggcaacatcccactccactaaatcgtatatatatactggtattaattccatgggaacaacattcctcttgtaccttcaatgcctagtgaaacaaccggattcacacagcaggcagtcaataagtactgcttaaataagcgaacaaatggctggatgactaaggtgccttcattgaagcatttattatgtcctaccaattttaaaaattcctttaaagtgaaagttagccaatactgaggcagaaagcaagacaataccatggctcttctttgtgggtgtcatttcatgcccctacactgaggaggtacaaacttctctaagggtgccccttccatctttattgtttctacatttgcctgctctttcccttccttcctcagaaggaaagatgtgttagcaacagtcatgctccaattctttccatttccctccttagctctctgagggtctgcaaactgcagggaagggtgagcgtgaagcttgttctttaccaacaacagcatccaaaaccaaaactaccttgataccggacagcttcatgcgcaccactttaaggcctgagatccatgagtagaagaaacaaggagcaaagcaaaaggtcacttccctacaaacaaaatgtgggcctcagaatgtgaggcaagaaaatcttacatgatatgaatgtcagatggcagcctttagcctacatcaccacaaatcaatattaaataactaagacagtgtatttatacattgagagaggatacactgtagaaaagaccctaactatgcttccatttcataaaccacaaatttagatttctactatgctttttcttttctttgctgtactttctgaagttaaatgaatcagttaaattcttcaaataccagtcagaacacatcaactgcttcttttaaaagaaactcttaaaatggggcaaagtagatgccaaataaggactctgtttctaaacataaatttaatacaagtattgtaagcaaggtcaaaattattaaaaggaactccacttctgaatatttagaataaaaaagtctgctctcaattttgatgtatttctaagtccttacagccaacaaagaacaaaaaactccactggtatttaaaattctatctggatatattacactgacaagatatgattatataaccaagaccgtatcatgtaaatactgaaagtttaaagtcataggtagaaagaacacttgaataaagatactaggattcagagagaatttgtagactttattttagactccacagtcatctttccagagggaaaaaaaactaaaattctcccacattcttagtatctaggataaccttaaacatcagaaggtgttaaattcacccaacatgagtcagggacaaattaagaactggaaggcactttgaaaaacctaataatgaaacagaagttattaatatcgttattacaaaaatacttaaaagtccatttgatattaaaaccagttgaaaaatcttcataagaaagagttccttcaacaacactacatataacagtatggtggctcacgcctgtaatcccagcactttgggaggccaaggtgggaggaacacctgaggccaggagttcgagaccagcttggccaacatggtaagaccctcgtctctactcagaacacaaaaattagctgggtgtggtggcaagcacctgtaatcccagctactcaggaggctggagctggagaatcgattgaaccaaggatgcagaggttgcagtgagctgagatcacatcactgcactccagcctgggcaacagagcaagaatagtttaaagccaccaggcagcaaaaaaaaaaaaaaacaaaaaaaaaggcaatataattttaagttttctgggaaaacagaggccatcagaagaataacttatttttccctttgatttcataaaatatttgccaggatctgagacttttaacttacacaactcctacagcagaacaccatcctcaaatactgattcaaaacacagatccagagagaactcagttacgtgttcagctggcaagccctgactatcaattactgctttaagggtgctgggctgattcagaaggtgctatctggtggtatattagaaaagaggactggctgggcgcggtggctcacgcctgtaatcccagcactttgggaggccaaggtgggccgatcacctgaggtcgggagttcacgaccagcctgaccaacataaagaaaccccatctctattaaaaatacaaaatcagccaggcgtggtggcagatgcctgtaatcccagctactcgggagcctgaggcaggagaatcgcttgaacccgggaggtggaggttgtggtgagccaagatcgtgccattgcactccagcctgggcaacaacaacgaaactacatctcaaaaaaaaaaaaagagagaaagaaagaaaacaggattcgactttctccatgcaattttaagagaatgttattacttacagattggtttaaatccattatccttgttaccatatgttctaaactaaatagaagcacaattaggccaggtgtactagctcatacctataatctaaacattttggaaggccaagacaggaggatatcttgaggccaggagttcgagaccagcctgagcaacacagcaagaccctacctctacagaaaaaaataaaaattagatgggcatagtggtgcacacctatagtcctagctactcaggaggctgacgtgggaggatcacttgagcccaggagttcaaggttgcagtgggctatgactgcaccactgcattccagcctgggtgacagagtgtgaccctgccttaaaaaaaaataaaaaaaaaaaaggcataattacattacagactaacccatttggttaccttttttagaagttaaaactctaaaaacaggccaggcgcggtggttcacgcctgtaatcccagcactttgggaggccgaggcgggtggatcacgaggtcaggagatcgagaccatcctgactaacacggtgaaaccccatctctactaaaaatacaaaaaattagccaggtgcagtggcgggcgcctgtagtcccagctactcgggaggctgaggcaggagaatggcatgaacccaggaggcagagcttgtggtgagccgagattgcaccactgcactccagcctgggcaaaagagtgagactccgtctccaaaagaaaaaaaaaatactctaaaaacaagtatgtatcagactgaaaaaaattactacctttaaatatctgtcaatccaaatcatagtaccaaaaattgcaaatacacattggtaaatgaattcaggaactcatgaacttgaattcaggagtctgtgcttcttaatcttaagagtaaagcttatggcattgtcacacaactttcagtggtctgaggagcttaataaaatggagtgatgagtctgtacacatattcaaaagattaaaagaataacaacaaaaaaggaagacaggacagagacagaatgtaagtaatttgtttaacattttcttggcccattcggtctgctataacaaaataccataaactaggtgcctagttctcttctttctcacagatttggagcctaggaagtccaagatcaactacccgaacagacaagcaaatggcaaaaataaataaataaatggcagatgtgttgatgattagatgcaattaactgagtggagaaaaattaaaatccagaaaacaaacacagaataaagtctgtctaatttacctatgtatctctaggaagcagtcagtaaatatattaggatttaataaagagaaaataaaactaacaaaattgtgcttgctgcaggtgggtggatagcacagggaacaaaaaatgagatcatcatcctaaggactcagaaatacatagtgtgaaactatttaccacagaagccagaagaaagcatcaggaaagtcttcaatatccacattaaaatgcacaaagacttccatgaaaaaggtgcaaagagccacaatgaaagaaagaagttaaggtaaaaagataataggataatgtaaggagatgaacaaaataaggaaggaaactaaaatgtcaacagaacttaaatgcatacagagagcagtgaggggctaaactgacgcaataaatggcagagaaacaactcacgtggccggctaatctgagaggctttcccagactgtagaattaaaaaaagataccttccaaacactacggaagacatcaaagacagcatgtgtaacaaaaagcagacctcccaacccccacgaaaagcaagaatacatttaaaacaaaaaataagaaggcacaagtagaactgaacttatcttttatgatgatcatcataaatgaattgacctccccaatattaaagacaaagtctctcagattgaggagaaaaaatgagatactacctctcaaaacaaccagatatgttgtatctcaagaagataaaaataaaaggagagagtgacaatatgaacacaagacaaaatagaattcaaggcaaaagtattaagtggaacaataattaagacacaaaaagcatgaatttctgtttgaactaccattacactgaaagattaaaaagaattgatatggccgggcgcagtggctcacgcctgcaatcccagcactttgggaggccgaggcaggtggatcacgaggtcaggagttcaaaaccagccttgccaagatagtgaaaccccatctctactaaaaataccaaaaaattagccaggcatggtggtgggcacctataatcccagctactcgggagactgaggcagagaattgcttgaacccgggaggcggaggttgcagtgagccgagatcgcgccactgcactccagcctgggcgacacagtgaggctccatctccaaaaaaaaaacagaattgatatgacaaaatgcaaaaagtattagaattgcatggaaaactggtgccccaaaacctactcacattagaagagcacacacctcagtctgacctactgtgtaggaaaaacttaacaaagcatggaggactggaattatacaattgataacattagtggatatcaggctttgtactgacattttaaaaatatatcttccttctacagcattcatgaaacatttgtaaaaactaatattaacatattaggccacaaagaaaatttgaaaatttcaaaaagttccaaacaaacataaactgtacacaatgccgtgttctcagtttccaaagaaataaaattactaattttaaaatgacacaaatattagaaatttttaaatactagtctaattaatggattaaaaaagaaatctgcacttctaggttattttaaaaacaacatactactgcttatcaacacttaggaaatataatcagatacagtctgaagaaaattgagtcttaagcctttcattattaaaaatagaaaaatcttcctgcctacttgctgatacctagtttatccaaaaagagcaggagggtagaaatgttttcatctacagtaagaaattaaaggagttaaagtacaaatccatagtttaagacaacatacttcagaatgaaccagttttaggccacctgcacccagccgatgatttgataactttaactaataccagatgcttccatgtttttacagggcatggagggaaggagggcagcaaggcagagaaagtcacggatttagaagggttcaaaagtagagactgggggcacagaagacagtttaatatgtatccatttttctttgtataattaattctgagtgggcataaattgaagttatacagagaagtagtgaaaacaggaagttctattctacatcaatgatacaggaaaaaataattccctgattgcttataaaggctgtggttgcttgtagttctgataatcaagagtcaaggaaaatacccaggcttctgaattactgcagtggtagcttttataagtgcaataagcccatattcagagattataaaatagatggtttccacacccactgagtcttacgctagcatttcataagattggttttaggaatatctaccattcctcaagcatctgagtaacatttcttctcatcctaaggaacagaaagggcaggttagcatcgccaatttacttagaagcaaactgaggtccagaatgggtccaaaggccatataactagaaaggtccaagtgaggattccaaccctcgatcccaatacattataattattgagtaaaaccatgagactgaggaccaagatatagatgaattacaggctacgaacagtaactaatcatgtgaccttgggcggtctcactcattcaataaatatgtattaagcatcttctgtgtgcaaggttctgtgcttagatgctggaggctcagagttcctgaatttcaaaaaatataatcaaatacacaatctacttcaaaaggctgaggggatggatgataaaatgcttacaaaagtactttttaaaaaggataagagaatgtttgaataccattctttcctgctaagatatcttcaggtctcgcatagaaaagtttagaactccatgcttaaattcacccatttcatcttttttaatgggtgaatttcatcttttttaaactatgcttgcagagtatctaaatcaaggataaagaccatgctaaattttttaaaactttattttttcatcttaagtattgttgagacaatcaaagaatagccacaaacaggaatagaatttaatggtgcctagttttttttgttttgttttgttttgttttgttttttaaattgagacggagtcttgctctgtcacctgggctggagtgtggtggtgcgatctcggctcactacaacctccacctcctgggttcaagtgattctcctgcctcaggatcccgagtagctaggactgcaggcacgtgccaccatgccaggctaactttttgtatttttagtagagacgggattgcaccatgttggccaggctgatctcgaactcctgacctcaagtgatctgcccatcttggcctcccaaagtgctagcattataggcatgatccaccatgcctggccgaatggtgcctagtttctaaaggctcaaccacaaatatgaaatataggaaacaggataagacatgcacctgggaaggcagaagccttcaggacttggggccaggtctacagccactgtggggcatcagggctctctaggcaggccacacagaccacaccagaggaactatctcatcatctgaaggggaaggggggtgagggtagctatttgaaacacagtgcaaagtaataattttaaagatctcttgagaagtcttatggttggatgatttggggatctatgaaataatcacatttttgcttcttgaaaaaggagatgttttatttattaatgtaagttaacttacaatatattaactcaaaaagagaacagcacatgttatgcaatataacaacagtaaattgaaaaattgaaggtggataaaaatattattaacctttaaaagtctcagcaatttaagcagtctaaagaataacaaaaatatggttcctgtcactgttgagctcaaagaggaaattcttttccaagaagacatatgccacctcggacttgaggtagaaaagttactatgtaaaaactgttaagcaaaagagacatcagacccactactctgcagatattcctgagggagttgtgtcgacagaaaaaagagagcagcattactatacctcagcttgggaagaaccaagaagcagaggttgtatcatttcactcaatgaattgcccctctccaatttaactttccagtcatgctcacactgtcattacccaagcctcacagaacagagctcctgagaaatgagcatgctttggttttaatacacgtacaaaggcagatacactgcccctctcatgttaccataaataaaatatccaataacaatttctattaacaataagagtaattattatttttatagctaacatttatatagcccttaaaacatgttgtaagcaccttatgcatgaacccacgtaagttcatgaacccacataaacagccctatcaggcttgtggcactatgattagccccattttataaggtaatactattttctcaccattttacacatgaggaaccagaggcaatggtaacgctcccaacaaactgcctgtgtacaaaactggatcacacaaaagtgcctcagagcacagatgctttactgtcaagaggctgaagacagcagatgtgactacagctaaatgcacactgacaacatgtaattctggtgtccagccccccttctacaaccagggatgactgcctccccacatcagttacttttgctgattgacaaatagtaccaaaacaggacagattctgattcactatatttattaattatatattagcaattttctaaacaaatggtttagaaaaacccatttttcttaaaaaaaatttttttttcttaatattttatctcactgtggaaagaattccaagcacttaagacaatgcagcaatggttaaaaacagactttgatgtcagaaatttggttcttcccagctgcattacttcagctaagttgtttcacatgtttgtgaagtgagcagtgtttcatgaagtcgagcaaagattaaagcatgaagttcctaacccagtgtctggtaaaccaacttaacttggaggaaattcggggttgggtgggaataaaccaggaaggaagcagagcaaagctcatagaaaccacctactggcttaacttaggcaaggtgtagagacaacctgatctgctggttggggtaggaggggagggcatgtgaagagtgcaaggaagcaagaaaggtgggaaagaatagccatatggagagatccttcatctcacactccctctcagaaactctccccagacaatcctggggagtaaagtgggaattggcccagaagtaattgcttccttccctgcagaagacacctttcagtgctagggcagtcctgcacacaggttatagtgcagggccaaggagggagaagggtcaggtaaaaggcctggcactgaggggacacctcgaaaagatgtggccatcaaggcaagcaggttaggaaagcaacctaagcaggcagcagtgacaaaggaagagagctcttttaggaaagggatggtctcagaaaatttgtaggcagatggggaagagagaaacaggaaagggcaggaaataaatggagctggatccagtaagaaaagtctttggtaccaagaacgcagttggaacgccagccttggtaagcaggaggcatgttttcctgttcagagactaagaagaaggggaccattaaaccacagagagattatgaagggatgaaggtacttcacctaagggcagacttaatctcaatgaagtgggaaaaagattttgttaaagcagatgggtctgcagtacgtataatctggagagatcaggaaagtagactgggtttggggtagtaactatgaagacaaaaacaactagacaatcagatgaataaaaacatagctggccgtcatcctgatatcaaaatttggcagaaaaacaacgaaaaaataaaacttcaggccaatatccctgataaacagacataaaatcctcaacaaaatactggcaaactgaatctagcagcacatcaaaaagtttattcaccacgatcaagtaggctttatttctgaaatgccagattggttcaacatacacaaatcaatatatatgattcaccacataaagagaattaaaaacaaaaaccacatgatcatctcaatagacacagaaaaagttttcgataaaatccaacatcctttcgtgataaaaaccctcaaaacactaggcatcaaaggaacgtgcctaaaaataataagaaccatgtatgatcagatgacagcccacatcatactcaacaggcaaaagctggaagcattccccttcagaactggaacaagacagtcccaaaagaaaataaatcatcctaccaaaaagacatgcatacttgaatattcaccgcagcattattcacaatagtaaagacatagaatcaacgcaggtgctcatcaacagtggactagataaagaaaacgtggtatctatacaccatggaatactattcagccataaaaaagaacaaaattgtgtcctttgcagcaacatggatgcagctgaaggccattatcctaagcaaactaaagcagaaacagaaaaccaaatcccacatattttcacatataagtgggagataaacattgggtattcatggacctaaagatgggaacaatagacactggggactactggcgggagggaagaaggagagcaacagctggaaaactacttattgtgtactgtattagtccattcttgcactgctataaagaaatacctgaggctaggtaacttataaagaaaagatgtttaattggctcacggttccacaggctatacaggaagcatgatgctggcatctgcttggcttctggggaggcctcaggaagcttacaatcatggtggaaggaggtgaaggggaaggaggcatgtctgacatggccaaagcaggaggaagaggagaaagggaagaggtgccacatgctttaaacaaccagatctcgtgggcactgtttgaagagaacaccaccggtaggtggtgccattcatgaaagccattcatgaaagatccacccccatgatccaatcacctcccagtaggctctacctccaacaccaggggttccaatccaacataagatttaggcagggacacaaatccaaaccatatcaggcactatgctcactacctgagtgacagattcattcacgctccacacctaagcatcacacaatgtacctttgtaacacacctgtgtatgtactccatgaatctaaaataaaagtttaaatcaagaaacatagctggcattaagtcaggatttaaaagaattttcatatttaattcccctttttcaatgtctttgaacatccacaggccctgactttccagactaacaatgatattctgatgccaaaacatccttggaaatattctttgttaaaaaatggtgtataccacaaacaagtatagacaaatggagatgtcattatcagaacagaataatttgaaatctctcaatattcttccattgaataactttgtgcaaaagacaatttcattcttcatgtggcataaacagcgaataagaatgctgcctgtcctcaagaatactattatgaaatccacgggatgagaaataaatgcaaaccaccatagtacatgcacatgagcatcgtaaacacagtaaaacgttatagtacaaatattacagaacaatccaacttaaatctaagataactcctttagagaaacaagaggttgttggctctctaataaaacatttcaaaatatcttaaaacttgatttcaagaagtaacagtatcaaggtccacagagaagacaaaaaggttatgccaaaaaaaaaatattttagggttctccattttgaaattataattactgcctgctatagcctgaatattgccccaaatcatgtgttaaaacttaatgcccactgtggtagtattaagaggaaacacctttggggaagtaattaagacatgagtgttctgtcctcacaaataaattatgcccttataaaagaggcttcagagagagtcattctcattcttttgttctcccacgtgagaacatcctccagaggatgccatgactaggcaccatcttggaagtagagagcagccctcaccagacaccaatcctgtagtgccttgatcagacttctcagcctccagaatttgagaaataaatttctattatttataaattactctgtagtattttgttacagtagcacaaacagattaagatactgccaaagtatgtaaaatcagtaaaatcatcatttagaaatagaaatgaaacttaaggtgataaacccatctatctatctacccatctatcagacatttagaagaagccctgaagtttcttataccaatgtgagtccataagatcatacaaatatcctgaaacactcatctatctcaaaacacccatcgtttagaaatagaaatgaaacttaaggtgatacacccatctatctgatcacatttaaagatgagaaagatgcattgtaacaccacaatttcctaccagtgcccattacaaagaacaggttaactgcaggtggactgaccaagcagttcctctggatctgtggtctaaatgaaaccaaatgggtacttcaagactgctcaggaatgcaggaggaaaacaaagccagaggactagcaactggctggctaccaccataggcatagacaccagaggttgtgcaatgtcaaaggcatatttcaaaatatcaaagtacctctctcagggaaataaaagatgaaggatgtcaagatctcaacttacagagcacaaaccaaacataaagcacctagatctttttgaaaagactaatgctacagagaaaggtatataccagaactaatctgctttctcagctgtcctgaccaggggctaggtccagtgtggtaattccaagtttgacaataaattttgatcttttcatcttttgaatgtactaagaaaaaaatggttagcaaacataaaaattggaaaataaagttcaagacttagaatatgaaaaattgaatttttccctttttcctctcactgacttaagaagaattgtgataaagctatatagtagcccacaatatctatctatacttgactacttgagtaacttgttcctctgtggaattagttgagacataaattatatataaataaataaataaatacagagcaagatgtcaccttggaacaaataatagctaatgtgaacaaatcctcccattaattccaaagaattttacaaagaatttccaaaatatttgataaacaagatttctttctccaatgtttttaaactgttagaaccagccagaggtccaagaagcctacttcattaggtatttcctctccaagtcatttgtaacaaaagtacataagacagatggatgaaggccaggtgcggtggatcaagcctgtaatcccagcactttgggaggctgaggcgggcagatcatgaggtcaggagatcgagaccatcctggctaaaacagtgaagcccagtctctactaaaaatacaaaaaattagccagacgtagtgactacacctgggtgcctgtagtcccagctactcaggctggctgaggcaggagaatggcatgaacccgggtggtggagcttgcagtgagccgagatcacaccactgcactccatcctgggtgacagagcgagactccatctcaaaaaaaaaaaaaaaaaaaaagacagatcgatgaaattccatgtttaacagaattcattaaaaaggtacacagcagcaaggaatataactaatacctctcaattcctaattcccacctacctctctcctcaaaaagtgtctctgctcgacagatggcatctgtattcacccaaatgatcaaaacacttaggattcattcttaactcctccctttactcacaaaatccaatccatcggcaaatcctaccaattctatttcaaattacagccatatcttgttttgctgtgctacgttttattgcaattcccagacactgcttttttttaataaactgaaggcttgtggcaatcctgtgtcatacatttttccaatagcatgtgcttgctccatgtcactattttacactttgataattctcacagtatttcaaactttttcattattattatgtcagttgtggtggtctgtgatcagtcatctttgttaccactgtaattgtttaggggaaccaggaccacaaaccaagcccatacaaaatggtaaatgtaatcggaaaatgtcatgtgtgttctgactgctccaccaactgactctcctccctcttccctctcctcaggcctcccccttccttagaaaaacaacattgaaattagaccaactaataacccagcaatgacctccatgtgttcaagtgaaaggaacagtcacacatctctcactttaaataaaaagctagaaatgattaagcttagggagaaagacatgtccaaagtcaagaccggctgaaaggtagcctcttgcaccaaacagttagcttagctgtgaatgcacatgaaaagttcttggagaaaattaaaagtactactccagtgtacatacaaatgataagaaagtgaaacagccttactgctgatgtggataaagttctagtgatctgaatggaagatcaaactagtaacaacagtgccttaagccaaagcctaatccagagcaaggctctaactctcttcaattctattatatgatggttgagagaggtgaggaaattgcagaagaaaagctggaagctagcacaggttggttcatggggccaaagtgaaaaaactatctccataacatgaaagtgtaagctgaagcagcaagtgctgatagagaagctacaagtcagccagaatatctagccaacataattagtgagggtggttacactaaacaacagattctcaatgtagacaaaacagtcttctattggaagaagacgtcatctgggactttcatagctgcagagatgtcaatgcctatcttcacagcttcaactgacaggctgactctcttgtttgggactaatcagctgacttatgtgagccagtgtttatttgcaattccaaaaattataaggcccttaagaattttgttaaatctattatgtttctgtgctataaatgaaacaacaaagcctggatgacagcacatctgtttacaaattggtttactgaatattttaagcacactattgagacctattgctcaaaagatttacttgtctttgagacagagtatcactgtgttgcccaggccagagtacagtggtgcaatctaaactcactgcatcctctacctcgcgggctcaagtcatcctcccacctcagcttcccgagtaactgggactatagggtatgcatcaccatgccaggctaatttttgtatttttttgtagagacagggtttcgccatgttccccaggttggtctcaagctcctgggctcaaacgatctgcctgcctcagcctcccaaagtgctgggattacaggtgtgagccaccacgcccagacaaaagattatttgcaaatcattactgttcactgacaatgtacctagttacccaagagctctgatggagatgtacaaggaggttaatatgttgttttcatgcctgctaacacaacatccattctgcagcccatggatcaaggagtaatttcaactttcagtcttattatttaagaaatgcatttttcttaggctatacctgccacagcaagtgattcatctaatggaatgaaaatcttctagatagggattcaccattctagattcatgattcatggaaaagggtcaaaatagcaacattaacataagtttggaacttattaacataagtttggaagaagttgattccaatcctcatggatgactttgagagggtcaagactgccatggaggaagaaccacagaagtgcagcctgaagataggactgaattgctgcaatatcatgataaaacttgaatggctgaggagttgcttcttatagataagcaaagaaagtagtctgttgagatcaaatctactcctggtgaagatgctatgaacattgttgaaatagcaacaaagagtattacataaacttagttgataaatttagcagcagcagggtttgagaagattgattcccttttttaaagaagttctacagtgagtaaaatgttagcaaacagctgaatggcacagagaaatcttttgtgaaaggaggagtcaaccaatgtggcaaactttattattgtcttattgtaagaaattgccacagccaccccaaccttcagcaaccaccaccctgatcagtcagcagccactaaaagggaggcaataccctctactagcaaatagattacaactcactgaaggttcagatgatcactggcattctttagcataagatatactttagttatgtacattttttagatataatgctactgtacacttaatagactacagtacagtgtcaacataacatatatgcacaacataacttatatatgcataagttatatataacttgtatatgcataagttatatataacttacatattcatgtgactcattttattgtcatattcactttgggatcacagtggtctggaaccaaatctacaatatctcagaggtatgcctgtatcatacaggcggtcaacttctctccattttctctgcccacacttttatccaatcctccaacatctctcgcctgactactgtaatagcctcttaataggtatattttctttcactattggctccctaaaatccatatgcagcaaaagtgatctcaaaccacacgtgagacaccacttccactcaacaactggcactaagaataaaactaaaactcatgaccaagtcaattaagcccctagaagatctggcccttgcctaccttccccccacctctcttaacgattctcttcctcattatactcctggcctctttccatcccttgaacacactaactaggctttttgctactttgaggtctttgcacttctatttgttctgcctagaaaggtcctctctgatgactttagatttcagttcaaatctcagctcagagaggctgcccggacctacatagctatcattccctgtcactctctagcacggtgcttcccaaactatctgtgatgaaggacccattgtttttcattgtcaatctgtcataaaacttttgtaaaaattcaataaaaaattttcttttaaaaatgtaactttaaaaacatataaaatacaagcccaaaattctcattatcagcattaacagtcaaaaaatctatcatattaccataaaagtctcttgttttctgtgtttataccattgggaaccattgtaatcagcacacaactgtcagcagataagactgtgacattgctccagtgtgccaccaagctaattcctttcacaatacttgccacactctagagtcgctattcatttatgtgttgatctgtaccagacactgttttaggcactggaattgaagcgatcaacaaaacagacaagatccctgcactcacagggctcacgttctatggtggaggcccagggaggataggctattggtcaagccgacaaggcaaagccagctttaaacttagatttgactccacggtttttcctgagttctgaaaaatcttcagcacttagctaagcagtgaagtatgccaaatgcatcctaatcagggaggaagaaatgaaagctgggatacaattactgaacaaacttaagttttttcaaagttgatatcaacaacaacatcctcctacaaaacatgcctgtggtcaccgccagctgcagcatattggcatgcatctgatccaatgtggtacttctgactctcatgtacaccaccatttcttcctcaaaactactgcactttacattacgtattctttgtattgtacaccaaccaaatattttaatcaaaataattacttctaaattggtacacattgagataccaactctgaggatccaacaatgtggaagagttaaacatcttcaacgagtgtctggagccaacaacaataaatacagttacagccattttactcattttccacagctaaactgcccagatgtgtaccaaggctgccctgtgtcattccaccctgtgtgcaagttccttcacccacatgtctcagatgagcagttaaaagagccacccaagatgtaatcaatgcctaaatactgccaccctagggccaagataatgttaaacctaacaaatccataacccaatttcctgaagcctcatcagcttgtgattaaaataaggtccccattcagaacacatcagcctcgtctatgtagtaaggctggggctgcaccctgagtttctagaatatgctcacattccttccactgtcattcaatcaactcattatctcccccaaaactctgcagattgttattattcccattttacaaatgagaaaactgagaaccacgcgtttagtaataattctcaaaaaataagttaacatatatttattaaattcttatattaaatacaatgttcttaccaatgagtcccaaacttggctaggcttcaagtcacccaaactgtagtgaacagagttgccaggtggttctaatgaagccaaactggcactaggaaccaatgaaatttgccatgtaaaaaccaagtgtacaaacagaaacataaagggaatgtaggaaaatgaaatctactcatttccacagcctatgcggaccgctgcaatgttttaatgtacaatgttaatagaatactgtttgtgtagcaattcaaaaatcacttcagatgtttatgttactgtaatcaggggatatttttaagtatcccttaaaattagcaaaaataccaattaatgaaatctggcataagtctacctactcaacttagctgattcccaaaataaggcaaagggcactatttaaagatttccattaatacacttgaatatctgaatcaacctggatgaaagaggaatctataacaagcccctacagttacttctgcagaaacaatgtgttcgctagcctttccataataaattaaacatgctaaaagaacttcatctctgtatttgatgtcccttccagctgccttcaagcatttgctctaatacacactgaagaccattgtttaggtatatttattaatttagagaaaaaaaatccattctgtcaagcaagtactaaaaaccacacaaccacctacacagtttcgcttaggaggatctgactaatcaaggtgaagaactgaaattactgagtggttatgtactaattctctcactgttggagtttaaaacgggtgcctaaaagaagtctgtatttggatttgccacattgcacaaatagtatatatacgtgtacatatatttcatatttataattatgcatgtggataagctttatactttcgataaaaagtctactattaaacattagtgattctctatgtttaaaaacaataaatgtaaaaactttaccagatcattaaaacatcctaaatgattcttgctctttagtcaatcgtatttcctattttcctctatattgtgtatattgtatgaattttacaatgacagagatattcttcattcatcagcaaagttcacaaaagaaatggatgagtaagttggcttcagctggtcctttctgcactgaggcaggaagatgtctcaggctggtgtgcaggtaaagcgttcctgtctcaggccaaggagtggcccctacctgtcttcagattctacttcacttctaccccactggtctgggatgaagtcacagtggcctacaagacctgtgggaagtacgtttccttcttttatcaccagcaaatgttcatatttctctcagtttggtttacctatggcaccaacagtcatgtcacaagcttgactctcatccaagcagacctaaactactccttagagaagtagtgagctctgagacaaaatgcaaaatggaagaaacacaaaaatgcctcctcacagtgttctatttagaaaaaatttacattgagagatacagtgcttgctatgcctcatttcacttaatccaccatgagatcctatcctatgagagtggtgccaccatcactctgcctactttccagaaaagaacattaaggtttaaatttgagaaagctttgcttaagatgacacatcaaacgagtagaacagtaaagacttaaaccctaggctgtgacttttgtctgcctttcttttactgcaacagacaatagaaaaatagcatccacattaggagaaaatgaagaaaggttttcacactgaaattattttattcaaggagactgttatttaaaaagggcttcaataaaatttctaaagaacaggaaattgtggattcaaaccaccactctcgtttcagaatcactattcaattcttgcctctaaaatcctaggaaacaatatccacaagtaatttgcctaggaaaggagaacagtcaagccttcagcctccttgcagagcattcagcttaggatggtaatgattagcacactaacccaggtctgttaataactgacaagtcaattccatacacatgcaggctggttctcaattcaggctgacaacctgctgcatcactgggggcaacatgcccaccgaggagggggactcaaagcatcaagaagcacacacagaggctcctgctctggagacagctggagtacaaatccggttattttacccaaatgctcagaaatgtctcctcagacacaaagtccaatttagctgaaatgcatcaatggccaaaaaataattttagctttcttattcaacaccttaattccaaaaccaaaggtaatttagcactgcctataaaaacagtatcagcaaccttcttttagtctccccagctgcctcatctgggatgtctgaaactatcatatgctggtcactaatccatctctccccttgagagccaaagggaaaaaatgctattttgatatggacggggattcattactgaagtaggaaaaagtagttaagaggttttaattcgtactctttgcagcaatgaagtatgttccaggtaatttcacttctaaagatttcaagttattgcttcatcgacaatggttaggttcctcactaagtgtcaggatatcaagatgacaagtcttgattctcaaggaatttactgtcccatcataatgataagccaataactgactgattataacatacaacagaagactgcgaggcaggcgagggcacatgttgcaaaggaggaaccatgaggccttctaagtgcatgaaatttgagctgggttataaggaatggtgggagagccacaggtgaggacgtggaagaggctgccatacccagaaacaacaaggtgggccctggagaaagatcagcagggtaaggtaagagaacactcaacagcccactatggccaaagcttgccatacatagaagagagagaactggggtgaccgtgtcacaaagctagaacacttggctgaagagctgaactcagtatcagaaggctgctctaagaaaacaaatttcatagttatatgaactggtggagaacactgaatccagtaaaaccaatgagactgcaaaataccaagtgagggttaataaaaacatggacaggaaagggacaaggatagataagaaaaatgaaagagacagaacacacggtgactggtctgagggaaaaaagggagcagaaaactgttcaaaggcaactggtgttttgagtctgggttacagggaggttagccaagcaaacaacagaggtaggagtaggttgagaggaaggagaccgtcaggggtgcagatgggttgttttacctgtggtgactttcagatttagggagagatttagagatatcaaatggacaactggagatgcaggagaatcttatatgcggagggttaatttttcagtccataatggtgattcccaaatccatatgaccatcagaatcagctggggaacctgtcctcccccaaaagtcccaccctaagaaatcctaagtaaatctgggatggggcccaggaatcctatgatttagaagcccagggtgggagccactgccctctgtgctctgctcactctgcacttcataatctcctgccttcatagttctgaatatacatccagagcatttttctgggggaagggacatttgcagaatgtgaaactagtacactgctctggaggattggaagcacactctcacatttgaaaataattacttctcagtctgtattctacccgttctggggaatggctttgatatgctactacataactgatggtctaggtcggcaaagtaacaactactacaacacagagatcaattctgctcaaacttaaagtgaccaagataactcatgactccaggactactgggttggtaacaatgtgtagtaagagcgtttctgttttaataatggagcgcagtgagattatggggtaactcgtggtatcaaatgtgaaccttttatagactcctggctccaagtcctttcactactcccatctccttttccaccccatcaaggtgagatcattaagctcaggaaggcagctcagccaacggaaaacattcaaccttcaacttttaataaagtacaaaatgcttttattttatattttatttctgaaaataaccacatcagggaaaaaagagcaaatgtggaatgggaacctgacattgcaaactatgggaattttattttttaaacgtttctaataaaagcaaatatagtttagtatgactaaccctaaccccattttgattgcttgttttctcacttttgtttaaaaaaatagtaaaaggaaaccttttatgcactcactataatatactgtgaaattcacataaaatttctcatttaattctcacagttattctgctctgtaagtaatctcatgatcctcacttctacagataaaaacaccaaggctcagacaagtcatgtttttgctcaaggtctcacttctcatgggggaagaactagaattcccacccagtgtttcctgaggtcagtgtcctctcggacaggaccccaagaggctgccacaatttgggagagaatacttttttctggattccaccagcggccaagttacctcaccctccctgacacagcacatgtttttttgcaaaaaagactgcactctcttggggaaggaaaccagtggcaccatcctccacttggcagcacctatcactgcctatcacaaagaaggttcttaacagtcctattgatggcagcagggggctgtccacggcaggggaggcgtgggtggtggcgggaggcggcagcaggagcggctgcaggagcagcaatggcaaaggtgggtcccctgtgccccgtgtccccaaggcagcaaactgtgctgcccccaccctcatgtggccaggcaggacccgctcccaggcctggaacatcagtggctccggaccctagccccacaccaccactctcacccacaactgctgcggggagggcaccaggaggaggcagcactgggggacccagggcgggagggggaaatgggagcagtgcccactacagggacccagccagtggtgcggtcaccacgcccactgcaccaagggtgccgtgttcttgcgcccccagagaggactctgcacagggccacccacagccatgtccccaggggtccgccccgcatggggtgaccaccgggcctgacactcccgacccgctatccgctcctggaggcaccccctggggaagggccgcaagcgggatgagggggagctctaggctgcccctgagtgcgggggccacgggggagctcacagtgatgtccctggacaccagcccaggcccagcaaggacctagagcccccaggctgcaagggggcacagctgggacttcccgcttcatggaaccgggagccaggagcaggcaccagccctgccctcccagacacatctgcagccgcccaggtggggctgtggacccgggcctctctgcactcttgggggccctggaaggcccccgccttgcccttgcaggctcggaggtgcctacctccactgtctggcctctccccgctccaggcacctgctatgatctccgaatggggttggggccaagccggggagctgtcacagcccagccaggtatgtgagggtcctgccacctcagctccctccagactctgtgtgctgacaagcatgggatgtggaacctagggggacactgagagcagcttgatgctggcctgcaggtaccccatggatgagcagcctgggtaccacagaccatggcaggaagcagacaggctccggggtggaagggggtaggtccctggtgagaccccaccttcaggccagggagggcatgaaggctgggagccaggccaccagtcccacagaccacactgcaggcttatggtgacttttctgggcctgcccatgaccacccatggaccaactggcacacacttcctccactctgaggcccataaaagccccgggctcagctagagcagggcaggggatggggagaagatgagatgaccagatgcagagaggagctactctctctgctaagagctgcagagacaatgggacaagctgcctacagagagaagccacccactctagggcctcctctgtgccgacagctgcagactacaggagctaccctctctgctgacagctgaacacttgttgggatgaccagctgcagagaggagctaccctctctgctaggagctgaacactcatcgggacaccctggctatggagaggagctgcccactgtgggtcttctctgagctgttctattactcaataaagctcctctttgccttgctcaccctccacttgtctgcgtacctcagtcttcctggtcacaagacaagaactcaggacccactaaatggcaaggctaaaagagctgtaacacacacagggctgaaacatgctcctcactcatcaaattgcaggtgaagaggggagaacagctgtggtccttcaaggagccctgacctgggagctccccaagccagggctgtgactccttctttggggccccatggttcctggcatctccaagcttctgggagccattgcattccttggtgccagctggggaagctgtctgcagtgcacctggtccagccgcagcctcacagagagccagtgcccatgctggcacctagagctgacagccccacagcagcagccagcatgtctgactgtgcagtagcccaaccccgcactcactcacacacgtcttgccagtccacgcctgactcagtctcccttggaggtgtgggatccaggccggtaccatgagctaagtgcagcctgccaggccaagtgggaggaacaagcccagcaggcccaaacaaaagttggacaaagacaccactggccacagctttccaaccagaaaaatgacaccccaaagatcctgtaacactatttccagaaagtggcagagaaatgtgctagggcttaaccattggctctgatagccctcatcccaggatccctaaggagggttttgggaatttgtgaacgtttcagttgtcacaatcactgggggatgctactggcactgagtgggtggaaaccaggaacactagaggtcctaagacacccaggacagtctgcacggccaaagacttctgcattcctcacaacttcctcaagtcctgctgaatattcacgtgggtaaaaaacctgtttataattgtctgagcgtaaaacctcactcaagttattacataggcacaacgtatgtgttacaaagtatgtgttaaacaggaagactaccattttattccaaatttaaccaaatttgaccatttcaagaaacaatgacaccaacagcacaccaccagtgcttgctgagtctccactgccatccacgtgccacagtctgcatctgcagctgccacagcagggatgctcccaaagtgtggcctctgagcagttcctccacaccctaggcagcagggtctccacatctgaatactgagatgcaagttctcctggcaaacaacttgcttttcatttcctttttcactgtcataaaaagggtatatggatttttttaaataacatgtgtaattaggatatgttattcacaaatttcattttaggattgtaaaggtggcaaatacacatgaaatagccagatggattcctggaatagtggaagcttagtgaaaatgctattttttttttttttttttttttgagatggagtctcgctctgttgccaggctggagtgcagtggcgcgatctcggctcactgcaagctctacctcccaggttcacgccattctcctgcctcagcctcccaagtaggtggaactacaggcatccaccaccacgcccagctaattttttgtatttttagtagagatggggtttcaccatgttagccaggatggtctccatctcctgacctcatgatccacccgctcggcctcccaaagtgctggattacaggcgtgagccaccgcgtccagccaaaaatgctatttttttttaaaaaaaaagaagcattataaatatgatgtgtctttctcaattcagcatgatgtaagtcaagttaggtagttcccatgcctcaggaaatcctggcttaatctcagctctgtcagcagtttggactgtgtgtgtgtgtgaggggaggaaaaggcatctattgattaaggtgcttctgtattctccattgagttcttcttgagttcaaggttaattttttaaatcactgtaatctttgaatgttctttaaaagaacattaaagcagagagaaatggcattataatattcacaatacaaaaaattaagacttgtaaagaagagtgaagaaagttggggaaaatatgcttcatgattcttaaaggtcgattcctcatggaatatattttaaacatacacacatacatatatagttgtttaaacccaataaataaacatttcagctaaaagtattataacactaaattatatctttaagcatttttaccaattttacttccttactttatcaatcatgtttcacatctctaatttctttatcattataacaaatttcaatttttatatcaagataccaatataaataaaagacaattaaggttaaaaagtgctacacgcacacactttttggttattttatttcctaaacatggaagaggggaaaacacaaacaatttcttccacacgtgtcacacacagtaaacattctttcaaatcacgtcagtttccttgacaaaaattaataccttaataaagatccattgtttaaaactcttggttaccacttggctagccatgcataaaacaggacaattagtacagtcaactgaacattatcaagactttcagacacagtgacactgttccagccaagcacagtagtgatgttccgtgaatgctgctctgtcagccacaattaccccttaaacagcctttggaattatcagcctgtactttgctaaaaagaaaaagaaaacattattttaaataatatcaataaaaatctttgtttcctttctgaggtaattatacacacatgaagttagcaagggtaaaatcatagtaattttaaaacacatgcttaaaagcttgcatcttttctccagtaaaagctttaaccagacttagtataaagaaaaaacggatttgaatttcactgtcttttcctttttcttcttctgtagaagcgatagtacttaatgattctgttcaaaaattctgaagcaaaaagacctagacaaataggaaattagacgttacatttttgaagaagtgttttattttccattattccttaaggctatcaggccaaaaaaaaaaaaatctattccaagaactctgtgattcaaatataaaaagtatgagaaccaaaactgagatgctatgccttggtctgctgagaactgtgataattttcttgaactttgctgcatatatattctaaagtaaagcaaatactttgacattttattctttttatcctaatgtaagtggaaagctacaaagcaacttccttttcaggggataaagtaagtttttaaaagccttctttggaaataattaagtccataaaaattacatgttgatttcttaggtattatgtgtccttctttttttctaaagaatgaaggtataaaataagacaatgtaaaccatggcaacaaggttgggtatggcagctcatgcctataaccccagctctttgggaggccaaaccagaaggctggcttgataccaggagtttgaaaccaccctgggcaacataagaaagaccttgtctctaccaaaaaaaaaaaaaaagttaataaaaataaatatataaataataaatcatgctgacagtttaaatttcaacagtgaagttaaacatctatctattaatttcatttgcaactgtggagagtatatgccaaaataaatatatacatatataagtaaataatcataacatcccaagatgacaattggggactgatttcagccaaaacacaaataatgtctaagtttttattttattaagcaaaacataagtttgtgcccaaaaacttacaaacattagtaacagttcaaaacagtcaatcttctactttagcattctaagattgtgtaaaaaactagataaattattacaatggtttatattaaatggtctccctgaagtacaaagcaactgcaaaactataattatcaaggactaaaacacgcagatgctatatacttgagccacctggtggtttatttccctcactgcactgataaacacctagtgctatgcacacaaccttaattagactctacaagttttacttttggtgccaagaccagaaagagtttacttttaccaaaatgtagtaatagtgtgggtcacaaggcacaagtctacttggaagcacttaaaaagttcactgttgctaagtacagaaggcactcctgaaatctaccatagcaggtctctagaactgttttcttatgtttttttctacagtgtttgatgcctacagtaaacatagaatccaaaacaaattcaaataaactgcagatcatgcctcaggtttgcttgtggtttctttacctcttgcctagttctggacagttcaggacagaccacattaacttttaaaggttgctgtcttaactgtcaagcaaggtagtaataggtgctcagagatgttggttaaaaaacacaggaaaaaaagttaaacaaaagtacactctgttaccaagaggaaagctgcagaacaccaatctttgtgactctgacttcaaattagggactcttggggtgatcaagatttttatcaaagcagaatgtgtccaaagcatacctttatcttcaagcttactagcctaacagctggagtgcattagacaggagccatgacaattctaatgataatggtggtgatgacttgattctaaacggatacttgtcaaaaagccagtgaaaatttaagccttttaactagtaaaagggttgcaagttaaacctctgtgtccagcagcagtcccacacccttcctaggagaagcaacttcctcaatttaagtttcaataatgtcttatgtgaagaacgaataaagtcagtattaaataatgtcattagcaaactgacacatccattatgataactgttcccattactggctttagtaggaggtgatgccagaggctctcccgcaccataaggcaaagcgcttcatgtccctgactcatccaagcgactcaaggccgcccagctctccaagtggaaacactgagtgggaaggaggctctcaaaggatgcctctattcctcctcccgcccaggttcttggtggagggtagatgctattaaaagactagtttcctgaggaaggtagatagtttcagggaaagaccatttggctggaaggaggaggctttgttgccagctgtttctccagctccactgcctgtgtggtcccaagtaagttgctaaacctgaccacgtcaagggccaggtctataaaaatgatgacatttcccgtaaaagggcctgcctggccctgcaccatttgccttcacaagggagcactgcactagagaagctctggctttgctgtgaacaaatcaaaaagtgacacatgggcttggcattttcctccatgcaaatcaaagtatcccatttccctgaaacactttaacaggataatatggctttaattttccacacttcctaattctgggtgctaacaggacacagccgccttgtgagagaaacaatggcacaagtagggatggcaaaggaagacacccctctcatggaagccacgttctcacagaggagcccattctgcagggctaaaaggcagattttactttctgtcattcatttcctcaagctgttattgagaaacaacacaggtaccagtggaggatgcgtgcattagagtcagaaagccaggtctccccaaatcccatctctatcatttaccatcggggagacactgtacaaagtaacttctctgatcattcctatccccatctataaaatggaaatgatgcacatcgtgccacaggcttactgtgaacgaatgatgggaaagtgtgtgaaatttactaaaataagcagccactggaagggagcctgagaccaggaccagccaatgagaaaagtaacgaagaatgcagaacttgcagcaggagctaaagggtaatttcctggccatgatgacaaatctggctatgtatacacagatgcatatgcctgtacacattatacagatacatgtaattcctgaagaaggggctgcctgtcaacaggcatatcctcacttcctgcctcaaaataggaaaaaaatatttgttaggaaatgaaatacatccaaaatatttgagaaagggtttgaggaacatcccataaaccaatgtaccttgtgtccccttcaattctgtttttcttttctaaaatgtcaaagtatgctaagactcttcaatgaccaaaaggtccaagtttatatgagtttttaatcatgttccagagatcactggataagaaacaaataaacaaaaaaaaaaaaacaagagaattaagcaataaagaaaagtaatgctgcagagaagaaatgaataagaaaaatttcattttactgctacgaggtattttacaaaatcagaaaattatgtttgcctgtgcgaaactggaaaatattagaactgctgaaacttctataccacatcagacttctcaacaagttcaagaaaaactaagcattttgaaatgcatggtgtctggaatagaaagggtagcaattgtggatcctaaaccagaagaattatactagtctatctacagaggtgtctctagcctagctctaagaccacaattggttagaatgagaacaggtagaaaacagaccattcataaagtcaataattcaggcttggtaatggcttacagctttgcttatgatgtccttatatcaagtgtttgccattgctaacctaaagagaacatacaactatctttatacataaagctgaatctctaatcatctacccattttcctatcctaaaatatttcaaaatgtaattccctaattcatattaaaaacttcatattcaacattattcatttcttattggacataatggtataaatatttagactaatttaccttttgtttttaacttcatgtccacaatacatggtggtgtttactcattaatcaagattttcctaaactccatttaatgaaaatatttagttttatggatggcaacaaagtattatactcaaatatctctgttggaccttaacaggaacccaaaataaattaattctctgacacaacaactcacaggcagccagaaatctttataaaatacaaatcaaatgtcattccattggcttcccatttctaatggaataaaatataaacctgatacaatggcctacacaatccatttactttctgccttcaaatgcctccactctctgtcctcgctgctctccccactcactgctccctcccctaaatgtactgccactttctctgtgttctagaatacagcctactcaggaccttggcgccatcttttccactgcctgaaacccttcctcctctccattttcagctcctctgaaggccttcttaccaacaacttaatgcaatgccccaagctcatttcaatctctattcctaagatgattttcatggctttttatcatttgttgaaattattagtatcttcctttatttcagtcttcttcattcaagtatcaacttaaaagcagaacacttgtctgcttgttaaccacttttcagcagtacctagaaatagtaccaggtacagagcagatacaggaatatttatcaaaaataaataaatgagtgagaagtctaagaattaaggatttctaaaagataaagcctacaaacctaagctatatatggtaaatgctattccataccatagcaaattagaaacattacaggattgtatgttatacatatgaacactgtgatctggaaatctctgccttgtacaaatagctctagaatatattcattcatttattaaacaaatatttattgcacatccactgtgtcagatattattctaggcagcagagactccagcagtaaacagaacactctacactgaggaagtttattctgtagacaagggacacagacgagaaacaaatacatgtgccaggtgatgaaaagtgctataggaaaaaacacagcagtgtaagagagtggaagggatgggagcctcagtagaagatgacatgttagcagagaggcgaaggatgaagacagaacaccacatgcacatccgagatgaaacaatctaggcagtgagggcagcatgttagcagagaggtgaaggatgaagacagaacaccacatggacatccgagatgtaaccatccaggcagtgagggcagcatgttagcagagaggtgaaggatgaagagagagcaccacatggacatccgagatgtaaccaactaggcagtgagggcatcatgttagcagagaggtgaaggatgaagagagagcaccacatggacatccgagatgtaaccatctaggcagtgagggcagcatgttagcagagaggcgaaggatgaagacagaacaccacatgcacatccgagatgaaaccatctaggcagtgagggcagcatgttagcagagaggtgaaggatgaagagagagcaccacatggacatccgagatgtaaccatctaggcagtgagggcagcatgttagcagagaggtgaaggatgaagacagagcaccaaatgggcatccgagatgtaaccatctaggcagtgagggcagcatgttagcagagaggtgaaggatgaagagagagcaccaaatgggcatccgaaatgtaaccatctaggcagtgagggcagcatgttagcagagagatgaaggatgaagacagagcaccacatgggcatccgagatgaaccaatctaggcagtgagggcagcatgttagcagagacgtgaaggatgaagacagagcaccacatgggcatccgagatgaaaccatctaggcagtgagggcagcatgttagcagaggggtgaaagatgaagagagagcaccacatgagcatccgagatgaaaccatctaggcagtgagggcagcatgttagcagagaggtgagggatgaagagagagcaccacatggacatccgagatgtaacaaccatctaggcagtgagggcagcatgttagcagagaggtgaaggatgaagacagaacaccacatgcgcatccgagatgaaaccatctaggcagtgagggcagcatgttagcagagaggtgaaggatgaagagagagcaccacatgcacatctgagatgaaaccatctaggcagtgagggcagcatgttagcagagaggtgaaggatgaagagagagcaccacatgcacatctgagatgaaaccatctaggcagtgagggcagcatgttagcagagaggtgaaggatgaagagagagcaccacatgggcatccgagatgaaaccatctaggcagtgagggcagcatgttagcagagaggtgaaggatgaagacagaacaccacatggacatccgagatgaaaccatctaggcagtgagggcagcatgttagcagagaggtgaaggatgaagagagagcaccacatgggcatccgagatgaaaccatctaggcagtgagggcagcatgttagcagagaggtgaaggatgaagacagagcaccacatgggcatccgagatgtaaccatctaggcagtgaggacagcatgttagcagagaggcgaaggatgaagagagagcaccacatgggcatccgagatgaaaccatctaggcagtgagggcagcatgttagcagggaggtgaaggatgaagagagagcaccacatggacatccgagatgaaaccatctaggcagtgagggcagcatgttagcagagaggtgaaggatgaagagagagcaccacatgggcatccgagatgaaaccatctaggcagtgagggcagcgcgttagcagagaggtgaaggatgaagagagagcaccacatgcacatccgagatgtaaccatctaggcagtgagggcagcatgttagcagagaggtgaaggatgaagagagagcaccacatggacatccgagatgtaaccatctaggcagtgagggcagcatgttagcagagaggtgaaggatgaagagagagcaccacatggacatccgagatgaaaccatctaggcagtgagggcagcatgttagcagagaggcgaaggatgaagacagaacaccacatgcacatccgagatgaaaccatctaggcagtgagggcagcatgtcctcactgcacagtcgagtaagcacagtcgagtaagactgctgccaatttctttctatttttttttttttttacagatacaatcttctctgacattgatatgcttacatgtctggtttcaactcaaatgcttatttgacaacctcttaattctctccgtgcctcagttgcagaggaggggacaggctgatggaagagaatggagttaattgatggaaactgagtaaggtgggaacagtcacggtagctcataggctcagagactggcctcgtggcctatgtcctggcaagggaagggagctactgcatgaaagagctattgaatctgacatgatgccacgtctgttgtggtttacctggatagaatgggctgtttctgccttgaaatgcctcctgctgcaataaagataagctatgaccctggttctggaccacagtggagagaggggatggagcagagacggaaacaaagaaggttccagattgtgagcttggtcctaaagaagcagtcatggcatcttacacttgacagggtctgcagaaagtcaccctgaatcaagcaataaaggcgcctgggtctgggctgtgcaccccctttggccagaagtatcctgccacattttcatttgcaaggtttctaagaaccgttcttggtgtgtcttgaatggctcatacttgttaactttacaggaatgtgtgttcataggaagcctgttaatcaaattgccaacataaattacttttcctcatttttgaaggcttgtccaattaataaaaggccgatgcttatgtactggagttactttaggccactggggggttggggggtagttaacgtttattgattcaatgtagtttttcctgtcactttgaggacatttattcaattttgaaatgaaaaatgatggtaaaattggaaaaaaaatatgtaagaaacttatgaaaaacaattctccaatttaaaaataatacggccttccctgtcgggctttgctgccagctgttatttaaacttgtatgctcctgcctagtgagagtcagcagctgagagtcttgtattagcaggaaaccagggcatttatgatggagttcctgttattgacttattcttagacaaaatgccaagtttctttggacagtacagtaggcccactgtggaagcacagtgtgaatactggtgtgacatttaggctatgattttttttttatgtgtccagattttttaaataacttttaaaacaatgttttctgtaatgatttggagacagtggttaacactacgaaaaaaaaatgtgtttttaaaatagaatctaactggtataccaaagaaatataagtagtttacgctgattccaataactctaccaggttttcttcacaggtgggtacattttagtagaaaaccttgctgtaggctgggaggaaggcaggtgaaacatcatcgcaatagcacagggaatgaaaactgtaaatgatcacacgatttcacatggaaaaaggcattttgtaagactaaagattattgtagaccaacatacatcagcatttaacgttttccttaattgagggtgggagggtgtgatttcccttgaagctaagcagaggtatctctggaaaacctgactttacaaattttcttaatttgggtgactaacattcttaaggaaacttatttcaggaaactacaaaactagcatcctagttgtctttattttgatagggttagggatagggttaagattcacaccattttctctacatgccaagtatacatcatcaatcaccacagctgtgggctggtctgtgatcgggtcattttcccggccctctttatgtttgcctttccacaggtagagttaatttttttaccaagaagtgctcctgcccactttgtcatctcccttcttcccccaaatcttgtccaatgctctctcatccctctactactgtaatgcaacaattaaatagcaatgattccatttactatcttcctgcatacatcccttatgtgtaaaggataccctttcactcattcaactaatatttaccaaatattgctcatgtgccaaatgctgctttaggcatgtagggacagtgttatgatacgaagtccctgcatttacaagctcaccttccagagctgtgctattcaatacagtagctactaaccacaagtggctacttaaatcaattaaaatgaaataaaattagaaattcagttgtgcaattgcatcagtcatatttcaagtgctcaataactacacgtggctagaggctgttatttcagatggtgcagaacggagcattcccatcattgcagaaaattttattggccagcacttccctagtggacaggttacctttatcactgatggttttgaccagtttacaagaccaaggatcatcatataatgtccctttcgcctactggtaaaaggtggcaaactatttagctccacaacttgaccacagcactcttttttaagcccatgcttgtgttaggggccatttttctgttatctcctacataattaccataatgctaaaatttatgaataccatttgtttctgtaacaaaagtcaatctatactatgtgtggtttgatgaagaactttttctaatattgaattttttttacgtctaaagttttacaaagaaaaataattatgacatttattgagcatttgctgtcgctggatattgtcctaaaccctttaacagagtttttctcacttaattctctcagcaatcccaaaggtggatgttaataacaccattttacaaatgaaaattttgaagatacagcataacttggttaaagccaagttatcagtggatagttgcaaagctgaagcaatcaacccagagctgtatgttctttgcttttaaatgctactattccccatcctctacctaagttcaccattagttgcatataaaactcccccattgaaaagttcatctccttaagttcaatcctgtagcaaatcccacacatcctgccgccttcttaccatgtcctctaatccaaagcacactgtccttgtgtccagactattctaacagcctcctaactggtctcccttcttccagcgtggccctctggagtagcttctataaagctgccagaatgaggattacatcacaaatcagatcctaattcttttctatttaatagctcccatttgtttccgattccaattagaatgacatccaaatgcctacattcttacaagtcctgcacaatgcagcccttgcgatatgcagagatgttaccaaagaagttcttatgctggagccactgcatctctgcttccatctcttccatctacccccacagattgctacaagttggactctttttcactcttcagtccaagccttcagggtgtgtgtgtggggggggaggggggtgttgtaggcttttgtgtgtaagtgtgacagagaggtttttgataatgatatcaatttctttaatagatatgctaccacacgtgtgttctgtttcatgataagtcagtttaggctggttgtcctttttcaagcaacttgtccatttttcactgtaacagtttggtggcagtataaaagcacagacggctgggtgcagtggctcacacctgtaatctcagcgctttgggaggccaaggcgggcagatcacccaaggtcaggagttcgagaccagcctgaccaacatggagaaatcatgtctctactaaaaatacaaaattagccgggcgtggtggcacatgcctgtaatcccagctactcaggaggctgaggcaggagaatcgcttgaacccgggaggcagaggttgtggtgagccaagatcacaccattgcactccaacctgggcaacaagagcaaaactccatctcaagaaaaaaaaaagcccggacatccaactctgaaatgagttttcccattcaagcaaagtgttgttatctttaatatcggatgcttctgggttctcaacccaagtggagtgtggtcagactccaggggtgcctctgggaggctctaggaggcactgaagacctatgcccactccttcataggtctacttgtctcttgcatgaattcatgcatcttttgatgtattcatttgtccattcagtagtaaataagaggaaacaagttgaacagagtccaagtggttattttcatcaactttgtcaaactcaaccatcactgtcacctgaccaacctcatattcatataccactttgagtatcaagatgcagaagaccatatagcagtggttcttaaactttaggctgcatccaagtcactcattcagactgctgggccccacccctcagagctctggcttggtaggtcaaaatgtgggcctaagattccaaacaaattcccagattgatgccggtattgctgatctgaggaaacactatgggaaccactgctttaaagtatttccaggtatatttgtttaggaacagtacagatgatattccttagtctgaggatgtccttacctgttatctgaaattactccagcagtccatcagagccatgaagggagaataagcacaggggtgaactactgaaaaccacactcccagaagtcttagtggtggtattcacagccatgccatgaggtcagagaaaacataagttttacttataaggtcatgaaaacataagctttactctattaggattaggtgaagctgcacataagttagaatccaacacacatcatgtaaaagaagtctgatggtagccagtcaagaactgctgattacggggtcaacaataatcaatgacctaggtagcctccttctatatctggcttctaccctcaagtttatgtcaccaatgaaaactgctgctggagctccagacatcacatccatgtaccaagaaacagaaaagcagaaggtaaaggcacaggggacatgtctcccaactctcaacttcctttaagcaggctttccagaagttccacaaagcactgtcacttatgttcattggccagaattgaatcacagtcacatttactgctaaggaagctggaaaatgtcatcatttaattaagctcagtgttcaccccaaataatatagggattgtatttttaaggaggaagtgaagactaactggttgtccatgccacaatgacaacaaactactgagcttataacattagagtttagaattgtaatcaaacttacaaaatctgtattggattcaaattgcccattaacttgtctgcattgttcctaggacggttttgttcctagcacctagcagatgctcagtaaatatttgttgaaggaatgaatactacccctaagagcaattcgcctattgttacgtaaaaataaaagtgattctcattttagatcaccccttcccctctggaaattacagtcctgcccatttgaagtttctgcagggaagactgtaaggttaacatggccacaggcaattttcttaataactaagggacacagtaaattcctctcaacaggaaaatattgagaagatttctctaaaacaggatcttgagaaccaagaaattaagcatatatatgtttgccaagttagtagctttttccaggcatatgaaaaacccagtcaggaaagatgaggtggaaaaggcagacaggtattcccttcccagattagaaaagttttacttataaggtcatgaaaacataagctttactctgttaggattaggtgaagctgtgcataagttagaacccaacacacatcatgtaagagaagtctgatggtagccagtcaagaactgctgattacggggtcaacgataatcaatgacctaggtagcctccttctatatctggcttctaccctcaagtttacgccatcacccaaaactgctgctggagcagtttagattagaaaagatttatccatcattttcaggagacttgttctgttaccagctgcatcacagctgaacagtgcagttagcttatctacattcaatattccgttttacagatgacacaattgtcacaaagaaaggctaagcaactcacctaaggataaatatcaaatcatagcaaagctaaaaacagaagctactatttctgatcgccagtccatactttttacagtcacaggaaaattgtagagtattatatacaagctgtacagacaattttcccacagcttgcagggccacaaagaggtggtactgatggaggcccacatatgttagatgcttctaagaaactgtctgcataattattcaaaacactttcccatagatttatggcagcccaaactgtggaagagctcaatgtagctgaaatacccgaaggaaagtaaaagcactttagaaaatagcttgcccaagatgtggtaatttgagaagccataattttagaaagagcatgttttactattttcttcaagttaaacacattttgctaaacgattatcactaactgaattctaaggccggtacagtgggctacattaaaaaaaaaaaaaaaactattaggcaatctaatgttctcatcagtagcacaggtaacaactacgtgtctgacccaagctgtcctgtccaagcataagagcaagaatattaccaaacttaattctcaagctcagttttagaaacctcttccatcacttcaagaaaactgttttggatccccacctccttcatgttaacagcacatggttaagtgttcagcagggcattgcaaaataaaaaaagaaatcaagatttattagataagcccatgactccataatcagacttcttataacatcttttgagattacttcctaactattctggtgttaaaatatcctttattttaaatgatgggaacccaaaatacacttggttgaaaaaataagagcactggttgccccacagtgaacctgaaattagtacatactgtgggggtagaggctactagttaaggaaataaaaaagtctgggccactgaacacaatgtactctgcagatctgatgttttaagcagcctcagctcaatggcaaatgccagaactggctgactagctcaccttccccctgcagggggagtagtcccgcacaataggcaggtgttagccaagatgccttgaccacagtgggtactcacacacctgctgtcagttttcaagtgccaagtcaaaccttgcatgtaatgtatctctaatacacatacatacacatacacatacacacacacacacacacacacacacacacacacgttctctctctctctctctctctggactgaattctagaaaacttctgcttattttacctatgtttagcattatcaaacgtgcatttataaaacctctagaagccagtaagtggccctaaaaaaggacacgtaagaaaaaataattttaaaattgggaggaaaatctatcttcggggttctaatacgatttaccacaatgtttaatgctaggcttaagacagattcttaagctgtttcagataaaccaagaggctaacagagcccagctcacactaccatggctgccaggcacaggaagatagaacacacactccttacccaaaggacccaaaacctagcgtgaaatgatccgtaaacaagacagccttaacatatagaaaggtgatatattctgttgtatgtaattagtgaaaaagataatcactattctacactagagaaaacaaagcttcatataaataaattttctagctactgaaagtaaccaatttagctcctgagtgcctttattataatcaacaaatttgtacagaatatttcaaaaatctatttcctactttccacagattgcattttaaggatgcaagctctgaaaccagagtgcccagttagcatcccaggtccaccacacaaggcaggccaagttcatctccataagcctcagtttctgcacctaccttagcacactgttaaaaggattaaatggcataatgcacataaaatacttagaacacttagcctggcaaatagtaagtgctcaatatattttacctattattaagaaaacctgtagtggtcagggtttgttaactaccaagttatctaacaaaatccccaatgtgcttacccatcctttcctggtgtaacgcagccccaggagtgcctcgagaatggacgggctaagacatgagtatggggttcatttcagaccaatgagacaggaaaggaaatcagctaggggcttccaggaaaggtctgcttactcccaaggtgggaaaggaaatcagctaggggctcccaggaaaggtctgcttactcccaaggtggggtaagagacagacagaggtgggccatgggcagtggtgtctcctcctgaacccgcatctctgggcacggcacctggagggtctacacccaccctctgccctatcacaccacatgtagttcatccctttcacggcacttagtgactaacatggtttggctctgtgtccccatccaaatctcatgttgaattgtaattcccagcactgagggagggacctggtgggagataattggatcatgggggcggatgtccccctttctgttctcgtgataatgagttatcatgagatctgatggtttaaaagtgtgtggcacttctcccttcactgtttcttctgatgccatgtgaagatgtgcttgcttctccttcgcccttccaccatgattgcaagtttcctgcagcctcccaggcatactccctgtacagcctgcataactgtgagtcaattaaacctctttttcttcataaattacccagtctcaggtagctctttatagcagtgtgagaacggactaacacagtgattacccaaaacagctctggtttgtttacttctgtctttcctctgccaccacactagaagagtaagaggaatgttttttggggatgtgcattactaacgccccttacacacgtacttgacgtctggggccatgtctaccacgttcattcccacctgaacatagtgggtgttcagcaaatacctgctgaagaagtaataaaataatctcaagtatctatttgttttccaaatgacatctgcttatttttaatgtgtataacactttcaattactttctcctacaattctctaatttgcatgttaaactttagataagactaattaatagtaacatctgccctatatgtttttttaaaaaatagaccctacatcaaaagatgttcaaaataaaccaaaaggatgctcaaataggtctatttgaaatgctcaaatagtctcactcctctttgtagcaagatcttccccaccaaaaataactagaaaaaattttttaactcccaaagaacacgtaaggcaggaaaaaatacgtatttcatgttagtagtttttaaataatctatgccgtagggtcagaaaacagacattagtgagaatgagcccagaattctaaattcccatgaaatatttattcaatttgaaaacaatgttaccaagtttacgacttccagtcttttaggtgagccaaagtaggaactaggtactcttgtaagacattatacataaaagccttccaaaaatatgactttcctatcccttttcacagtttcgtcacctaaaatttaactaaaccttcaacaattggtaataatttaacccatctctttttaattacagttcattcaagtaagtaaatatagtataactgtgcagggaattttaatgtcatagtacctatttgtttttaatttagaacctgtgttacatttctctgtaattcaattgattaagaagccaagtagatgtgatattttgtgatatgataaagaaaagttatactacttcaaacctggagcttttaacatatgaattcaattataaaatagcaatatctcaactaactcctgcagtggctctactgttattttctacttgggaaagttaagagttcaagaaggtctttgtcaaaaacttaagcaggcaagcatacagacatgttaacaattcagaatccacccaagcttagacaaaacactgcttcaagcagcgagcattgcaggaccaacatttcaaagaatttttcctaaaaagaaagagcaacaaaaaaatcaacaggacaaaacctcaaaaacattacaacaatttttagataataatacaagttataggatattccttatgtgcttaaaatttacacttaaacaatacatattctctaactgcacagccccaaacccatgttttgcaagggaataaaaactataaagttattaagaattgctggagaaaacatccttagtggtctttgtgttagaaaggacctgctttctttaattatcaacttttccacttataccaaaattagattaacttgtaaaaaaaaaaaaaaaaaaaaaactaaattagaaacattgagcttactacttgaaaacaacatgacattcatttttcacatgtgcagctcgacatggattctgactataaaccataagagcgtgtgtcatcctctggaaagcttaaaagggcagtattttctgaatggttactcctgtaaaaaataatcagtttaagtctttaaaaagaaaaatatcaccttttcttatcatttcttctgtatgcccatggcattcttttacttaacttgtatcccctaaggttactccctttctaggtggcttaggaaccttagggacagggaaatcaaaattagccccctactgtacattatttttgtcccagtatttttgaattcaataaagggggcgtgggctctcactgctgatctctgtccacagtattagaaatcataaaactgtaatccacagcaaaagctcaccacaggtggcaaatatcactgagggaagcctttttagactgtcctgactcaagagtccctcaaaatacgtagcaaggaatcccttgatttatggtagttggtgaaacctggcagtgggggtggactctgcagctctaaattctaattccagctgctcattaatctgtcatttactaatggtgggaccttaggcccattaagctctttgggtttcaatctttttcatttgtgacatgaaaataacaatacagacccaatggtcttgacaaagcagttgtaggaattaaatgggatatttgatgtaaactcactttgaaaaaggagagcaaataaaatacaaattgattttgtcataaaggtacacaaaacagttctactatagtttggggtgaaggaggggcacatacggagtaaaaaaataaaacaagggtagtcccagagcagattgctgggccgtgcttcagtgcagggcagctaggaagagcaccctttaaaaactaacccacataaggagaataccaatcagcgagcattagaggacacagcaggaccagaagaaagcacagtggggtctatgagaataggaggacgaaggctagaattcaagcttaagggggagaaggggtaaactaacactcttcagagtttctgattaaatgaaaaagtgaacaaggtaatgttccttacatactttgaggcaacaactaaaacaagtactttagcagcaacgtcaagatgacctacggagtgttaatttttcatttaaatattttcaaaattaaaataaacctgcctttgggctccttagaaaaagagctgattccagatctggtgcaggaaaaatgtatgaatcctcttgtcataccagaaagcaatgaagcaaagactatcaagcctgtatcaaaaggacacagaggccaaatggaaaggttcacagattaggacaactagaacttcaacaataggacaacaagcttcaactgacacacatcaacaatatttcattccatgaattcataatggtactaaaaacaaaattagtcaccattggaaattggtatgaaaccaagtcattaaaaactggtaaagaaaaataactgatcatttattttgccttttctatacctcagagtaaccgaatacagttggcccctatatccatcggttcctcattgaggattcaaccaactgcagatcaaaaatatgagggaaaaaaaatggatggttttgcacctgtaatgaacatgtacagacctttattgtcattattccctaaacaatacagtataacaactatttacatagcattttcattgtattagatattataagtaatctaagtatgatttatcatacatagcagaatgtgtgcaggttacatgcaaatattatgccattttatttaagggacttgagcatctgtggatgctggtgtctgcgagggtcctggaatctatccttcatggataccaaggaatgattacacttatgagcttctttttttacataaattttctttctttcttttaagagacaaggtctcactatgttggttgggctagtcttgaattcatagcctcaagtgatcctccctcctcagcctcccaaagtgctgggattacaggcaagagccaccatatccagcaggagcttctctttttaaaagtattccactaatcactgaagaaaaaactacagaattagattatcacaactttgcaacttctaatgaaataatggataatcttgagaatgatcttcaatggttgctgatattacatgaagaaaaccaagacatcacatgcttcttaatgtaagtacgttaagaccaactgtgaagtacttttgtctccaccccacatcaagaaaaatcaagactgaatctgattaagtctttaaatctaaacatcaatttacaggaaataaagggataaaagaacactttgggaatataaccaaattcagactatggaagaaacaaaacacagcaaatggctcagtgtcctcaacaaacagattataagagaggatggggaagggagaaagagacacatacagagatagagacacagagaaaaagagacagagagaggatgttattagtccgttttcaagctgctgataaagacataactcagactgggtaatttatgaagaaaaagaggtttaatgaactcacagttccacatggctggggaggtctcacaatcatggcagaaagcaaaaggaaaaatgagagccaagcaaaagggtttccctttataaaaccatcagatctcatgagactcactcactaccacaagaacagcatgggggcaaccacccccatgactcagtgatctcccaccgggtccttcccacaacacgtgggagtaatggagctataattcgagatgagatttgggtagagatacagccaaaccatatcagtgggggaaggagggagaaagagacagtagagagggagaagagagaaagagatggggagggaagaaaaataggagaaaggaaggaaaggaaggaagggggaaaggaggtaattaaagacaggctaagagacattgaccaatttaatgtatcaccttattcggaccctgattcaaacaaattattaaaaataattatgagacaattagtgaaatctgaacattgatagacatctaattgtgttaacaaactattattaacttagtaaatacaataaaggttgtgtagttactttttcaaagagccaattaaagatatataatataataaatacagctgaaatcatatacagtgaccagaatttactgtaaaaaatttggaaggggatcacggaaacatagagctacatatgaaataaatttgtctatgagttaataattacaattagaggatgggtatgtgggggctcactatactatgatttttacttcagtatatatttgaaaacttccttaataaaaagtttaaataaataaggctgccttgaatcattttgggaataggacagcatatagacttaaaagattttagattaaatagttttaaaggggacaatatatgctacttaaggagttacaatgaaagatattttgatttctagttacacagcatttaaagttcagaaatatgtacataatgtgtttaaactcaattgaagagactaacaatctcattccataattcctacattataagttattttgaacattttaacaaaaacatgatctttactggcttaagttagtatgaaacagattctaccttaatcagagtaacaggcatgtgtttccagagtgctatgaacctctaagattacatggaggtgtgtgcaggtgtaagcgtgtgtgagcacgtgtgcacatgggtaaactgcactcacacttctttgtgggaaagagcctgacttcagttaaagaggtctgagctggtgtggcagcacgcacctgcagtctcaggtactcagaagactgagacaggaggagcacttgagcccaggagttcaatgccagcctgggtcactgaaacctgcttaactatcaacttgcacacatacaaattttctaaggaggaagcacatctgtaatataatcactaggattcttcatagccctttgtgctatcccttttacactgcatttacgtgctccaaacacccccaaagtgctttaagttggctgcttcccacccgcctctcctgggcaggtgcctctgcagcagcccctgcacctcaaccccttttcgcagccaactcccatggctcctcacggaaagggagctcagtggttcctactccaggacacttccccgagacttggcaaggtttgcaccattctgagacccgcacatcagacctccctgccagcctcccgcagccgccctggcttcagccgcccacctggcctgagcgctcagcacgtggactcgagctggctctgcacccagctcagaacacagctctcaactgtaagcatcaggtaagcagcttggcattggtcactagagggacagagatcatcagacagcagtttctgtgaagcccacactgggacacctggctgcaccccctcccacctgaccctcccctgcttcctggcctgccctgcttaatttcccctcacctcactctgcaccacaccaagagctgccagttctattaccaggacacgtgtttgcctgtaatagagagctgccatatatttttaacatactataatactttaataatacaacttaatatttatatagtaaaatatatgacatgtaataatattttcaatattaagtgaaggtttatgtttgtggtttgttgtttaactttaagggagaaacacatataatctcattaacttgcttttgaactaagccttttactggggtaaggtaggagaaacacctcccaactctgttttaaatagtaaacatcaaaatgtgcttacaataatgctgcaaatagcttataaagtgatggtatcttctgaagattaaacttgcaaacatcttaacacacataaggcctggtatatataagcactcaatatgtttcagctgctattagtggctttgcatgttaataactgaactatcagggcactttaataaaggtaagtaagcccctcccattcccctccaagcctcccagtgccccccaaagccctggatgaactgagttaactggagccaaagcctaccaagaaacagccctacacatccttcttttaaaggagtaaagaaaagattagttttgatccagaaaataaaaagtcaagcagtattttacccaagttaatttggactctggaattattctgccagtgtctaaaggacaaagtgactgaaaacaactgctctcgggctccaaatgagctgacaagtggtttgtcaagtgagtattcacgatcacctgtgggggtacccctaagccccaaaacgccttccaaacctcctcaccacctttcctcactgcttccccagcaccaccccaagcctgaccattttctcacttactcccctttttgtaacatatgcagagttggagcgaacacctcagagaaaaagaggaaaagaaagagaagaaagttgaggattacgatgaactcatctgaataccaagacaacacccagactcacctctggaaatgcacaggtgaaagaaaagcaaggcagtaaacagcaaaaaggaaccccatctttctccacctcaagtccacagaaattgcctcccttctaagttttaaacaagggatgaagatatctttgaccaccggaagtgaaaaattaggacaaaccagttagatcagatcatccgtaaattacaaaatttttcaccttatattgtttcttggactaagacactctgtctttgccagaaagtagtgattcacttttgcaaatatactatgataccacacttttacatcttgcaatggaaaataagcaatttttaaaaattcacctcagagagtacagaacattatcttaatttttatctttcccaaataattattaaatatatttaatatgcacaattgtaattatgaatcttctatatatcttaatgtgcattctaaagtatttcagattacaatcaccagatcatttattgagagctatgttacgtgccaacaaccctgaaattagagttaattatcttcattctatacattatgaaactgaggtttgtagaggctaaagtttattcagggtcacaaggttccaagagctaacctaacacctgtgctttttcacagattctaagcattaggaatttctttaaaaatctcttaataaataaataggctgggcacagtgattcaggcctgagttctggctacttgggaggttgaggagggaggaccgcttgagcccaggaggtcaaggctgaagtgagctacgatcataccactgtactccagcctgggcgacagagcaagaccctgtgtgaaaaacaaaaaaagaaagtaaacaggcaacaggtcggtcctctgagaagaggaaatggggaggtggcggacaggcataggacgactcacctgaatacccatttgcatctttatattttaaattagctgaatatattacctacccagaagataaataaaaatttggaaataaagcaaaatctaaatagaagccagatgatagagagggtagaaacttgagtcctacagaaccagtttggctgaagagcatgctgtcattaggccatcagccaacagtgcatcctgttaagtgagaagacaacatagaacttactatatggacgatattcgtaatcactttacacaggatcctctaaaccagtgcttctcaaactgtctgcagtaaagaactagttattgtcagcatcctcattttaaatttctaatccatcatgaactggttcttttgtaaaatacaactgaaggtgagttactaaaaaaaaatgattagatgtaaatgtctcaggaacttgctataaaagcttctaaatttactctcattttctgtacttaccttgtcacagaccagtaacaaacagagcaccgaccacaccagttaaaagaccacacctcctgggcaccaacttaaaccagaaactttaaaaaaaaattccctctgatttcagtatcatgaatattgctcctgagcagccgggtcacttccgttttcttcaaatgtcataaattatacaactacaggttaagcatccctaatctgaaaatccaaaatgtccccaaatccaaaacttttttagtgtcaacatggcaccagaagtggaaaattccacccctctggtcccaagcatttcagataagggatattcaacctataatggtgacaatgaagatgatgtcaacactgcagaaaaagtgcccagagacaacatgttgaaaatgtgtgaagggcttattcaagggctagggcagtgtgcattcacaataaaacatgaaatcctgtcagtgtataaaatcaaagacttgtaagacaaaaatcatggctaatgaggcagatgactccggaggaaacatctttaaaagccatccagcagaacgcctccttatccctagaggactcaatttcccggtccttcaatacttctgatgtttcttttcacccaccaaacacaagatacaggtacggtaaccttttagtcaacacaaggcctcacagatggagacggaaagcctgctgctgtgtgctgttgctgtggtttagcagctggtacagatgtctggtgatgctctgtgctgcttggttaccctgacacttattttctcgctgtaataatggcatgtcatattttttactgttaagtgctttaatgtgaatagatgtgagacaataattgcttatacgtagcatataaattcagcctcaagaaggatggggatgccagacaactacagactgtccacatgggtggctcagatagagtcaccttcactttctgacagttcaatgtacacaaactttgctacacacataaaattacttaatgtgttgtataaaattaccttcgggctatgtgtttaaggtatatatgaagataaacaaatttcatgtttaaacttgggtcccacccccaagatttgtatatacatttctctacgtatatgaaaatatttcaaaatcggaaaaaaaaaaaatctgaaacacttgtgctcccaagcacttcagataagggatactcaacctgtacttgtatgtccctgtttgataatggtaataaagctgtggccttctaagaagggatgtacaagctcaggcacagtggttcacacctggaatccaagcatttggggaggccaacgtgggaagatcacttgagattaggagttcacaaccagcgtggggaatacagcaagaccccgtctatacagaaattttttaattagccaggcatggtaatgtacacctgtagtacattaccacaagtaatgtactcctcaggagactgaggtgggaggattgcttgaatctaagagtttgaggttacaggagccactgtactccagcctaggcaacagagcaagaagcaacacccaatctcaaacaaataaacaaaaaaacacaaaattgtggctcaaagattacctctcagctttattcctggcttcacgtagaattccagttctcacttgtaatatcatgatttatccatctgttttgacttcaattgcattttattattttaatcaagctcccttaaacacaatattacattacttaaagtagtgtcatctaaaatgttctttttttttttgagacggagtcttgctctgtcacccaggctagagtgcggtggcgcaatctcggctcactgcaagctccgcctcccggcctcccgggttcacaccattctcctgcctcagcctccagagtagctgggactacaggcacccgccaccacgaccggctaattttttgtatttttagtagagacggggtttcaccgtgttagctaggatggtctccatatcctgacctcgtgatccgactgcctcggcctcccaaagtgctgggattacaggagtgagccaccatgcccggccttaaaatgttcttttaacaaagggattttagtgaattttgcaacatgagtaaatgaattaatgagaatatcatattcacattatagcagtcccaagcaaaaagaaaacaaacaacaacgaaaaaagaaaatactctcagaatgtgccatggggtataaaagaagaaaaagaagacaatctgtggccactgcccacaggggcaacaggaaacttggtgctgcccctttaagaagccgccaggtcagtgggaagaaaaagagaaaatgaaagtcaaagggccgtaaagaaacaggttttcttaaataggaaatacaaaaattaaacagtaattctacctaaattattctccaaaataatgaaaagcaacaatgtttcagtctaggctcccctgcatggaggtgattagctggaagcgactagtatgctgaagtctgataatgacagcttttacacactgtcaccaaattacgatgcaaattctatggaaatcattagaccagcactcactgtaagaagtatgatctgggattgagttttggagcttctcagaggtttactccgatcctgtcaatctgactgcagagctgctttccctaggcgtctaaaatgctctcctggggttagagaccacaccctggtgcagtgaatgggattcctccaattccaaatggctccaaaacctctgctttctccctcaactgcttccattctcactgcttatctccgaccctttggcccaaatgtctccattcattcggtgcctcattacacaattattgggtactcatcaggtgcttaagcactggtgaatgtaaacaatagaagcttggtccttgaggcatactgattctgttaggcaatttaagaatactcacagcaaagggggaatactgtaatagacgcaattaccagccaattaggaacaaaaaaaggaaatgctgtactaagaaatgctgtgctgcttgagaaggtcagggcaggctgagagtggagcacaggatgagtggcaggtttccaggcggtcagtaggcaccacagtaggtgtgggggaaatctggacagatacaaacacgagcaacattgagaaagacagtgaggcagttaattttgtgtgctaactaggatatgccaaccagacttggtcaaacacctgcctagatgttgctctgaaggctattttttagatgtgattaacatttaaatcagtacactgagtaatactccctacaatgtgagtgggcttcatccactcaaagacattacccaggaggaacaactaattctgcctccaagcggcctagatgttggactggagctgcaacatcaactctttcctgtgtctctagcttgccagccagccctgcaaatctcagacttgccagcccccacaatgacatgaaccaattccttcaaatcaatcaatcaatcaatcaatcaatcaatagcgcgctctctctctctctatatatatatacacacatatatatatatccatatccatccatcccactggttctgtttctccagagaaccatgactaatgtggatatggtgaattcaagaaactatccgtacaaaatggctgggttacaaaacacacacaagccagggggcatgtggtgcaaaggcaggaaagtgctagtcacaaaggcactgggacactggagagtttacactccccccagggcaagagagagccaccaatagtttaagctgaggagcgaccatctgacatgatcagatggtcactccagctaaaactcactggcagcaaatgaatggaaaaaaaaaagactggaagcagaagaccaggtaggaggttactataacagcccaggcaggacaaggtaactgatgtgggcaaggaaaggacaagagatgacaccgctaccaaagctatgctagtggggtaaaatcagcaggacctgctggtgaagacatgaggagtgaggggaaaggaggacgataggatgactccaagatttctgactttggctcccaaatggattgtggtcctgctttgaaatagggtggggaaaaacacagagatgatagaagggagggacatgtggagtaggagatgtctatgaaatacctacatggaaatgttgaggcatttggaactcagggtctggaactcaggaaacaaatctggactggagacaaggctttgggattcacaagggaagagtgactgcagttgtagacatagaaagtgaacaaagtaggagagagtcaggaatggtatgttaagacacactaacctgcaagggtgggcagaacaatgcactgacaaagaggtacaaggaaaaccagcagaggagggaaaatcaagaggaaaagtgacagtgataacacacgccaacaaagcaagtaagacaaggactgaagttgcagggtttagccgtgaaaggtaatttagaagatcttatataacaacagtttagggtaggatggggaaagcaaccaaatataatgagttgaacagtccttaagagataagaaaatggacatagtgactgaagccactgggctgtgaaacaaaggctgggggaataatgagaaagatactgacagcccgttgtggaaccctagaaattatccacccttattgacacaggtgttgggttactgtgcttcatctttaattcagctctgttgcagggatccctaatgcagaacactgaccacagggccacaatgacttctggacattagactcagacaacttggcattttcagtttggtgatgatgttggaaactgttttcaatttgcaacctaattgcttcccaaataaagatctcaatgatgcttctcataggagaaatacatatattctaaagagtgcactgagtagtttttagctattttacatataattttatagttataggagcgaagatcagtgatcagaaatattttatgtacaagtttggtattatgtctcagagaaaaaaaatcataagtatagcatttgttaatgaacaccaagtaccttcataaaaacatgtttatttgaacatgcaaataagagttagttgtttactctcatcaaaattatagcgtgtcttcaggaaaagaattctaggtcaaagcagactaatgttcaggacagccaagagtaaaacattaatgaatatttattaatattatgtgccagacactgtgtccttcaaccctcacctatggctagtaccattatcctcactttacaaaagagaaaactgaggcacagagaggctgaataattacttgaaagtcacagaactgagaactggcagagaggagatttgaacgcacgtacgtccacacgatgtcagacgctacctgagatgaacagtaagccttggccgggcatggtggctcaggcctgtaacctcagcactttgggaagccgaggtgggtggatcgcttgggcccaggaattcaagaccagcctgggcaacatggtgaaacctcgtttctataaaaaatacaaaaaaaaaaaaaaattagctgggcatggtagtgcacaactgtggtcccagctactcgggaggctgaggcagaagtattgtctgagctggggaggtcaaggcttcagtaagccaagactgcaccaccgcactccatcctgagtaaccaagcaagaccctgtctcaataaataaacaaacaaacaaataaataagcctttatcctatgatctcattaaagacagaggtgccccctaacttgccctttaacttgcagtcttgatccctgcaacaaagctgaactaaagatgaagtgcaataccaaactgctccctaacttgtaccttctcctgctcctatgccacagctctcttccataagttcattctgaagagtcctaggctgttctatgcaaatgacgaatcatttgccaacccttagattttccggcttgcatccggatcagtgtgttggctgtaaaccaaccaacacagatgatcaatattacagcacaaaggaagtaaaaagcctttgtgattatccagtaagctagggatcagaaaagaatgattgcaaaatcctaacgtacagtagaataaggaaatgtttccaggtatttgtcagaaaagggccagcttccatctggaccatgacctacaaacaacattaatgctcctaacagaactatttaaataagattccactgtttgttctctgaaatctcctgggacacaatgactacctagaaggtaatcagacctcgaccacaggagagccaaggactgccattccagctttcctgccattctcacttcctggcaggtgaactctgctcccattccagcccctgaaagcctaacctaagaaaagaaaaaaagagagaggaatagaaaagaaaaaactgtgaaaagaaagaaatgaaatagaggcagaaaacaaagaggagggagaaaggaaacaattacactagaggtagtttctgctagaccaacactgagccaggccatcccagttttcactctcttctggacactcaccaacaatatactttaattttgtcaaaactgcctttgggtgaggcatcctgattcctgggtagaaataacatgaaacccgtgaagtcagagactcttctatagtagagacccagaatgcagttcactaattttgaaagaatttgtcagagctgtaggagacctgtgagatcatgattgctgttcccatctaagagttagattctgcctatgataactgtccataagggcaacattccaactaaattttcgcattactgtgtgctacaattaatttttttaatccagttaataaagtgctttcacagagtatatcattaacaaaagttaatcgataaatactccagagcaatagccccaacaacagagatattataaccctcctatcagaatacacagaaatggaatatgagtatctggaaatgcaaacttcagcaaacatcacaggaatttttttaagtgtttgcatataacatgtcaaaaactaatgaactctgattctactagcatttactctcctaaattctatcactcaaaataatatgaaaccattaaaaacacctaacatgtgaactaaaatatacacacaaatgtctatgacaatcataataggaggtgctaagctggttaactaacaagatctcttgaggctgggattttcctcaccctagacccccagatgcattcatccctggagtccctcgtactcaatcagtacttgatgactctgaaagaatcatccaggaatgattccagatggaatttaagttccatatccaactcaaggccagtaacatttgctgaaaagcagtgaagtcaatcagtaacaagttagtcaaaacaatgaagaaaagataatgcaggcagtaattacttctgagtggtgggattgcgggtgttgttttttttccccctgaaactttatatcctcctatacttccaatttttcaatagtgaacattatttttactattctgaataaatgttaaggaaaaaagtttatgaaatatatatatttccatatatatgtcatatatatatataaaatgtttcaagtcactactacggtccccataaatgaatggttctcaaccacaacacctcacttttcaaacacctcagaatgtttctaaaaacagccagctccaagttctaccctaagcccactgaactgcatagaagagccaagagttattcaacctgcccaagtaattctattacaccaccaacatcagaaccatgctttatggatgcttcaactacaaatggcaagtttcttatctttggagaggactgaaatcaaaggtcagaacatcaacaaaaaagcaaagtattcttttggaacaagctccatatctagagaaacagctgattctagtgagaatttcagtagttcctagagagtgactgtggaaaaggcaagcacagcaggagacacctgagattgcactggatgcagggagtgaggtgccaattgtggctggaactataggaaggagcgggcaggccagagctgtttccctgggattccagaacagaaggctgtgccacacagaggtcccctgggtcacaatagcagctgaatctcagtggccatgacagcaaggcaacaacggggccagctccccaaggtccatgtaagtgcagctgcccaggactccccttgctgtccagacataggctctcctacctgcttccaacttcagttctgtggcatttccaggaaatatgggtagttaacacataaccatgctcaatgagagccaacctgtggctgtgcggccctttctcggcacgtggcccaagcctgtgctgggtctacgcagtgaagtacaaggtaaaaagaaggcaagcagcttcttacacctccctcccagtgctgaacctagacaaaatgtacccctcttagcacctttaggaacttttcctagagaaacaagaatggcaggcacctatctgagtgtgcttggttcctcttggatataaagtgcaagcctgtgtcaccttctgtgtcactcaggattaaacgtttatgacatcccaccactgatctaaaaggatccactcacagaggaaaatgaagactgaaaagccaacaccaacaccacccttctgtgcttctcagcacttctgggccttcacgtcctccttttcctcccccacctttataagcactctccttttcttcaatatacactccaaaccctctccgtcccaccttaagtgatctgccttgagctgagcccgttttttaaacaggtaaaactgcttttaagagaaagaaacatttctcccatgcagagtacaattaagaaagcatcccttccccatccccagggcagccatgcctccttccacctaagcttggtgagctttggaactggtggtaagaactgatccaaagtgtgtgctttaacaaatccttccaaagaaaacttggaaatcagctatttaaacttggagtccacttctctgtaggaagggcattcatttgaacacaaatttagttcctgcgccataatgtgcagtgttaagagtaaccctgaacaatgcatttgctgcatggaatagctttctcagtacaactgtgtagtgctgtagagctccctttttgcccctggaattagccccaataccccccgttgacagcttcaacaagtgggatccaggtatgacatctgagaagtgagtaaaataaggctccagtcgacaatggggcaatggaagtggccaggcagccaggctctgggcagcaaccacaccagaggctagctcctggaggcaaactctatgattgatgtgatgaagtggggaaagggaaggggaagaagacaggaaaagcaagagtccctgaagcaaacttctagtggtgggggtctcccgtggctccacttttccccagggcttcactgcagatggggtgagagagggcatcagccaatcactgtccagaggtaggacactgcccgcatccagtctggtatacaagaaaaaccaaagtgatcctccaggataacaatgttctcatttccagaagatcattacgcaaggcactttctttcgtcctagtacagataagggtggttcaaaaagactcaaaagtttgcccatgggctgtgcatggtgattcatgcctgtaatcccagcactttgggaggccaagataggagaatcacttgagcccaggagttcaagaccagtctgggcaacatagagagaccctgtttctacaaaaaaaaaaaaaaaaaaaatacaaaaatgagtcacgtgtggtggcacacacctgtgatcctagctactcagaaggctggggtgggaggattagttgagcccagcatgtccaggctgcggtaagcaaagatcacgccactgtactccagcctgggcaagagcaagacaaaaaaaaagtaaatttgcctgtgacacccagtgagtactgaggtcaggaatcaaactcatgttcatctttctctcctctccctttacagatttatcttaattccaaggccagaattcaggtaccagaaatgggtactttgcccagatcatccctgacaaaaatatttgcctattaacacaatcttactacaactaaatagaaaacaaaaactgttgacctataagataaatgaatctttcaaagcattatttggttgctctacctgaagaatactaaattgtaacccagtcatccagcatgagactctacctgtaaacctcgaaggcttattcctgcctagagccccagggaagcagcttccacctccacattccaagctgccatggaaacaacaatgctgcctattccactacaggctttgcgagactcctctgaagacctccctccagagtccacagttgcgagactcctctgaagacccctatccagagtccacagttgcgagactcctctgaagacccctctccagagtccacagttgacttcctcctcagagtcctaccacaggattaattcctgaaatctttcccaaatccaaacgttaagcattatctacatcagtcaatgtcctactaaaagtttccattacacatgctataaattttgactgatgaaaactaaaaatctagatgcttttattagctacgtatatttacatctattttctgaaacgtatatttaaagagaagaaaaaccacagcccataaaggttaagtgatctccattcttcaaagacctaagcagtaatctcaggtttcctggatccatccctaagccctccactaacagcgatgtcctatatagagaatctgctaagatttctagttgggctcccaattatttccctggcctagataaaatacttccttgtttttagcaactaaaatgaaattttccatagtaacaatctggcaatagtataaacttttggtaacgcttaaataggttaaaacctatatgttcaaacagtaaatattaaaagacaactcaatggaaagaaaatactacataaatttaaataatttgaacttactaaattagtcaaaatagcaaaattgataagggataaaattaaaaaccaccgttgtccataaaaaagccaaaaggaaaaaaaaagggacttcaatacttggtcaactcttcctatttctccttttcaaggtttatatttaaatgtagaaaagcaaaactttaacaaaaatctactatgtattattacttctcctcaaaaaaaaaccccaaaaccttcccatccaccttgagaaattcacttaatgcatttagtattctcttcccccctcccaccccccccccccgttccttcccctaatacccagggttgaccaactcacaaagctagcaggatgcctaagtcaacattataaggacagggggacaagaaagagtgcctggtcaaaacaacaagatctgtcaccacccagaaggtccccaaaacttgatttcagtttcaagttcccaagttaaacctgaaacaacacaatgatgatttgaatattccttccaagcacactcagagactagggagagctgcagaaacagagctgtaaggattccctgggtatcttgactcctaagttctgctagtatattctttgtgaggtatgaaaagtgcccaagggccaggaacagtggctcacacctgttatcccagcagtttaggaggcctgaggtgggcggatggcttgagctcacaagtttgagatcagattgggcaacgtggcaaaaccccatctctacaaaaagaaaaatacaaaaagtagccagatatggtagaacccacccaaagtcgcaggtactcagggggctgaggtgggaggatggcttgagcccaggaggcggaggttgcagtgagctgagatggctccactgcttttcagcctgggcaatagagccagaccttgtctccaaaaaaaaagcctaaggaatttgctcagcatgccaaaggaagtggttaaaatgaaatctgaaacaaccaacaaacgaatgcttaccaagcaccttttatggtgctcaatatcaaatgggtaccaggaagaatgaagtattataaagtatagtaactccaaattcttccagacagccctggtttccaacattcagttccactctagatcatttatatatgagataacgtgtgtcctaccttggagtcaagaaaaaaaatggtcaccacaggtttaagacatgatccctatccccaagaagttcatatttcggttctgagcaaatgaaatcagataaatgaaattgtttttcatttcagaatctgaacaaatgaaattggacaaatgaaatttttttaatagtattcaataggtggttcccaaatgtactgtatggactaatgccaatccatgacacatttttaacccgttctttagcaaaatgaaaaaaatggaaatgagaaaaagtagttcacatagtcaaaagtatataatttggtgagtgttctttattctgggagcatgttcttcttacattttggtgtgtaaaacgggtttttttttttaaatactgtgatagcagacagcaatttgttactcctaagattcttactttcaaaataacctagccaccatatatcaatctcaggtttttaccagtctatgtaaaatctaacactccatgagctactgacattcaggatttttactcattcattctcctagaccccaaaagggggtacaacaaacactttatcctcaattcctgatgccccttttgaaacatcaaaccataacaatctttgtttgtcagcacttatggcccatgaaatttactcacaacactctaatcaaaatcacaacctcactggtgtgatctaccactcacatccactttcatgtttcttagaggacttcaaaactggtttgtcatcttaccgtccaccatcatatatatcatcattttctatcttcgttcaggtaggaagccacaaaaaccaatctgcagctaattgaatcagaaatctatgaaaggtacagtgcagactgaagaagatgactgagaggcttcataatgaggaacagcacccaaaatcacgctgcggaacagctctcagagaacagcactgcagtgacagagacggcaccactgcagcaccagcgccggtgcaggactggatgctcatgcacatctcaggcctccagatgcccgcgaccttctccccttcagcctcttccataaccacactactcctttcctccatcggcttctcccctgactgcacagaagcccatttccccaccatgacgaaaaaaaacctttcccagatctaaggcaaagggaaaaacatacaagacagaatgtaaatttgtgctgccaggggctgggaaaggaggggatggggagtgactgatgaatgggtatgggctctccttccggagtgatcaaaaagtgttctggaactagagtggtaaagaaggtacgacctcgtaaatgtactaaatgtcagtaatgataaattgtatgttacatgttaccaccaaaacaacaaaaacatctctggcctccctcagattccacgatattactcagtacttttgttctctctcctctcccctccctccctagcttccttctcttccaagcctgaaatgcaaacattttcctcctcctcactctcatccttctgtctccacattctctcatttggagatatcatctatgatcagtagcaattccactatccaccctaaggaagagagctctacagcaaaccttagaaaactttttcagtgaagggccagagagtaaacatttcaggctttcaaagccacatggtctctgttgcagctatttaactctatgtggaagcagccagaaacaataagtaaacaggtgttctatgctctaacaaacctttatttacaaaaacagggcttgccgtggtggcttacacctgtaatcccagcactttgagaggctgaggtgggcagatcacttgaggtcaggagttctagaccagcctggccaacatggagaaaccccaattctactaaaaatacaaaaattagccaagcatggtggcaggcacctgtagtcccagctactcaggaggctgagggatgagactctcttgatcccggtggggggcgccgaagttgcagtgggcagtgatcgcgccactgcactccagcctggacaacagagggagactccatctcgaaaaacaaaaacaaaaacaggaggcagctggacttggtccaggggatacagtttgtcgatcctgctctaaagtatgatacactgcacatctacattcccattccttcttatatgcagtgtatttcctccaggatttctgaggaagtatgaactccagatgtcattcaataaatatctattgagagcccaccatatttcagacactgcactagggatacagcagtaaaatacagtcttgtcctcatggatttacacaaactgaatgtcattggtatcaaccataaaaataaagacaacaaacaaaacaaaaacccttacttctcctgactttcccaatccaacaatccaatcagtagctaagtccttttattctcctctcaaacagctttcttattccttcctatccatcatacctgaggcttcaccaagaacaagcattccttgtgtacaaaaagcagactctcttaaataaaatatgcagatttctagatatttcaatgataacatcaaaattcatgaaaatcaaaacaagatcctactgggaggccgaggcaggcagatcacctgaggccgggagttcgagaccagcctggtcaacgtggtgaaaccccatctctactaaaaatacaaaaaattagctgggcatggtagcgggtgcctgtaatcccagctactcaggaggctgaagcaggagaatcacttgaacccaggaggcggaggttgcagtgagccaaaatcgcaccactgcactccagcctgggcaataagagcgaaactccgtatcaaaaaaaataaaaaaaataaaatcctagcaaacttacaagatttgaaaagacataaattttctgacctcgagggcaggccctattagcatatggtagacaccagagaaacattctcaaaaatgataggagtaatctctaaatgaaggtatgagagtttacatcaggtacaattttaaagcaaaaaaagagaaagcattgaaattaatgcaagaagtttacggtcactcagtgagtaaattaaaaacaagtgaggacctgtaatcccagcactctgggaggccaaggtgggcggatcacctgaggtctggagttcgagaccagcctgaccaacatggagaaaccccgtctctactaaaaatagaaaattagccgggcgtggtggcacatgcctgtaatcccaggtactctggaggctgaggcaggagaatcgcttgaacctgggaggtggaggttgctgtgaaccaagattatgccattgcactccagcctgggcaacaagagcaaaactccatctcaaaaaaaacaaaaaaacaaaaaaacaagtgatgatacgtgtacacaaaggtgccacagccaacagagttagaatcatccccttaggggtgatggggaagcaggcatattcttcttcagggctggaaaaatgtccttctgagctagacttcttcaggccaactgagactaatctatcagattaaacttactaaacattccaacaaaatcaaacctactatacttcccatgcctatacatacagggaaatataaaatgcctcccccagggacaatgcctaattcattccatactaagcacccaaatccaggtcttatcattttgttcttcaagcaaaaagaaaacaaatgcaaagctggagctccccatagtctgcatggagacataagaggaaaactggggccaggcacagtggctgacacctgcaataccagcacttggagaggttgagatggtagaattgcttgagccaaggagtttgaaaccagcctgagcagcacggcaagaccccatcttaacaaaaaaaaaaaatacaaaaattagccaggcatagtggtgcacatctgtgatcccagcttctcgggaggctgaggccaaaggatcgcttgagcccaggaggttgaggctccagtgatctgtgtttgcactgctgcactccagcctgagcaagaccctttctggaaaataaaaaaaaataaaaaaaataagaaaaaaaaaaaaagaggaaaactggtctgtgttgccaatctggtaagtttcaggaacaaggcaaacaaatggtgttgggagccagttctctatgggtctctccagtttctgcatgtcttatgagcagattgcactgacagcttttattggctactatctttcctgtacaggacatctgtagatagcattttaagatagcaatagtgtttctctctggagcagatggaagatttgtttgctatgcagaataataaaaataatgtctccctcaaagcaaaggctgggcaggattattagttcccttataaaaaattggggtttcccaatctcagattttctcaactgtggtgcatacccactgcatgggcaacatccacctagacccacccagccaccgtgttacccacatggtctttgaggggcaagaaaatactatacaaacagagctgtcacaaacatgaagttcatactgcctgctgacccaggagtgctgtgtcttctgccatcatccgtggaattttaagaagctaacttgttagcctgcaagtaaggtaaaatctcaggcctcccacaattcttgacaaacagggtttctgctgtctttctccttgactgggtttactccaacaagcatatatgccacacttgcattttgtcctgcaggtctcttgcaacaaagcttccattttgaaggattccactgtaaactacaataaacacgtttatcaatattgatcaccaaaaaatactactagtgtctgcatatacttgcaaaattccaattcatcatttttaaagaaccgatgtaaaaatatagttcgaataaagcaatactaaaaatctaacttttgtgaaaagtgatagaaatacagtaccattctaagaaacatagaaaaatcatgttttgattttaaaagatttctaaaagtgccaattagaggctttttcactcagcattaaggaacatatttttgttaaacatgatcaagcaattcatttcacattacaatcaaaccaaatgctcaagcataatatatatataatacaaccaagctttggtggttcattttcccaagtgtaattagtcagtataaagaaatactttctataaatccctagtaaatacctttattttttcactcttaagtttaaaagaacttagtatgaagatctgagaaaggattcccctagaatcacatgtggtaaattgtttaaaaggcacagtatgaacagtctgaaacaaatgaagtaaatacccttcagccaagaacgtcactgcatataaaatcatctaacctcaagtctatgtaactcaattctacataagtaaatgccaaaataatatcctggaaagctgagtcatttcaatgagtaaatttatataaacaattgggttactacttatggtaagtcacaagattttggcaggaaaattgcttactagcttgccaaagactaggtttggcacattggtgccccactgccaagaacattactgataatcagctttctatcctataggattacctttcagacatgttttactcactcatttcctatgtattaagcttatacaggaatggttaatgcaactgagcaccttacttctggaagtgtgagattcccaaaattcctcaagaaaggaagaaaagcatgagaaattgtaaattggaagtttggaagtacctttttttttttttttttttttgagacaaagtctcgctctgtcacccaggctggagtacagtggtatgatctcggctcactgcaagctctgcctcccgggttcaagcgattctcctgcctcagcctcccgagtacttgagattccaggcgcccaccaccatgccaggctaatttttgtatttttagtagagatggggtttctccacgttggccagggtagtcttgaactcctggcctcaggtgatctacccaccttggcctcccaaagtgttgggattacaggcatgagccacctcgccccgcctggaagtatctttaacattaggaaatgcaaataatcaacaaataaataaaggagaaagaaaggagaaaactgaaatatactaagaatagcctggttaacatcaatcatgaaactaaagggaaagtgttaattttcatgccttctaagtaagagctacagaaagttctgggagacagggaagaagactggctaaaggtacagcacagcagcatggccacctttaggacttgcccactctacagcagccacctctgagcacttttaagtcatttttaagacaaagaggccaggtgcagtggctcacacctgtattatcagcacttgggaggccaagaccagaggattgcttgaggccaggagttcaagactagcctggtcagctggtgagatcctgtctctacaaaaaaaaaaaaaaaatagtaaaaaaatcagtcaggcttggtggcagctaccagggaggctgaagcaggaggatcacctgagcccaggagttcaaagctgcagcgagctatgattgcaccactgcacttcaaactccagaggaacaaaataattcactgtcttcccccagaaaactgattttccttcccagtggttgcatttctggccatactattaccatccaacctgtcaccaaaatgcatttgcatccttgatctcattatcctcatacttttactattctcattcatcctacatacccctaactgcattcccaagcacttctccatccttctctcattccttcccactgtgagaacttattcataataaataagaactatcacttcataaacactacatgccaggaacagtgataggccttattataatataatcatcatttgtaatccacacatcaatttgtgatgtgggcataattaactccatttttctacccaagaaaaacccaagaatttaaaactccttcctctatcctaatttccctgatttgaactttacaaacatgtaccaaaatatcacacataccccataaatatgtacaattattatgtaccagttaaaaaaaaaatcgttcctcaccaaaaagtcacttcattcatttgatatgtcctacaaagatggacagctccaagttttcactctatccttacaaattctgacaacatacaactcatatgaatttcttcttagtttacaaacttaatttcaaattcagtaaaattaatagttcattggtttcatttaaaaaaaaaactatcctggccgggcacggtggctcacgcctataatcccagcactttgggaggccaaggtgggcggatgacttgaggccaagagttcaagaccagcctggccaacatggcaaaaccccaactctactaaaaatacaaaaattagttgggcgtggtagcgcacgcctgtaatcccagctactcaggaggctgaggcacaagaatcacttgaacccaggacacggatgttgcagtgagtgagatcataccaccattgcactccagcctaggcaacagagtaagatctgtctcaaaaaaaaaaaaaaaaaatccaattggctttatgtctaaaactgaaattactgcactgcttaaatataaagataattgcataatttctctattgtacacataataagtcagcatgtaatccaaacatcacactactgtagactaggagcagcccttagatccctaagaataaccaggtaaccctttcacttgacaagttaagaaaaacactcaaaaaatgtaaggctatacaattaattggtatcaaaacccaacctctgattcccagtccagagctctttcaattaatcacatgtaacagtctttgattaagcaggacagtactcaagacatctctctcacttccaataatgccagaccttttttttttttttgaaatggagtcttgctctgtcgcccaggctggagtgcagtggcacgatctcggctcactgcaagctctgcctcccgggttcaccccactctcctgcctcagcctcccaagcagctgggactacaggcacctgcccccatgcccagctaatttttttgtatttttagtagagacagggtttcactatgttagccaggatggtatcgatctcctgacctcgtgatccagagatttgggaggcccgcctcagcctcccaaagtgctgggaccacaggtgtgagccaccacgcccagcccaataatgccaaaccttttatcccaggactgcaaatcccagcaaggaagatttagaatggaagtcactgcctacaatcctcttatatgagaagataagaccagctcccagatctgctttgcacagtcttgaaagactcactggacattaaatctgttggcctcccagtactttatagccttgtggttgattccaaatattacagaactttctgcttctagataatagattccccatgcaaagcaaggctaaatagtaatacctcccacattcaacttcctttcctaaaagtcaagaaatcttttattattctgttaacactatggagggaaggtccattccagtaatgaggcaaaggccactactatgtgcagatttatttcctatttgataagaattattcttccaacctggcagaaaagataagtgacttacccaaagccagtgcagttcagaaagagctaagcagtaattcaaacacctgtaatcccagctactcaggcagctaaggcacgagaatcatttgaacctggaaggtagaggttgcagtaaaccgaggtcacgtcactgcactccagcctggacaacagaataagactgtctcaaaaaaaaaaaaaaaaaaagaaaagaaaaagaaaaccacctcatagaagctctctgttgcttcaacaaatatactttgaacaaaatgtaatgcactttgaacggtacctggcacaaactaaatgctcagtacttgttaattattttaatctaccataattataactatcaccatcatcataccactagactatcaatgtcataaggaagatggtaattcagtctgttgcatttgctgttcaaagtgcattacttgtagaattggtagagaaaagggaaacagatcagaaaaatttttcaaatctacaacctggtcatgtgatagtgaaagaaaacagcatttttcagtaaagaaagccaatggtgctggggagcaatcacctgctaaagaggttggcatggataaaagggagccaggtgctaatagtcagaacaatgggaaaagaccctgaaggcatctcagacatctttgaggctgtctctcccatcagaggcccagagacctaggaggacagcatggtttggggagacaggcccggggcacagctggcctggcacacctcaaggagtcctggaacgtcctacatgctgctccgacatcctggctgctgcagtcacagaatgtctacccaatgaccgtacaaccattgtatcttggaaaaaaattattcgtttttggttttacaggctcatagctagaaggaacttgctttgagtctcagactttgaaccgttaagttggtgctggaacaagttaagaattttagggactattggaattgtattttgcatgagaaagatgattgtattttgcatgtgagaaggatgagatctggggggtcagggatggaatgccatggtttggatctttgacccctccaaatctcacactgaaatttaatccccaaggttggaggtgggaactaataggaggtgttttggtcatggaagcagatccctcatgaatgcttggtgccatcctcacagtaatgagtgactcctcactctattagctcccgctagagccggttgttaaaaagagcctggcaccccacaccccaccccacctcttgcttcctctctcaccatgtaatctctgcatacactagctccatgagtggaagcctaaagctttcagcagaagcagatgctggtgccatgcttcttgtacagccttcagaaccatgaaccaaataaacctcttttctttataaattacccagcctcaggtattcctttatagcaacacaaacagatgaagacaactttcatatctttatatctgcagcagcaccaaaacaagccttggacactgcagacatgcagtgaagatgtgttctgctaatggaaaaagtaagtcaacagttttgaaaccccactagatgaaggcatgtgggaggtaacaggctgaaaatgagatttctatcttaaagtagttcataatctcaagacaaaagatatgaaattacttatacaatcaacagggactgcatacatgtaaatacagaggaagttcctggaatggctgcatttatcaggattaggctgagaacactgagactcaccttaaaaggaataagaattgtgaggccattcagccacaaataattactccaaagaggtacaaggcaacagtattcaaaaaacagcaagaacatctccaagagtgcagtaaagaacagcatcattagccaatgggggtgagcttttaagagtggctggcagagggcctggagacagcaatgcaaagccagagcctgagcttctttaaagcctatttaataaggttcccactttggaaaaggagtgtgtcaagaaccgatgggaggggaaggctagaataagaagcctgacaatacgtactagagatacacagcagacaggacaccctggctgtccgcactattctcaagcgggaatttgggacaacccatttaagagcccatcttggcacaaatgccatgatagccccaagtgccagagcagtggcatttgaatctgaaatctcttcttagagtaagactatttatttctctctgtctcataaggctcaccacagtctgtataacaaaatgacttacagcaactgctgagatctgggttcagatctcagttctgacactcattagatgtacgacctcagggaacatatttaaccttacttagccagggataaatggggatacttattatacctgtctcttaggtagggatatacaaaatgcttagcagagtgaatagctcagtaagttctcagccaatattattaagaaaacatacaataaggtatggattttcagaccccttgcattaacaccacagtgctccagagatccttgatactcaagttgggagtcactgtcctggaatacaaataaaaaacataaaagagcagtaaattccatctgcaagtgtttatgtggtagctacagaattcagcactatgctaggggtacagaagccaatgcaacaccaaatgaggagacaatgcagagggcagatgccggagggaagaaagaaacactggggcagagattcaacccaacctgaaagccatgcaggtgttttaagttggaaatgaaatgaggaaccaaaaaattccagtcagggagtggtctgctgagtgtggtgcttcaggtagactcccatgacaggctgcaggacaaactagagtgggggcccacttccataccttcctggccactcagttccagccaaatgactgctcttaaaagtcaaaattaggttccatttctaatctgcactgattcatactgctggtcgtgtaaattggtataggccacaccaacacagcacattagttaagatgttaatcttaactaatttccggacaatactaaaataaaatctctactttccagagattaggtaaacttggtaaacatttgagcttcaggtccagtctgacaaaatggaaaaaagggaatcatctgcagaaaggtcccagcattagaaaacaaagagaagggggaggacagtatgtaggccctgacctgtcttactgcctcaattcaaggattcaatttctcaacctcagatccttgccctcttactagttttcaaactcagatccacctcttactagttttcaaactcttgtctattatgattaccttaagcaaagcaagatgcatgaataaccagcagtaaatcaggtattcaatacttgaaattgtgtaatattctgtgactgtgcatctggccaatttcaacttctccttctttttttttttttttttttttttttttttttttgaggcaggatctcactctcttgccccaggctggagtacagtggtaccatcattgctcactgcagcagcctcagactcccggactcaagtgatcctcctgcctcagcctcctgagtagctagcactacaggtgagcaccaacatgcctgcctcattttttaaatttttttgtagagacaacgtctcaatatgttgcccaggctggtctcaaactcctggcctcacctcgagcaatccttccacctctgcacaccgaagtgctgagatttcaagtatgagccgctgcctcctgcccacttagccctttctaacactagagaactttgagagtggtttcaataccaactggacacttcccagcggtttaacctcaggcaaatcaaactcccatgcctcagtttccacatatatagagataataaaagtacctcctcaaagagtttgttatgagaactaaatgagttaatgttaggcaagcgactggaacatgatagacacaatatgtattagccattatcacctttatctcagtgttatattggccaccacccagagatacccaggagcacacacatcacattctttctacagcaatatgtgggcacgattacttcatgaccactgaatctaaaacagcacagcttggtaagacacagcggtcggatcccacctactgcaacacctctaagaggcgaccctcacaaaccagccatgcttagcctgagacattccgaagacctcctcttgattaccttactcgacgaacttattcctttgaaaatggaactagccgcacttttggaccagtgtgcctcggatacacttccaaatgtgtcaacctgaatctcagaagttggcgtgattttaaaaagttttttaagttctttttcctaaacatgtcctagtaggtgactccacagcattactttctttcatgttctcttttctatctggaaatccggtgataggggacgaaaccagcaaagcaccctttttcttgcttcccaaacgttagcaggtaagcgccccttgagccgagacacatcaagaagacctcacccgcaagttcattgatcaccggttcttttccctttccggcactaggagctgcgaagcacgacatgggcttggaggaagagacgctgcggtcacctgaggggcaggtgagagcgggcggtcctgcccgggtgtgagcgcgacatcccgcgcggcacacacgctcacagcccccagagaaagaccagaggcgctcgatgtatcccgcacaccccacacgcaacacactaactgcaccgtaccttccgtcccacctcccggcagcagaccccttccgggacgccgagagggctgttcctggagagaccgcagcccacgagtagcggcgcgtagggagagcacgcgtgcccaggctgcctcggccggcgcgcccccgcccccgcactcacctggcctgtgataccggtgatgagcgccacgttcctgggcttgcccatctcgccgtccccggagccccgggcgctggggcagcgtgccggtgcgtgtgccatgtcccgcggcgggcgtgcggtcggcggcagggcggagcgcggcagagggcaggcgcggtgccggcaggaacgcgggggtgtgcagcacgaagcgcctctccaggctgcgggcagggagggagagcgcaccgcgcgaccggccgccacagtctgacaggggcgcacgggaggccgtgcagggagggccggg
